United States Patent 6,900,016 (POLYMORPHISMS IN KNOWN GENES ASSOCIATED WITH INFLAMMATORY AUTOIMMUNE DISEASE, METHODS OF DETECTION AND USES THEREOF) - sequence listing, part 3

SEQ ID NO: 679 - DNA, 10696 bp, Human
tcactcttgtcacccaggctggagtgcaatggcttgatctcgtctcaccgcaacctccgcctcccgggttcaagcaattctcctgcctcagcctcctaagtagctgggattacaggcatgcaccaccacgcccagctaatttttttgtatttttagtagaaacggggtttctccatgttggtcaggctggtctcaaactcccgacctcaggtgatccgcccgcctcagcctcccaaagtgctgggattacaggcgtgaggcaccacgcacggcggcggaatctgttaaacacaaaaacgggagaggtggccccatgctgatcatggacttcagtcagtgggcagagatatcccagctcctgtccacaagcacgagcaagggtgaaccacagcttttcttttccttttttttttttctttttttgagacggagtctcactctgtcccccaggctagagtgcagtggcgcgatctcagctcactgcaagctctgcctcccaggttcacaccattttcctgcctcagcctcccaagtagccgggactacaggcgcccgccaccacgcccgcttaattttttctatttttttttttttaagtagagacgggttttcaccgtgttagccaggatggtctcgatctcctgacctcgtgatctgcccatctcagcctcccaaagtgctgggattataggcgtgagccaccgcgccgggccgggccacagcttttcatcttcatctggagcccctaccccctccctttccatgaggacctggggttcctcttctgtcccacacagaagtggaaatttcctccctaatgaccctgggacagtcttagacacaagcaggctgtcagctttcaagtttgttctttgatgtgcaaccttctcaaattaaagaacttttcatttctttttctgcacaaaactttcataatctacatatttcggatgtataatctacatatttcagatgtgtgtatgtgtgtgtgtgtatatatatatatatatatgtatgttttgagacagggtcgtgctctctcacccaggctggagtgcagtgctatgatcatacctcactacagcctggaccacccaggctcaagcaatcttcccacctcagtgtcccaaatagttgggactgcagtcgtgcacaaacatacctgattatttcttctttgttatatgcagagacggggtctcactatgttccccaagctggtcttgaacttctgagctcaagggatcctccatcctcagcctccctaggtgctcagattacaggggtgggccaccgtgccgggaacttcaaacataaggagcatttcttggtatttggagcagatgtgggctcttgagttggggcatcaatcatcctcctctactacggagctcaatgccaggatcctctcacaccccaaccactcctgtcttaatctggtctggaaattcaccatggccaagccccctcccatgtcccaggcaccactgagccccacatccactctgagaagctgaggtcatgaccacaagttccaaaagagaaaggctcaagcaagccactttgctgtccaaggtcacataatcggtggaattaggaagaaaattcagctccccactccaccccatgaatcagatgacaaacctgagtaattgttctgaaaaccttgaacatggttggaggcacagagggacggccaaggacaaaggggcactgaggaggcaggaacgacttagaggttcattcccagcggaggggttttgttgctctgccctagcccttggtgagctgagtataggtcaggccgacagcggctagggctcagggagaccccatttctgtctgaaatgtctgcagagagcctggagctcaccccagccccatccctggggaaatgagagccaggctcttggggagggcagttccccttcctgtggggcttccgatgggacagtcttgtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcggtgaggtttgaagagggggaaggaaggtccccgtcttggagggagctcactctaaagcgaggctctggtctatcagagaatctggtctatcagaggctccgagggaggagaggaactgctggggcttccaggggcaaatccctcacagggaactctcttccagggctgagtgtgggccccaggacctgcgtgcaggcaggtgagtctgtccccagctgtcccaggtcccttcttctcactggggacaagggcccaaccccgggcagctgggggtggagatagctgttctgggctgactgatggggacgtctggagggtcctggggctgagaactggaatctgagggatggggatgtcttgggatccagcctctgattccattctaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggtgagaggacactcaggggtcccagccccaggctctgccctcaggaagagggtcggctcttagggacgtctacctctcacagcccagccctggggatgatgtgggaggtcggagccccacttaagacgtgcctccttctctgctaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggtgaaaaagccaccacacttctttatataattttggggaaccagataggttgttgggagtttggttgatgactgatcatggcaaggaccccagaaggatgtgttgatggatgggctgaaggcgtgaggaagaccccacggggaggctcagatggggaaacaggagcctgagtcaccctcacctggaaggggtcgactcaggaaggcaatgggtgtatttgctgcaatttcctgtccctcaatgaggagaggacagaccagacagacagtggccaggagtcagagagacactatcggtctggaactactccaagacagacccaggtgagaaggaggccccgggatccgagacacagagcgtgagagacagtgagacctgcagggccaggacgccaggacgggagaaggaaggggcgggggaggaaccagccttccaagtcccaattcctctttccctccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggtgaggagcccagcgggttcagtcagggacccaggctctgcacaggtcctgccgggggaatccaattagtgatggccgggatgaggcgggggggtggtcccaagggagggagagacagacagagacaggggatgggtggggaggggaagactcagagaaaacagagacagaggctcctagagaggcctggggaggtctcagctcagagcaaggtggggcagcccctcacccatccttcttctctccaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggtgagggccctgaccctgtcctgtccaagctcaaaggctcagctcaggccctgcccccaggagagctctgggctgggatggagtcgcggtgcgggggggagggtttgaggggggctcagccagagggagactcacccctcagaggggaggaggacaacgggggctccccaggcatgcccacacttggccccatctcctgggatgcaaatggtgaaaggtgagcagaagaaagtttccagagaagccacgggcaggtggagggacgggtttcctcactcagcaccaaagcgcctcgctccctttctgtgcttattcccaggaccctctggggatcccagcctctcacctacaggctccacccccacacctggtgagtcactgaggcctctgggctcggagggagcgtggtctccccccaggcagccctgagtctccccgaggatcctattcccctcaaagactcaagcgggagcttccctccagggagctgggcagagccagaggaggggccacaggctccccggggctctgaggctgggccggtgagggggcgggcgtcgaggcagagagagatgttgggtgttggggcccagcctgggggaggagcagccgggctgatgtggggagcagggcagccccagccctcacctccccgtcctgacccagcaggccctgaggaccagcccctcacccccacggggttggatccccagagtggtgagtgaggggctctgagtgggaggtgggcggagaccaggggaggcaggggtgggttctgtcgtaggttcaggctcctctggagatggtgaagtgcacaagcccttcccctgcctgggcctcagtttctccaagtgtaaaggagagaggcctgcattgatgggattcttcaggggactgtcctgtcccaccggcagcagtgacggtgacctggggcaggggaggggagcagggccgtggtttggggcattcaggctctttccctgcagctccggggctccgctcaggtgcagagaacaagggctgcgggtcagactcctgggttcacttcccagctctgccgcatcccaccgtgggcccaggcaggtcaactttctactctgactcagtttcagcagctgtaaactggctcagtcccatccagctcacagaactgctgcgaggcgtaagcaaaatcatgggacctggccctgtacacagctcggcaggggcaccgtcctcctgctaccctcagcccttcccagatacacacagagcccctatccagacaggttctgcatgggagtatgggaacttggcagagtgggaaacggacctggctgagctgggagtgagagcaatgcagggtccgtcctgcacaacccactccctctcccaggccctgctgtgctggggaagggaggatcctaagaaggacaccagccccagatggagacactaggacaggcccctcctgtcaaataggaaacaggtgtgcacctggtggggcagcaggaggacagctggggaaaacacaaagtccctggttcccttcccagacctgcttcttccaggctgaggagcctggggcaggcgattcccctctctgagcctcagtttgctcctctgtgaattggggggttggcaatcccatgttgcacaactgctgtgagggttggagctcatgaaggaaagacctagctcgcgcctgcacacagaaggtgctcacatcaatgacgtcatccccattcccaacgtcatcacgctcaaggtctgggaaggcacctgggggttgtgactggggtctcagtggccttcgtcctgctgctgttcctcctcctcttcctcctcctccgacatcggcatcagagcaaacacaggacatcgggtgagtagggaatgggggaacccgtgggccgaccgagggtgggctcggggcaccagccagagggaaaccaaacacaaaggaaagtcagcttagaaaaactgctccagaaattcccaggtgaaaaatcgatcgagaaagaagagaataaatgtgagcatgtgtggaagtgcttgattcttctgattttactttaaacttacgacgtatttaaagcctcagtgccagtgggcctccaggtttccttctttccgctcgagttgtgtgtgcagggcagctggttcgaattctcccaggcctgaccctctgtccatctctgtccagcccatttctaccgtcctgcaggggctgcggggccagagcccaaggaccagggcctgcagaagaggtaattctgcatgaagacccaagactcccatccacccgcacagccccctcactgcccctcacactcccgtgtcctcccccagggccagcccagttgctgacatccaggaggaaattctcagtgagtgactagaagcggagggcacctggggtgggcaagggagcaccaaagtttctgtagcaatgggggcaggagcacaggctgggaggggtctggggccaagggggaggtggtctgaacccacactgtgggacctcagggacatcacagtccctccctggatctcagccaccctagtgggaacagggcaagggctggcaggacggagaagtctcagagaaccttcccaggagatgaaccccttgctctggcccagcagatgctgccgtgaaggacacacagcccaaggacggggtggagatggatgctcgggtgaggccccgcccctgtcccgggcaccaaaggcctcctggtgccagatctaatccagcaggacttctctgtcctccttcccccggctctcagcatcgtcacggtggacccctccttgtccagcacgctgcctcccgcctgctgcgacctcactctcttctgctgtcctgggacctcgtgggcctcctcccgggtccccttcctgctcctcatcctctgtttggccgtctggttgttagagctctccccaggcctcaggaggatgaggaataaatgaaccaccccggtcccccaggctccccttcattcattcaaccagcgagtgttcccagggagctcactgtggatggggctccccatgggagctgcagacacagcagggagcaaagccgcccccgcctcctgagctcacctcatggtgggagacaaaatgcaaataaatgcatcgtgtccaggagtgcaacgtgctgtaaggaacataaaccagggaaagggcagagagtgtggggcagtggggccagtctgaatggaaggggagggctgtctgctcagctgtcatctgagaagcctggacagagtggggcacacgatcctctgatggacgagcccctgcaggcagaggaaacagccgtgcaaaggccccgaggcagcagcgagctcttgcaggaaggcccgtgaggctgcagccaaatgggcaaggtcagagtgaggagcagaggccagaaccacagggagggagcggccagaccctccacggccttagggcgtccctgagattccatcaggaaagggatgtaatcggatcaccccgggaacagtgaggaaaattgactccaggaggtcagggggactcaaggacaccccccaccactgtctctctccagcagagcccacacgatgaagacccccaggcagtgacgtatgccgaggtgaaacactccagacctaggagagaaatggcctctcctccctccccactgtctggggaattcctggacacaaaggacagacaggcagaagaggacagacagatggacactgagagagtcctttcctctccaggcccccaggcctcccccacccccaccacgttccttccctctcactctcccccgctgcaggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatgacagaaagaatttagaaaaagaacaacaaattattccaaatgaaggtgtgaggaaggggacaaaaataacaagaggagttactaatgagggctacgtgaaaactcgatgaagccaaaaaagctcattcttgagaatgtgaattacattcacaaatcctagccacaataatcaaggaaaaaagcggggttcaggcacacatttccatatgggggtgaaacagcagacaccaccacaaatctgacacatattgcctttatttttttcacttttaagttcagggatacatgtgcaggtttgttagacagataaacttgtgtcaaggggatttgtcttggtttttgtgtgagggtttttgttttgttttgttttgttttttgagacggagtctcgctctatcacccaggctggagtacagtggagtgatctcggctcactgcaacctctgcctcccgggttcaagcgattctcctgcctcagtctcccgagtaactgggactacaggcacctgccaccacgcccggctaatttttgtatttttagtagagacagggtttctccatgttggtcaggctggtctcaaactcccgacctcaggtgatccgcccgcctcagcctcccaaagtgctgggcttacaggcgtgagccaccacgtccagcccatacatttcaattttaaagggatgcgccctagtccttagttagtctctcctcatctctataaaacgttcagctactcacctcttgggctattgctagacatcgttttctcttccttctttctgacgcctacaatagataggacattccccctcctcattctattctcccaagtactttaaattgcaatttataaagtttctatgctacactctaaaaaaaattctgttttgttttctaatttcataattggtgcttcactgtgtcttgtcctcgaaggaatgagtattttgattgtgttcattaaatctgatttttctatgtcttctaattattttatataatattcattctgctgtagaaaaaaaaatcatataatcctgcctcagaaattcaatgtcctctgtatttctcaaatatttaaacatgtttaacctaagatgggtctcacacattcctagtactccttttgaccatgataatcctcattagtgagtgtggattgtcaaccatagcactttgtgtttgattttttggtttgttttttgtttttatttatttatttatttattttttgagacggagtctcactctgtcacccaggctagagtgcagtggcgtgatctcagctcactgcaacctctgtctcctgagttcaagcaactctcctaccttagcctcccgagtagctgggactacaggtgcccgccaccacaaccagctaatctttttttttttttttttttgtatttttagtagagatggggtttcaccgtgtggccaggatggtctcgatctcttgacctcatgatctgcctgcctcggcctcccaaagtgctgggattacaggcgtgagccaccacgcccagcctgtgtttgtttttgagacagggtcttgctctgtcacccaggctaaagtgcagtggcgcaccaccccagttcactgcaacctccgcctgccagactcaagcgatcttcgacctcaggctcctaagtagctggaactacaggtgtgcaccaccacacccagttcatttttgtctttttagtagagatggggtttcaccatgttgcccaggctggtctcgaactcctgggctccagcgatctgcccacctcggcctcccagagcgctgggaaaataggcgtgagccatcgcaggcagccagtcatagcactttttatca

SEQ ID NO: 680 - DNA, 27692 bp, Human
ccgggcatggtggcaggagcctgtaatcccagctgcttgggaggctgaggcaagagaatcacttgaaccctggaggcggtttcagtgagctgagatctcgccattgcactccagcctgggtaacaagagcgaaacgccatctcaaaaaattaaaaactaaaataaaaatgaagcagcaacttccagagccttcacaaccaaaggctccatggacactcaagactttccttggttcagttaaatctcccacttctagcccttagcattcgggcgggagaaagggaaactgggcacgctcctcactcccactcctcccagatgcttacactcgagaaagaaggaaaacccacaggacctaactgctactgaaaatcaggagttagctggcacagtagctcacacctataatcccagcactttgggaggttgaggcaggcggatcacctgaggtcaggagttggagaccagcctggccaaaatggtgaaaccccatctctactgaaagtacaaaagttagccaggtgtggtggtgcctgcctgcagtctcagctacttgggaggctgaggcaggagaatctcttgaacctgagagggagaagttgctgtaagccaagatcgcaccattgcactccagcctgggtgacaaagtgagactgtgtctcaaaaagagaaaatcaggagttgtactctgggaaacagcaaataaggggcttcaaggaggtaaaaaccagtcattgaactgttacaatagccctgaggcaacacagagttgtattcattgcttgcccaggtcagactgtcccaagcactgtacaggatgtcccaagcactgtacactgtgctaggacgaagtgttttgcttgttttgagaaaagggttgaagagaccattctttccattgtccttcctctagaagtgtttccccaaaacattctagactcgttattcctatcctataaattatgcaggaaaggaggttctgcaccatgctaggttgggaagttcatcctttcatctaattcacagctgtccctctgtgtttctgagaaagcaaagagaggggggatacttagagggaatttggcagcactttcccctgggcaagagcctcctctttggaggtaacaagccctgagagtctcagatgcatgctgaaccaccacactgcaggaaggggtcagatgggctgaaaagaatcagcgatgacctcgactgtcaacatccccagcataagcacagagctgggtacctgggggcaggtgaattggcaaaggatttaaaggccctgatcccagcggttcctaatgcatcacccacattgacaactcagagaaaggcacagttggtggatgagtctagagtttgtaggtagagaacagggccctccacccaatccagacctgtgtcattgagactgggatgggatgcagttttgtggtcttgagaccatgtcatccctctcttcctgaatactacccccttccctagggggcagtggtgacatgggacagaataaattcacctcatacacatttgttcctggggctgtggcaacgcagtgaaagggcctgccaccttacttgaagtcccgggcaactagcagtatccagaagagaagacctttttcagggactggaggtctgtttccctcttggggaaatgctaacttccaacctcagtgctggtaacttaccactgtgctggcctctgccccacctgccctctaacaggacagtgagagtccctcttagggttaaccaggtgggttgttttttgttttgtttttgttttccccatcttcagtttggagtgaaagttaggaaggctgtgcagtagtgatgagaggagggcatgattttagcatgaccttttcctcctctccctttatgctttacaatgaaaagctcaggaaccttctccccacacagtcggatctccggaggcatctgcagggatcccaacagtgtcgggctctgcagtcggactctgcagggatccgaacagggtcgctgagaccagtgcacgagcctcttcggaagatgcatcctggactcttggccgcagaggagaaagcggttggggtctcccagggactctttctaaagggtcagtccagcatggtaggggttaacgtgggtccacgcgtagagggaaaggaaagaagttgtagttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggccgagtcggccttgcacccgattgattccgcttttcctggagagagcggccgggccgcgctcgggccgccagcacctgcccgcgcctggcgggcttcttccctctcctgcgcgcagccaccgccgcagcccccatgctccccgccccccgccgccccccggtggcctccgctcctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgctgcgcctggcgcccgacgacagcttcctagcgcccgagttcaagatcgagcgcctcgggggctccggccgggcgaccgggggcgagcgggggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcaggtaggactgagagcctcctccagccgccgtgcccggaggccccccagacgcctcccagcgtctctaaaatctccccttccaatccctctgagaaaaaaaaaaaaaaaaaaaaaagccctccccactcatcttctccagccttaccccaaacgagattctctcctgtctgagaaagagcagtaactcttttctgaacttctgccaccctggatccctgcgcccccacccccaggtcccttccagtttagagtggggctgccgacgcccatccctctcatccgaatctcccgcggcacgtggcgcactgacccgaaagtgggtatcaacgcattccccggcacctgcctctcccagcagagatgaaaattgagcgtttacgaatagctcccactcccacccctcagccctctactgcctccagatctgagaggctcccagggaaaggcagatgggatggagagagatggctgtctgattcccttgggtatggaggtcgccataagcaaaagacattgtttgaaaggagctgaacctggagaggggctgcccaacttctgtgcagccagctggttgtgatcaatggggcatggactaccttgccaacctggcgctcagccccggcagaacttggcaatgccagcagccagcacaagagggaggggcagagaacttctgcctgggggctcagcccaggagctgaagctttggtggaaacgcgaggggcgcaggggctggaacgagctctttgggtgaatgtctctagtaaagccagacccacacttggtccacccagctgcccttagcccagacacagctcttacctaaacaggggagaaaaacagagtccaggggatggctacctaaccagaccatttctaactagatgcaaagatggtgctgactcagcaggaggtgtctgtgttgccctaaaccccaatttctcccctaaagaccaggtgaaggcttttccaggaggaaaagagggtaaggcttccagaagaggggtgctctttgcccctagggagcacagaaccagagatgtgccagggaaggaagaactgacctgcccagacgtcatagttccctgaaacagggatcctggcaatgcagcagctaagctgacactttgtggtgatggcatccttggccgggacccaatactaggctcagtctgtgcccgactgctgggggccccaagggcataggcattgcctgtgcagaatagtccagacaaggaggcgatcagccttctgtttctcaccccatctttcccaccctctatcactgggaaaggcagggtaggaaagacccagggagaaacagatgattaggatgggaactgctgtgggtgagagtccacgtggctgcccctctggctactgcaggtgctgactacaccccagggacgcacccctgcaagcccttgtggtatttgcttccccaaaagcagggcagagcagctttgggtcacgctgatttaacacctgtttccctgcctgtcctgagagcacggagcggtgggagcaccagccctctcctctgactcctttctttaagcaagtactagagagtgtggcaggagaggggtgagaagagggcttctcccatctctttaggacccccacacctggctcctagggggctccaccagaaagaagctaagatggccgggcacggtggctcaagcctgtaatcccagcactttaggaggccgaggtgggcagatcgcaagctcaggagatcaagaccatcctggctaacacggtgaaaccccgtctctactaaaaatacaaaaaaaatagccaggcgtggtggtgggcgcctgtagtcccagctactcgggaggctgaggcaggagaatggtgtcaactcaggaggcagagcttgcagtgagcggagaccgcgccactgcactccagcctgggtgacagagcaagactccatcttaaaaaaaaaaaaaaagaaaaaagaaaaacacaaaaaaagtaagaagctaagatgcacccattgcaaacccagagcggggtgctacacccctctacccccacacatggaacagattctgacatctacctaagaaccaaaacataggaaagccaagagaactccgtgccagcagagaaagtccatttttcagccttcagggccagactgtctcactctctcagctgatcacctggacgctggagataactgagtatttgcctcagggacatactcgcatctccagacatcctagctatctagaggcagacatgctctgaggcccgaccccaggatgcccgggctgctgaagcaggagactctgcttgggtttgcacccgattttgttcccttcagcttaaagttcaggtctgctgccccagacaattcggctttctctgtgtcagagacacccaggcattgccatcctcatgagactcctgaccgggcgatgtggctcctgcttgccccgctccccatcccccacaaacacgcatttctggacctttcccagctgcacattggcacctgcacacccagccagcccacctggaccaggagagcgcagcaaaacaggcatcgggcacctctgaaggctgagttcctctccctagggggttgacttctgagtctcacctggaagaaaagtcttccctcagggagactagccccgccacctccaccctgggtctcatgtcccatcccacctgtgctcctgctgccaccgtggcgggtgggggagggactgaggtacagctgtgtccaggaccaccctcgggcccctgtgctatgatgagctgaccagccttggagatgctgcaggacaggcgtgactgtctcagctcagtcccctgcgcttccgaaaacagatccatgagcccagctgagagaagaatgaaaatcaagttcccgtgcctcaagaccttggctgcccacacccacctcctgcaaatggaagccagtcctttatgtggagacctcattcacacagagggaaggcactctggggtgattactcttggtaatcaggggtgtggaggatgagaagagcctttacctctctagggcttagagttcctcatctgtgaagcaggacacctggactaggtgatcaatcccggtctgagcacctgtgtggctgcttcatgatgagccagtcttctggaaggtttagccactctctgagcgtgttcaattcacagcgtggttttacacacatcacctccatgaaaataccagtgaggggggcagagggagactgcacagctcacagaggacatgtggcttcctcaggatcagacagcaccgatcaggatcagtaagtggcagggctgggcctgcagaccaagtctcccaaagctgaatcctgtgcactgttatcccaccaggcggcctctttctcaggactagggtctgtggctctgtcgaccctctgatacttgcttatgttgtgggagtgggtctttaaatccagcagttcaaagccatccaggcccactgtgaggccctatcctgcaaagaaaccgccgtggaggctgagagaaagaacgcaccactgccaaagctggtctcactatgttacgcgacaatgaagttttccagagctctgtcaattgagttcatttaatcccatgagaaaaggggcccctgtctcccaccttcttatctggtttcagagttaaggagctcagacagaggggcctttctgaaaggagggaccacctgggaagactccattagctctgtctacgtccagctgctgctcagtgtcccctgtgtgaacccggggcgagatggagtgaggggcagcatggcagtgcccactctcgccagcctgggacgcctgtcccgccagtgcttctgcagtgagcagagttttcgagtcctcttcttagcagagagggtccgaaaagtggcgctcatcttcccaaagtccagcagaacactcgcaggaggtcagattctggggactgacttcagggacggctgtcacagccatctccatgcccccttacctgcatgctgtggggaaaatgtcttccacaagacactaaagtgggcatgcagcctaggttgtccagcagcatcccagtttctgcctgttctggcataattattaatactaccgtctttccctctcaagggtgtcctggtttggatgacaacagaaacagattcatgcccccccctgctctgtggctaccagggagaaagacaagtgttatatgtgcgtgatgtccttcccattggcaaaagaatgcatcttttccatcccttatgtctgctgcagtcagaatgatcaaagatatggagtatttcccaaagaaaatgtctcagtgtccaaagatcgccccttccccatctcccaggaggtggggtgtgcataggcaatgacaggcggacttgctgcttgcaagccttgggttcactttggctaggctgcagttttccttacagcagcaaagatgggtggcagttagtacagagactaagaacacaaactttggaatgaaatcgaaataatgtagtgtccttgagcaagtcacctatttctgtgtacctcgattatttcaggtaggagcagttataccaatgtcctagccttgtcttgaggatgtaagaaaatatggaatgcacctgacctggtgcctggtccagacgacatactcagcaaggcatggctattactagagttgccttcggtgatggaaaccatttgttagagtggggaggatgggctgggccatgccatcagagtgccggccaccgctgtttcagctttgctgttccacatggcagaggaaccttctctttcagttgcccatgctcagtggtgaaggctgacttgtagttcagcgtcagcgtatgctttcaagggacaacattgctctttgctgcttgcagaacaagaggagatgaagcatatgatgcaggttgctcttttctcctctcacttctttcctctcgctttgcttctccatctccacacccccagctcagtctcaggccctagagacgtcagataggaagagggaatgcaagagcttcccggggccacttttcctcacctgacctccccccaggcgcgccgcaagggaaagctgtggagccaccggtgaagcgcaaaccggctggatgtaatgatgacatcggggcgggaggaggccggcccgtccccatcacccaccgcagctggcttcggctaccacagaagctctgaggaaggaatctccttgttcgtatctcaaagaaccaaaaggggctctggcccacccaactggccagggtgttgttatttttttttaattcatttttttttaatagagacaggatctcactatgtttcccaggctggtctcaagtgattctcccaccttggccttccaaagtgctggggttacagacatgagccaccctgactggcctgatgttcatctctactccaggtcctggggtcactcatgcacgagcagactccctaaaaagtgccgcctctccctaacaaaagtgaagagtatgggatccccaagtcattcaagagcaggttgtttgaccaccctggctgggctgaccgtgggctcccacctacctgccgtggtttggggggcggctgctctgctgatgcctctgctcctcaggggggccaggaccccgttcacattcttcacatgcagcttgcattggtgtggggagcagggaggtgtaaatcggcaccaggtggtggagcaagccatctgacttcctccttgaccagccgcaggcctgatccccacaggactctcagtcaggcctgtcctttgaacccaggatattgggggagaatcaaaggctcacagccctgaggtcccccacctcacccaggctcagtggtccttctccgtagggaactgtgagacgcaccgcatatataaggcattcctctggtcatttctcagaagagcggactgggaggggaaaaccaaaaactcagtagaacaagagataaggagagatcagtgggatcgggatctgggattttgaagggaacactggaccacagaatcctcctagccttcttgaaaatgaaaagtatcttctgagacagcggccagaaggaccttcagatgtcctcaagtccagcccacccctcgaagctaaatggctctgaagccggccctgcctgacagctatgcactgtctggagaagacaatgatatgagctgtagagaaggaggctccctgggaaccttagggccgggaagctccttgtgctgtcttgccctgatcttcaagcagcagtttattctgcatgaaaatcaggggttaaccctcaccttcctccggtcttcactgaggatgtgagcactgcctcatctctcactcagcctccctccgatctgctcaacgtgggcacacagacttgccccaacctcctgtctttagctccttgtgctgagctgtctcggccccgaagcttagcagctggtgttccttagctttacaccttccttgtgcgacctcatcttccccattttgagattgtgaaactgggactcagcgggaagaaatcttgtgatgacggttgcagtttgcctcagaagaaattccaggggttggtccctggcccatcagaccctggtccttcttagagagatcaggatactgttggcctcctggaagcagcaaagacccggccaggagttcatctcggcaagccaccattcctcagcgctcacccccggttgcataatgatgtgattgctttttgtccctccagaatccaactccaggagcaagtgccaagtttcagccttgttgataagatgtttacatcagcctaaacattgctggagtgcttgacacgccaagtaacctgccaacccctgcttgtagggctaacaaaatacctggctcattgcctgtgaggtgaacagacagatcccattcacaaataatgggattcatctggaacgcccacacatggcctcacccgatggaatgtccctctctaccctttcctttctcctccttccactcccaccttccagaccacaggaggagaggaagaggggatcccaagaggtggtgatctagggatcggagaggcagggcaagcaggtgctgcccaactgaccacactccaggctcaaggaacacccacctctgcctctgtgtctcctcttccacaaaatgctcaaagagggccacttcaaggggtcgctgaggcaggagagcgagttcccatctggccttctctccaagccttggaatccagcaggggagcagttggcagcccagggacaagacagaggccaagcagtgatgtatgctctgttggccagcctgggtggaagggagagcaggtgagatcccaagcacatgggtcctcttaggcccacgggatcctctcaagccccagtcaggagggaacgaacccttcggggctgtccaggcagacaccaggaagccacgcccggggaaacctaatgagagcacggtggacctcagagacaggcacacctgggctggcctcctggtttcaatagctgcgtgaccttcaacaggttaatttgcatgaccttcctcattcgtgaaatggaattacagcaccttcttcacagagttattgtgagaattgaatgaggtactgtggcagagtagctgttgttaggagtgattatcacagcaaagttttcagtgttaacaaatccccccccaaagagtagagttaccccaatagacaacaggaaaatgttcagctggattctaagagggaattctactaaccttgagcgctcagaactttgcttctgggctgaggccggggacgggtgggggtggttggcaaggagacggtgtcaggattaaggcagaataagccatgccgtccagtagaactttgtatctgcacattccagtgcagtagccacgagccatatatgactattgaagcactagaaatgtggcctgtgccacgctataagtttaaggttttggattttaatgaatttggatttaggtcgtcccctgaagctgtcctggatgttagacacacaagttcggagcaaggcaggtctgggttcaaagaccactgttcatgcatcagctttgtgacctcgtgcaggttcttgagcctgttttctcacatgcaaaatgaagggagtaacacggagacctcgggggtattgtgaggctttggtaggaatctgatgctcagccccataacaagaggtgatggcagcggacaggccaggccaagggccctgagacttaacccttcactccgcctcttgtctcctccttcctgacagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacaggtccgtgcctggctccggaagccctggggaggaagggagacaggatgggcagatcaaagggaggaccacgaggcctgcccaaacatgggaaacgtctccctgctggccccagctggacgccagagcctcatgcccagaatgatgaggaggtcatgaggacaagtgtgaggtatttgcaagggaaggagaagaatcttgtaagggctctcttccaaaagtttgtgaccagctgtctcctgaggtcacacataacaagaagaaatgggctcaagctgcccagtgagagatctgggcttggaatgaagagagtagttctagctgcagtggttgtaaaacacaggggcaggtagccagggggtcccctcaagatctgcccacagcaggagggctgcccacctacacggcatgacttaaacagacagcttcctgaaagcaagagagcgatcctgtgtgccaggccctgtctgctccttcagtctcataagggccccatcgggcaggccctggtgttatccccattttgtaacagagaaaactgaggcacagagtggccacacagctctcgtgccacatagcggcagcgcccatagtccagccaagacagtgctgctgtagagtcatgttctgaatgactgtgctgtcctgtccccacaaaaagcctttgaagtcccagccagccctaggatgcagccagccctaggatgcagccagccctaggatacagccagcctgtaacatagaacaggctcccttacatgaatggctgatgtgaagacagacagagatttcccgatcttatcactcagaaatccatcttgatagcctttgtattttatattctttttggtttttaattttgttttgttttgtttgagacaaggtctcgctctgtcacccaggctggagttcaatggcacaatcacagctcactgcagcctctgcctgctaggtccaaatgatccacccacctcaagcctcctgagtagctgagatgacaagcgcaagcaccttgcccagctaaattttttttttttttttttttttgctttttgtaggaatggggtttcactatattgcccagccttgtctccagctcctggactcaagcaatctacctgcctcgtcctctcaaaatgctgagattacagactgtttttattttttaacaaaaggaaatttcacaggttactctccaatttagaaagatgggggacgggtgaactggcttgaccataaacacaaaaagaaccaataaagcgaggccactaggtgggatatccagacacgttgaaactgctgttgcgtcttcctccttaaaaaaggtcagccaggcacatggcaagcggctgtagtcccagctacttgggaggctgaggtgagagaatcacttgtgcccaggagtttgaggctaagtgagctacaattactcctgtgaatagccactgcattccagcctgggcaacatagccagacctcgtctctaaagtttaatttaggccgggcacggtggctcacggctgtaatcccagcactttgggaggccgaaggagccggattgtccgaggtcaggagtttgagaccagcctggataacatggtgaaaccctgtctctactaaaaatacaaaaattagccaggtgtggtggtgcacgcctgtagtcctaactacttgggaggctgaggtgggagaatcgcctcaaccccataagcagaggatgcagtgagctgagatcgtgccactgcactccagcctggatgacagagcaagactgcatctcaaaataataataataataataataatttaatttaatttaaaagctcaataaatgcaggtgatgcacaggccagcaaacatgttatgggacgctcagtggtccactcccacgtgcacgctggccacacccggccctgcaggcctgcagcgcaccccacacacacactgatgcactctcttgctctctccccgccacgcagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactaggtaagatttgctgtgccaaagcccacttcaccacatcggagggaactgctcttccagatccaaggttgcgtagatcctaaggaatatgcggcccttgcttaggaatagctcctcctaattttgacagggtgactgtatacaaacagataccgcgcttgacagtgctgaacacaactccgctcccaccccgagcacatggccaaaatacaaaagcagcatcccacacgattatcacaggtcaccgggcaaatgccaggacacaggacaccagacacgtgctggggtggaggcgtggagctgtgcacaagctaagccgtgggatctgggggaagaacaatggtccagggactgtcatgtgagagggcaaataacagagctagatccaaattcaggacgggctgaggcagaaaataaaggggtatccgtgtttcttagtcatctgagaacgcgtcctggaagagcaaagcgcaggggaaagccctacgcagaaatcttcggagagtgagggggtggctgctcccctgaggagctccatctctgtccctagctgggccaggtggggcgccctcaggcaggacagggcggagtggaccaggcctctctccccagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggtaggcaccggcggccccgccctacttgtccccgtgggcctccttccactggtgctggcgcagagaccccctccagctgtgcctcctcacagggcccttagagctgagtccccggccagcctcccacgctggggcattcacaccacccccgaagtctgctcttctggccccatcttccagcagccgagttctgcgctaatttagattagtcacaaggcagggggaagtcatccgagaaggttgtctgaaggaggagggtttgagcagcgcttgaaggaatagaagcacatagcacagaggagagacgaacctacaacagctcaggcgtgacagaggcagtgactgcgtcctgtgagagcaagagggcggggagctggttcaaaggactggagccaggcatggggtgcacacctgtggtcccagatactcaggaggctgaggcaggaggatcacttgagcccaggaggtcaaggctaccagtaagctgtgatcatgccactgactccagcctgggtgacagagagagacgctatctctttaaaaaaaaaaaaaaaaaaaagggccaggtgcagtggcttctgcccgtaatcccagcactttgggaggctgaggcaggtggatcacaaggtcaggagttcgagaccagcccgtccaacatggtgaaaccccatctctactaaagatacaaaaaattagccaggcgtggtagcacacgcctgtagtcctagctactcaggaggctgaggcagaagaatcgcttgaacccgggaggtggaggttgcggtgagccgagatcgagccactgcactccagcctgggcaacagagctagacttcatctcaaaaaaaaaattgcttctcagaagaggggattaaagaaaaaacaattttaagtggttggaattgttggtaaagtaatattctagatccttctcactgagggagacagggacatgtatgatgcaaaaataagatgatccagacagcattatttggtcttcatttgcatgctgtggctttcaggagcacggttaggttgtgatatggatgaatattgtgttagctggcattcactgggtacacagaatgtcgggggcaatgcttcctagatgttcaggacagcaaaggaaagtcggtcctgaagagcgtttgcaactgatagtcaaaaattaggcatgctctcactagatcatcaagtggtgacagcttttagttggaggtcaagaagtcgtgacacctagaccttcagtgccatccatcacaggccatgaagagctgagagggcggcagccctgtgcatgttcttacacccctgcttcctcttttcccaggagactgtctcctggatgcccctgctgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaaggtgagggacagcccctgaggatagcggggaggggaaaggagaaacaaaaggaaatggggaggactgagggctgttctccagaaggaaaccacacttgagagtcatgaaccgagagacagccaggcagagcggctcacactggaatcccagcactttgggaagctgaggcagaaggatcacttgcaccgagaccagcctgggcaacatagtgagatcctgtctgtacaaaaaaataaaaaataggtcaggcatggtgactcacgcttgtagtcccagctactcagaaggcggaggcagggagatcacttgatctcaggagtttgaggctgcagtgaaccatgatcatgccactgcactctagcctgggcaacagagggagaccctgtctccaaaaaaaaaaaaaaaaaagaaaagaaacttcgggccaggctgcaacataggacttctaggtaaaatcactcatcttttaacaaacaaaccaaagcatatttatccacacggtgaggagcccgtgaaggctatcccctcggtcagtgggttgacactgccgtggctccagacattagggagctgctttggggctgcctcagggctggtgcaggtgcagattggtgagcggggtggagacaggaaggtgagcacacaacagatggagccactgtcaattccgtcatgaacacagagacacgcggaataaattccatcaagaattgagtgaaaagtattcatagcctgcccgtgcttgaactgaatgcataattacaggttgggagaatgagagcagttgtgggaattccgtattcaaagaggaggagaggagacagattcagagctgcctctggccaggcagaaaaaaacttggcccaggagagagtaaactcacaagaaaaaccaaggcagtgccagtgagggtttttaaatgattcacttctttgccctgctctgaatacatccaaactgtgaggctgatcgcatttctcttactgtgactcatggagccatcactatgaaacagcatccactgggtttcacagcccggtccccgccagcgctgaatcgccagggtggcccaagcactcctcagtgcatgtcttttgcactgagccttgggagcccgcctgcaccaggtaagctctgtactcttgtcctaagcctgagctggtgcaggattcatggactgatcctcagccacctcccattcaccctgttcattctcatcacatgttattgaggggagagcagagggatctgccaccaatcccagagcacagccgagctaagtgcagggagaggttgacgtgaaatgatcatggaatgatgtgtggcctctatttttaagaagtcagatcagaaaatacatatttatagaatcaggccaggtgctgtaatcccagcactttgggaggccgaggcgggtggatcacctgaggtcaggagttcgagaccagcctcaccaacatggtgaaaccctgtctctactaaaaatacaacaattagccaagtgtggtggcaggtgcctataatcccagctactccagaggccaagacaggagaatcacttgaacccaggaggcggcagttgcagtgagccaagatcataccactgcactctggcctgggcgacagagcaagactttcaagaaagaaagaaagtgagaaagaaagagagaaagagaggtagaaagaaagtgagaaagacagaaagaatatatacatagaatcatatcttttgtaaaataaaagcattgcatttttatgatgatatattcagagcaaaagtatgaaaaatattggtgaaaatcatgttaatggttttatctgggtagtggtgttttaaagaagtgttaatttcttttttacacttttctgcatttttttatttgtcgtatgagcaactattacttttataacttttaaaaaattattttcattttgaatactctatgaacctttgggcatacagcattccaaagggcaaagctttgttctcataggtcagttgtaaaatgggaagcagggccaggcatggtggctcacacttgtaatcccagtactttgggaggccgaggcaggttgatcacttgaggtcaggagttcaagaccagcatggccaacatggtgaaaccccatctctactaaaaatacaaaaattagccaggcgtggaggtgtgcacctgtaatcccagttattcgggaggccgaggcacaggaatcatttgaacccaggaggcggaggttgcagtgagccgagatcacgcctttgaactccagccttggcaacagagcaaaactctgtcaaaaaaaaaggaagcaattctgtttctttcccaagcattgtcctatcaccagaaccagtggctggtagactatggcaacacctcgcagggatgtttcctttagaccagagttcctctgccttggcactagggacacttaggactggataattgttaccgtggggcctgtgcattgctggatgtggagcagcatcactggcctctacccactagatgtggtcacgtacaccctccacagctgtagccaccagagtatctccagacattgccaaatgtcccctggagggcagaattcgccccaacggagaaccactgcattatatgcaaccttattcccataaaagggtgtcattcattcattcagcagatagcctattgagcaccttactaagcataaggcactgttttagacactgaggagtcagtagtgaatgagtccagcctggtctctgtgctcacaaagccatgcaggccacacagtcattaaacaaatgattgaggcagtttacggcactccatgcaccaagatgataatgactagatgaggaagccagggcattggccacccagtgacacagatactgaagcctcctggcctttgctcctcattcagtgtgccattgtatgttgcagcccgtggcagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacggtaattaccactcagggccgcccctgccagagcagctactatcattgctatgacgcatccccagaggatgtgtaaagtgggagtgaagtgggtgtcccgggatatagagttactcccagaggggagtaaattgggtctcctgggatgtagagttttgcctgtgatctccacctaaatgggctctgcaaggttccaatcccaggggcagctctcagggacccgggacagctctcatagtgttcagagagcctggcaaagtcaaggagagaaattacgctcatcttccaagatgtggagaggaggacatcactcccaaccaaacttattggggaggagcctctgcagaggggctggtgtctaggaaactaatcctcctggaggcataggaaccctcatctgtgtgcagaatggaagcattttccaaagcaagtgtcagagccaaacctccaaggtctttctagccaaaattcagcccagggcagagggaggatttctgaatctgattcctgttcacattccttctgagaagagttgcccatcttcccttgggaacatggcaactgtttgacagaatcttcccaggaaggaatactacctctccctccccttggcatattcctatccccagtacctgctggaaaccatgaacattaacttagaggcagtaaaggggcagcagcaaactcgtgagagggaaatcattacaaggtttttccccaccatcccatccaactgcccagtgtgcagctccaggaaggattggcaggcaagaaaaatcaggcagagccttaggagagattcaaccacgggaaaagacactggcattgggttgatgtctcaggagaatctgtaggctttgcggtttcacaagacaagaaggatccacaatggtttgaggctctagaaactttgccctggaattgtatgagagtttgcctggcatacagggtgagacgttgctgggaaagggggaggatgagaatgaatatagggtgcaaggtaggtgtggacgaaaagtgatgccatgatgtcagatgcaccaaagtctgccattactgtcgagtattttttagtattttttgtgtgtctagaactataaaaatgtatgaaaatgtaaaaggcatggtctctgtccctaaggagcttgtagtccaattagagacccaaatccctttaacacagccattacatttcaatggatgagtcacagaccctaggttggtgaggcgctcggagaaaggaaaggctgggtgagcggaagctttgaaaggagttaggactgagcagagtctggaggactgagatgggtgaggtgtgaggggacctgccagggtggtggaaaggtgtgagaagggccctcattcacttaggtggaatcaagcaaagcacaccactatgtcaaggccagaccacagaggtccttgaaggctgacacagtatctgggagttatctgtgccacctgtcccattaagtcacctggaagctcctgcagacacagcccagaccccctcagctgcactgactcagagtctcaggcgtggagtatggcatctgccttggcaaagtctccccaggcattcagatgcacagtttgggcagggaaccttggcaggaagaacagctttaattttaggatttgggggtggaaagcaacccacatctaacttcagatgggttggtctggcagcagcacgtggcaggatggagaggaggcaggcacaggtccccatgaagccagcaggcctgggcttgtggtggtgagagtgggatgccatcgttttaaatcacagattgtcctgaatatagtgtgggtctttgtgacagtttggaaatagcagatagagatgctcaaatgttcgggagataccaggataccagtctcagacttgggcatggtaagatcagcaaatgaaagtcaagacagttcgtggaaggaccatcgggagcttggccatgctgagttggaggtaatcacagtacatacaaacggagctccccagggacacccagaattacggaatgtgggtgtaggggcaagatcagagctagacatgtagatttaggagtctttggattcatgtccggtgtcactgaggaaatcgatactgcacaattagtagtgtcctgagaatatagctccacatgccattctgtgccttccaagcttactgaattgttccctgttgctccctgcgtttattcacctgtagagtacaatgagtctctttccctaatggaaagggcatttatcctagaaagcccagcatgcggctggaggctcctttccttgcccttttgagtaagggtcacacatgcgtctaggaatgttgtgcccagaagacactggccctgggcgcctgggttgagttcaaaaccaaaagaaagaagaaaagtgctgtaaattcgggatttctccaccggatgctcctgcttccgcatgggtgtcacctccatgccgtttcttcctctttctagggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgagaatcaccctgggactcagatccagagatggggaggaaggtcgcctgtccccacacccccgccccccggcaggctgcttctgtgctcaacacgccctccctcaccttccctttccccgttgcaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaagtgagtctccccagaagttctgtaccttgcttggtagaagagcataatgggctttgcactctgctaggcccaaattgaactgtggctgctacttaatagctgtgagggttgggcaagttatttaaactctccgagcttcagtttctttgtaaaatgtcagcagtatctctatctcagagtcgttgtaaggatttcctgagatgggatgtgcacttggcagtgtcgagctcatagaaaagatagaacacagggcagccgtgacttttacgagggctggaggccatgtggatagggagctgtcatctctgagtcaatcgagccacactgagtaacctggacctctgccagaaaacagctctcccaggcctgttttgggaaggacgtctcaccctaagcctggcaagcccctgtcctttctgcagatggatcttcagagaagggggttaccaaaaaggggccctggcagcctcagggctttcatgaatctgagaactccagacacttttttctcatcctaatgccccacattcataaaactccaaggattttccaaagcgctttcatttccatggtctcatttgatttgtaaaataagtccatgaggtgagcaaggccaatactattcctcattttgcagaggaagaaattaaggcacagaaagattaaatgacttttctaaggtcacattgatggttaatgacagccagaagagaacctagttttcctaagtcctggatgacttttgtctcccattccatgtacttcctgcagagtaagggcaagttcgggtgttttatatgggccacactctgcctgtctgcctccagtacatcaatgtgtcctagggcttatgtgagcatccacctgtccagccacttcccccactcacggtctcagagtttttgagaagtgttcactgtattgtattctacctagtgaagctcgcaaaccctgccccattctgtgtgtgtgtgtgtgtctgtctgtctgtctgtctgtctctacatctctcatctcaccagtctgagagaacagaatcagcctacagcaggcaacttgggactgttttcattttttttaatttatttttattattttgagacagagtctcactctgttgcctaggctggagtgcggtggcacgatcttggctcactgcaacctgcttcccaggttcaagcaattctcctgcctcagcttcccaggtagctgggattacaggcatgcaccaccacacccagctaatttttgtatttttagtagagactgggtttcgtcatgttggccaggctggtcttgaactcctggcatcaagtgatccgcccgccttggcctcccaaagtgctgggattgtgggtatgagccactgcgccctgccttggaactctttttacatttaagctcaaaagacatagaaaaagagaagcagacactattcagatactgggtcccttggccactttccctcaggctttagacagatgggcctgtggacactctaagagtctgaaactaagcagctagccccagctggacatatggtaagaaaagcaaaaagcccgcctgaccactcgcctcactttctccccagcctatggaacccagatttccagaaaagaacaaacaactaatctttcttcatcctacctaaagccctaagcctataatggactggaaacagtttcccaaaactgcttcctatcattccagaagcacagtgctcatggtgcctgggcactcccagaaggtggcttcaaagaagcaggcttaaacccccaactcccaaccccaccctgatcccaccctagggccatattcatcaaatactaggagccgactgactcagagaggtggtgtgaaatttccctcctgttcacgttctggaaggggtgtgtggaacagttttttccatgtgggtttgagctctgggtatggaggtggccaatcaaagttgtataccagtgcaaggagctagaggtatttgagatcacatttgacaggtgccaggtttggctacaccagtgcagctttccacatccttctgggttctcctcgtctctatgctgttctcaacacccacatacctcaactcctcaaccacacttttgaaatagagttgccagatgaagcaaacacccttgaaaatcccaatgtacagacatttctgtctgcctaaacagctaatttattgagaactttgaggcaacttgcttaattacttgctttgtttttttcgtgtctgccacctggggtgcccacttcagtctccaaggcatcatcgtgacctgggctgggcagccactggtctaagggtgtccttctgtttctatcacagttatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgccaatgcagtggtctggtctgattcattgtttctttggaaagggcagcaacctagaacccagggatggaggctgaaactaggtcagcagctggatccctgcctgctctgggtcctcacaggcctgcagaatccagctcattcgggcaactttcatttgcaggatctagaccagtggttcccaaggtttcattaggatcacgtagagggctgtgaaaatggattgtgaggctgggcacagtggctcacacctgtcattccagcactttgggaggctgaggcaggaggattgcctgagcccaggagttcaagaccagccatgacaatatggcgagaccctgtttctataaaaaattaaaaaacgaaatcagtcggtcatggtggtacaggcctgtagtcccagctactcaggaggctgaggtgggagggtcacttgagcccaggaggttgaggctgcagtgagccattttcatgccactgcactccagcctggatgacacagtgagaccctgtctcaaaaaaaaaaaaaaagaaagaaagaaagaaaagaaaacacagattgtggggccccatccccagagtttctgatctaatggttggggtggcctgagaatctgcatttctaacaagttcccagtgactgacatggaggctgctggtttgggagccacactgtgaacacctgtgctacaggaaacgtccagctgggagatcacaattgttatgcgatgcctttgggctcatcattcttgagaaagaatatccccttcctctctgtgagctaccccatcatcctcttacatgctgcctgcctccttttagtttagctgggggcaccagatcctcagcccctactccgctccatagctcctcatctctcctgtggctcagaggaactctggctcagtcttccacctggtctggtgcagagggaacttacttagtccctgatcacaaatgggtgacaagaaacagacatcaagaaatgacattctagcaaaagaaggaaaatacccaaatgtgcatcttggtttttttcaccacctgtgccccctttgtcctcccattcagatatctggcaccatgggcagagaggatgctgtaggggcactaggcaaggccatgagattccagccccactgttccccttagctgctctctacacgatgacagctgactcagagttggtcactccttcttgtctgcctactcttttcagcgagtgggaggctgggcttacctaagcataaacaggcacacacacaggcatgttgttgatgactagcaaaaccagattgtttccctgctgtgcaccagttttgtggaggctgatgtatgcttccgcaactcttcatcgccttccatttctcgctctcccccaaataaggccaagcgtgtcccccttaacggcctaagccaggccagctgtgccatccctgctgcctgcatcattaccaggcacagcttttgccctggagttcagctggcagcagagctgctgatgtgcaaagcagaatggaatccagcttggctctcccggttgtgtgggctcggcgaggctctcagaacgcatacttgtttgtgtctggaaattcaacagctgcagcccagggactcagaaaccagat

SEQ ID NO: 681 - DNA, 22345 bp, Human
aaccagatccagaacatttccagcctctcaaagactccttcctgcccctcccagtcagagacccccaagggtgacgccattctggcctgttgttcaacttgacttgaacaacccttcaagtcaagtttggatctggcttcttctgctcagttgcgaggcccattgatgtttcctgtggcctagctcctttttattgccgagggctactctgttgtatgaaaaccacaattcatttctcccttctcctttggtgaacatttgcactgtttccagcctggggcaatgatgagtaaagctgttaaaaacaggcacatatgttttcctttctcttgggtaattttttagaagtagaaaagccagaacatagaagtagatatttgactgtattacaactcaccaagcagtttttctttttattttttatttttcaattttttgagacagagtcttgctctattacccaggctggagtgcagtggcgtgatgagggttcactacagccttgacctcctggggtcaagtgagcctcccacctcagcctcccatgtagctgagaccacaggtgtgcaccaccacacctggctaatttgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcgcccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagtgagttccagggctatgggcacagggctgcctcagccagagggacacagctctggggctctgaggaagcaactcctgggtggcaggggatgggggtgggggcatcccaaagagaacacaagcagggcagaaatatcagaggaggtcatcctggcacacctgtgccgtgctgagctcactcatgcctggagggatgctccttcccacgagtcatggctttgacagtgttgactgagctgtcctgtcctgtcctgtcctgtgtgctcaggggaagacatgtagagcggggtggttcatgtaaagaggaagcaagcacgcttctgggacagtaaggacgctacccggcatggtagttaagggtgcttactgtgaaggtggcctccctgggtccagctatttactggctggtggtctctgggcctcagtttccatatctgtgaagtgggaataatacttgagccccccactcccagggttgggatatggattaaggaagtagtgtatctagtgtgtttgaacagtgcctgacacactgtaggtgctttgggagtgtttcatgttattgggtgtctgagggcagcagggaagacctcccgaggaggtgtctgtgctctgaaggttgggcatgggcatgttcagggcatctgtggaggggcagtctcagaggtgagaggggggtgaggactgtccctgcagcgtggggtcagagggcggcaggtgccttgctgaaaccctgtgaggtttatgagtccccttcatacacggaaaatctgaggctcagggaggcagaggccagttgccaaatgcctccagatgggagtggcagccccaggagcccaggagacttcaggggtcactgtgtcctgggccggctcctgtcataggatctcaccccgccttggcaaagagcttcccgaggggctggagagggtgggctgatgggtccttcctgggtggggaggcagggtggggagggtgggcagaggcagggtactgagggagggaagctgccatggcccacctcggcagaggccagggtcgggcttgagtgccccctggtgacactgagtccagaatgaggctgcctacgttctggtctgcagagctcggctctgctttctaaactccagagagaaagaatggggaaaggaggcctgtttcctcctggctgtcaccaatgacacctcagccaccctgtggaggcccctgaggtaggacctgcacagagggggctgggggaagctggaacaggccgctggtgggggccttagggtcagcaggtgctgccttgggcatgtcaccctgtctctggttttctgtcaaagaggggatcccagagcttcttccaggttctgacatattattattctggtgactggtttttactttctaatccttggattcagaaggaaaattatcctacggacatcagagagttaaaacagggccttggagtccagacaagaaagatgatcagtgcagcccctatgggtgtccagagtacccctctaccccacgggggctcccctgggttgggacaattaagcctcacttggtgacccatctggcagtcggagccacgcttcctccacatgccgacagtgggggaaggtcacgcggttcgctgtcctgctgaggagggctgagtgccatgagggcctggcttggaaacctcactcccacttcttgtctggcctcatctagcccagcctctttggagggcctgggggaagctggaaccacgtgctgtgtggtccaggaagcactgggagagccaggaataaggatgttctcagcttactcatgagaggaagcctgtgtggtggttagaagcgtgggtgctggggttcaaatcccagctctgttgctgaccagttgtgtaactttgagcaagtgactgaacttttctgtgcctcagtttcctcatctgtaaaagtggccggggttgctgtgaggataaatgttcctagtcatgcccagagccctcatggactccaaatgccacagcagccttagctggtcaacctcaaaacaacacatttgttcttacagtgttggaggtcagaagtctaaaatcaaagtgtcatggaaggtggccagcaggaccatggagcctctgaggcagcggggcaccttggctaagagccacgtactggcctcctgctggcacgcagtcttggccagccaggctgagctccccacttcggggtcgggcctgggtgtcctctggtgatgctgagtccaaaacaaggctgcccacattttggttcacagggctcagctctgctttctagacttccagataagaagaggaggaaaagtccccggtctctgggcactatcaggaacagagagcaagtcatgactcagcagagggatcgatttgttcaatgcaaagagctgcactgtcatgtctgacatgagccaggggctcagcacacggaatcgcacccagtcctctcagaacgctgccagccaggggctcagcacacagcgttgcacccagtcctctccagaacactgtcgggtggtgttactgtcctgccattcagaggagggaactggggcacaggcaggtcaagtgacttggccagtgtcagaattgctagtgtacagagctgggaggcaagcccagtcccgtgggaccataaatccagtgtgaaaatccatcctcctgcaccacatggaacaaaagcaggtccggttgttttcctgggttttctggacacacttatccaaattccacagcagccttggctggccaatcttaaaacaacaaatttgctctcttaatgattttgaaggtcagatgttaaaatcaatgtgtcagcaaagttgtttccttctggaggccccaggggaaaatctgtttcttttccttttccatcttctagaggctgcctgcaggccttggcttatgacccctcctgccatctttaaaaccagcagctttggctgggcccagtggctcatgcctataatcccagcactttgagaagccgaggcaggaggatctccttaatccaggagtttgagaccagcctgggccacaaagtgagaccacgtctctacaaaaaatagacaaacattagccaggtgtggtggtgcatgcctgtagtcctagctacctgggaggcggaggtgggagggtcacgtgagcctgaggaagtggaggctacagtgagctgagatcgcgtcaacacactccagcctggctgacagaatgagatcctgtctcaaaaaaaacaaaaaacaaaaaacgaaaacaaacaaaaaccccccaaaaacgcaaaccagcttcttcttgcttctgtgcttctgttgtcacatctcctacctctgacactgatcctcctgccttccttttataggatccttgtgatcacattgggaccacctttaaaatcaggacaatctccccatgccaaaattactaatttaatcacatctacaaagtcccttctacaacatattcacagtttccggggattcgaatgtggatgtttctggggggtggcccactggtaaccagtgttataagtttcttataaatccttccagatatattttatctataaataaataaatgcaagtccatagacttcccccacccactttttatacaaatggcatcattccatatcagtgctcagagttctgtcttcctctttttcttttctttttaaggctacacagaacctattaaatggaaataccctaatttatttcacctttttcctgtcagaggacttttaagctctttccaatgctttgctttataatcctttgtgttataatgctgcaatgaataaccttgtttgtaggatgatattcaatttaaaaactcatttttcaggccaggcatgatggttcatgcctgaaatcttggccctttgggaggccgagccggaaggatcacttgagctagcccaggcaacacatagagaccccatctttacaaaaaatattgtaagattagtgggacatggtggcctgcacctattttgtcccagctattcgggaggttgaggcgggaggattacttgagccagggggtggaggctgcagtgaaccatgatcacacccctcactgaactccagcctgggcaacagagtgagaacccatctctaaataaataaataaataaataaataaataaataaataaataatcttgtttttccgaattttgggggcactatttaagatattttgaaacctcacagagcttttttggggaacttgttgccttggagattagcctgtcctgtcccgcccccatgatctgtacttcctctttctccctcctggcttccttaattaagccttgtgtgtacttgccagcccatgtccatcacgctctgccttcaattctagatgctgtgctgtgaatacacttaagtggaggccgcatgcttcccaggagggtgtgtattttcagtgttgtgtctcatgatagtatgaaaggctctggagagaatcacaggcttccacaaacaggcaaggagaaaaatgttccacagacatgtttcagggaaaacaggcttcccaatcctaggccgtgctggtccataattggatcaggctgactctccttcccctacactgctggtgtagacagggacaagaatgagaagtcagagacacagagaagctgtgatttgcttgaggtcactaaagtacttaatggcagagttcagacctgacctgaggggcaacaaaagacacccccctcaaatccatggggagcagagtctaactgaatcagatcccagatttcctggggctctcacggtgccaggtgtgtacactgagctaggatgggtttcccagggttctgtgtggtcacacaactcaacaatacagaccagaaagcagtggcaagtaggctgaatttggctggtgggtgttttctgtttggcctgcacagtgtttcttttaacgttttattataggaaattcaaacatgcagaaggaattgtaccatcaacaacacacacccatcactctgctccaacaatgatcaactcaggcctatcttgcttcatcctataccctccctcgcttgcttccttcccaccctcagatatgtggaagcaaatccaaagataccattccatttcaaatatttcattttgtatctctataatatgggaatttggggggtttcaagacaggatttcactttgttgcccaggctggagtacagtggtgtgatcatggctcactgcagcctccacctcccaggctcaagggatcctcccacctcagcctcccaagtaactagagttaaaggtgtgcaccaccacacctagctattttttttttattttttgtagagatgggggacccattacgttgttcaggctggcctcaaactcctgggctcaagtgatccttctgcctcagcctcccaaagtgctgggattatagatgtgagccactgtgcccagccaggagcttttacataatcctttttgacaaattttcccccaagaaattagaaagttttatagaaaaaaaaaatccggacttctgtcttctcttaaaaatttggaagctctgccaatactgggcccagatggcaatcactgcttagcacggagtagatgttgacttttcagatgaggggtgtgacatctactttgccacagtccccaccactcccccacctggccatctcacccatacacatcacctgcctggctcctttaggcatttaatttgtgtaggaaattgacctaaaggagatattagagaagacattaaaaacttgaagaatgtgaaaatcagccaggagatagaactgtgctttaatgcgggttatagaacgacattggatatgaagcattttgggaataaactttgaaaattggaagtaccagtttgtgaattttgctcagagagatgaaggtggggggtgggtgacagtggtgaagcatctcctatgtgccagtctcttttaccacaggctgtttctcacaaaatcatcaatcatatgcagtaggagaaacacctttgtattttacggatgagaaaactgaggcacagagaggtgaaataggcttcccgaggtcactcaggtcatatgagcagcagagctaggattcagacctggagttggcctgactctaaaacgatgcatgcctcaccatggcgcattgctcctttaaagagcaccagaagagagaatttgacaaagtggttgcccgtggggcctgggatgggtggggaaactatgctagggctctgggctgctgagggcctgagggaaggaatggggagcccgggcgcagaagtagaggagggggctgccccacggctacagaaggcatctgggaagacactttgctgaaggtggccaggagggcaaaggtcacagtggccattgttatatggtggtggtggggagagggggatggcttcttcttaaccttctcgggtgagtcgaaggtttaccctccagacccttgatgggtcccttatgtcccttggacatcctgagtccccagccagggccctgggcgctttgctgggagcttgacataaggtccagcagcccccattgctacctaattccttagcagcccagggtgtctgcctgctacttccctgcctggaaggaaggccttctgcctggtgcgttcctgctgcagcctccactgcctcttagactctcacacaagctcagctccctgtcgcgtcctctcagggccaggcttctccttatcacaagcttagactgtctgagtaactaattggatttgtgtttgcctccacacaggaccctaagacccgtggggctgcgactccctctgtactggtcacagccgcaccctatccccttgcatggcgctgtcaaacccaggctggccactgactagcgctggaggggagcaaacgggaggccggccacctgactgatggtcccacaccttctccctgcaggctgtccccttttctgggactattcaaggaggtctccaggacggacttcagatcactgtcaatgggaccgttctcagctccagtggaaccaggtgtgtgtgtatatggatggaaacgtttcactccagcctcgtcccttagtaaaccactgtgcctgtgagcctgggttagttcaaacagcaacatccaagctcacgtgcctggctcaggggaggcccaatgcgtccctaacccatgccacagggcagcactccacaggcacaacctgcacccaggggtgccattaacctggactccaggatgaatggggccctgggagctgacggtctaaggagggcgtgggatggtcagagttggatgattatgttactgggttgaaccttgcacactgtgactaagagttgcaaaaatcaaacttcctccatttcccgtaactgctctcatccactctgaagctctccttctgctgatgtgaaaatattgaaaattgccatcaaaagtaatttggtctcttttggtttcaaggccttttctagaaactactaagtcaattcaacatactaacattgtatcagggctgtttcccaccccctcctccctcccaaggtgggctgtctgggaacagagaagagctcacatggcttctcagtggctgggagggctctagaccctcactcaggcctggctgacccctgccgaggcaccccgaccgggtggcacagaggtgtgcagctctctcctggtttagtgggggaccatgggtggctgcctgctgaactctgcggggcccacagaagagcctctggactcatgactctctctcggaagcctctctgcctcagtcccaggggacctctccttaagaccttctgggcctcacagatcccagctaaacctcagcttggacacctagattcttggtgacctcctccgccattgccatcctgctgtgggacttctctgagagactgcggtgccctcaggagatgccaagggcagggaggccccgatctccctgaaccctccaaccaggggaatcaggaccatgaccctgatcttccgccccttcctctctccctctccctccacctcccccaccccccagcaccaggagggcttcccactcccatcctgtcatatagagacagatcctacctcagagggccctctcctcttgggagctttctgtctctcccttccttggggcaggaatttcgaaaggactacagggatgaagctgaaggactccaaaggaaaaaatacatgcagatatatttcaaatgcaatcttctccatttattcatttaattaattaatttttttcttttgagacagggactttctttcacccagcctggagttcagtggtatgatcatagctcactgcagcctcaaattcctgggcttgagtgatcctcccatctcagcctccagagcagctgggactacaggagtgcactatgatgcccagctaattattattattattattttgagatggagtctcgctctgccaccaggctggagtgctgtggcgctatctgggctcactacaacctccgcctcctgggttcaagtgattctcctgcctcagcctcctgagtagctgggactacaggctcatgccaccatgcctggctcattttttgtatttttagtcgagacggggttttaccatgttggccaggatggtctcgaactccagacctcgtgatccacatgcctcagcctcccaaagtgctgggattacaggcgtgagccatcatgcccagccaatttttttttttttaactagagatgagctctcactatgttgcccaggctggtctcaaactcctgggctcaagtggtccacccgccttggcctctgcgcccagccccaatttcacatgctctttacatttgttctcttctttcccatttaatcaggcatgtgctggcctccaacaagtgtccactggcacagaaggctctctcttctaggtgtgcttaacaacttccatcttcggtatcaattggtaatcactttccaagacctatgtttcttgtttgctaataccagcacttttccttaaccgttttctatttgcttttagcaaatcatgctgtaaaggcaaaatccaataattaaaacaaaaacacattagatcccaattagaaaaacaaaaacgatgccaacaaagcagtctctgccatacaggttgtgtgcaagatccagacaaatgcaaagcacaggcgccgaggccctcctgtgcctgtcactggcaataatccatgccacagaagactatttgctttccctgggcctaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgagcaagaatcccctccccacctctcacccctgggacccccagccctatcaggtgaatggcctttaagtaatcacctaaattgacattcagccagagtgacaccactatacagataacacgctcatttccttgtgaggtgttacccatggctgcctagtctccttatgcaccttcatctgaatctacaggtgcacctgctgcttcttttactctgaaaataagaactagaggagtcatcacgttgctatttggtgttgtgtgtctttgaattccaagctcattccattcctctgctatagccattcctcctctccaggtcactggtaacatttatttttcagcgacatcgttccagcctttatccagggtctattaagggtatagttttgtaagcacattgcaaattacctttgcaagcagagtaggtctctgggcttgagaagcctgtgggtaagtcagtccaagtatgcttatctgagataaggatgtccccattcgttcagtatgcaacctgaggtcacctctcctctgctccccatgagcattttatgcatatataaataataccgctgcagccataaaaaggaatgagatcatgtcctttgcaggaacatggatggagctggaagcctttatccttaaactaacgcaggagcagaaaaccaaacaccacatgttcttacttataagtaggagctgaacgatgagaacacatggacaaaatggggggaaacaacacacccttgggcctggtcggagagggagagcatcaggaagattagctaatggatgctgggcttgataccaaggtgatgggttgatctctgcagcaaaccaccatggcacccgtttacctagttaacaaatctgcacatcctgtacttgcaccctggaacttaaaatcaaagttgaaggggatggaaatggcagatcacgcctataatctcagcactttgggaggctgaggagggcggatcgcttcaggtcaggagtccaagaccagcctggccaacatggtgaaaccccatctctactaaaaatacaaaaattagctgggtatggtggtgggctcctgtaatcccagctactcgggaggctgaggcacgagaatcacttgacccactgcactccagcctgggcaacagactgacattccatctcaaaaaacaaaaaaaaacagttgaaggaaaaataaataattaataaatgaaaccccaggtgagctaagactagaaagacaaacctactgcaggaaacaaccagaagaacgaaaagtccaactggagcctggtagagactcgggttgatgcactttgggtcacacacacgttcctgtaactggccccacactgaagaccagactcaggtcttcattttctagaaagagggtccaggagctcaggggtggtccccatcccagcctgggatgcctcccccagaacatgtgctctcctctggcaggtgatggtgaacgggatcctcttcgtgcagtacttccaccgcgtgcccttccaccgtgtggacaccatctccgtcaatggctctgtgcagctgtcctacatcagcttccaggtcagactgtccacctggcaccggtcccaggggctgggatgcagggcccagcgtagctgtgtctaagccctgctgggtgggcccaagccaatctcctacccaggtcactctggggacaacctctgcttccctgtcccagtacctgcccgccccttctcctctgtcactctgcccctccttctgtgttactgtctctgtccggaacacctgccttggtctcccagactcctcagctgcccctttctcttcatccctcagtttccatcctggtaaggagggcatattgttctagaaagagcccaggctcaagaaccaaactgaatccagttcaaattcccagctctgccattcatcatctgtgggatcttagacaagcaacttcacctctctcagccttggtttcttcatctgtagaatggtcattgcctgccccccatgggtggttgtgtggttcagtgaggagacagatatcagaggtcacacagtggcccccctgggcccacaccagggtctgtttgacctctgtgttttaacaactttgaatgtgttgccaacatctaaaaggtcaggagagtcaggtatggtggtggaggtctgcagtcctggctactcaagaggctgaggtgggagaattgcttgagcccaggaattagagttctgtctgggcaaaacagcaagaccctgtctccaaaaaactttgtttaaataataaaataaaataaataaaactaaataaggtcaggagataccaataccatgtgaaaaatgggaagattagggtatgctgggcccacattcccacagggcaccagcagctgggtgggagctgctgttacccttttggcattcgaggctgctccctgagatcagcgaagcacacagtaggccctcagcaaatctgggcttctcgccctttggtcctcatctctcattccctccttccctgactctctcccctgcgggtggtaggggagggaagagctggagggagaccgcacccctgcactgctcaccagagcctggctctttcccatcccatcttggcatggccctaacccccttgcctcatcgccctgcctgcctggtctctccctcttgcccctgcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggggcgcagacaaaaagtgagttcaacacagaggccctgggtggccgagcagacagtaggaaggaccgagggtctgagaggctggccccagccagcaggccactcagggcctacaggccgcatcttgcccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttcacagcccccagcccttcaaataaagcccaaattccccagcagggtatatgaattcctccccagtctgccccaatccacgtccctgcctcacccccaacccacgaagctcacgcagcctctgcagctcactcaaggccctcttgggccaccatgcttttgcatatgctgtccctggtcccggaagcaccctctgccagcctgccccgagcacatgcctaattgcccttccatgctctgcctaagtgccgctcctctgggagtcctccccgcctggaatattgttggacgctcccctggtgtccccacagagtctgtatgtatctgtgccatgccagttcacagcaccccattgtaactgtatttgcgtgtctgtccccgttactccacccccatgtccctatgcccatgaggccccagagggccaggactgtggcttgttcatttgcactgtgcctggcactcagtagggactcagtgaatgaatgtggaatgtggttcacacagccagggagaatgggataccagccagggcaagaacagtctactgggtggggcaggatccaggacaaggaggtgagcagcccttcctccggccactcaagtagtggggactgggaggaggggcgctttgtctacgcagtcttcttatggctcatcaccgtacagacagggcacctgcctcctgccacgctgacttcaggactggtcgagccccagggaacatttgcagggcagcccaactttggccctggccctggcgctggccctggctctggggaggatagaaagtgtgctggatacagtcagacagaactggctgccactttggatttgatcccttccaccttggcaagcttgggcaagttgcttaatctttctgagcctcgttgcctcactagggacacaggagctgaggctgcttcccttgttggaaagcactgaagcccaggaatcgacccacaataggccttcaacaaataccacttctcaccttatgggtgaaatatggcactggaagtaatgctcttcgctgtgggagctacagaaagcaatgaggtctctatcaaacccagtctcctctctctcgagaggaaccagtggggataccctaccccccaaccccaaagccctgtacacctgggggtaaaaatctgggtgccacgggctcaggaaggcttgcttgggagcaagagggaggtgggtgtgtccggggaggcatttctgagcacaagagcctccctggagttttgccaccatctcctcccattctgtggtgcccgcgataaccaccatttctgactctcctcacccctccagcctcccggcgtgtggcctgccaacccggctcccattgtaagtctcttgctttctttttggatcgtcctcattttggcttttctgggctcatggaggaggcagggccaggcattgggcctctcccattgggagtggggagggcacagaccagacccttgaccatctgcccggcctggtgaggttgggggttggatgtgggggttggatgaaacaacctgagttgccaccccgtgggcagccacggaagaccatgccccacattcacttctgtcacctgcaaagggaggctaggctgagagacgtttccccgagaggaaagatgggccagagccaccagcgtccccatctgtcttctccagggttctaacctttgcccctcgctcatccccttgagagaagagacacctgggcccaccctctgtggggtctgtggggccattgggcttgttacgccccctggagggtgcctgccgtgtggcgccctctggtgggagctggtggttttcacacgtgagagcctgggtgagacctggtttctttcttccagacccagacagtcatccacacagtgcagagcgcccctggacagatgttctctgtaagtctacaagttctggtcagttcacagctgcacagtgtcctccttcaccaaaaactaaactccctagagccctagagtcgggaagaaagcggtttagcaaggaggatggggacactaggggctgagtgcttggctcaggtgacatgtggctaaagctgtccttgggacagcagagattctggaagaagcagggtttatccagtggtggaagagacaagtcccctagagaccgggagggaaactggtccatctgtcaccaagtggggagtacagtggccccagcacccggatgtgaggttcctggccctgcatcctgggtccccaggatgtcactattgatcacaggcttaagctcttctcctgatggtgcaaatgaggcaggggggcttagaattagtggggctgcctgcggaggggttgaggggcaggtgaccgtggtgtggtctgggaacacggcaggaagttccaggaaggctaacatgaaaagggaggtagacgggcgagtccaagggccaaaggctcacgaggtcagcctcacagtggagtcctctctagaacgcgtgggtgcgcctgggtgagtgctcgcgcacccatgtgctctcccattgaatttcctggtttcttttcaacagactcccgccatcccacctatgatgtacccccaccccgcctatgtaagtggtttctcagggagggcagaggttctgtttgtggtgggcaggctgggggtgaagggccgctgtggggggatccactggccttgaaaaattaaaagcagtcatttgttaagctgaagggcttcaaagcatcccagcgaattagaaggctgtggagaggagctttcaaccttaaaactgtcgtgtcaatatgagcacattgcatgtccctcccttttcaccccacgaaacgagtctttttgtgtttggccaaagttcctttcatgacactaatctaagcccattaatttgaggagcactggaaagttttcctttggcttttatggaaccaagtaaagatatcatgggcttcttctcagctgacagcccaaattcatgggaactggtacaatcttccccttccgcgtggtggctgacctgtcccccttcttccgacagccgatgcctttcatcaccaccattctgggagggctgtacccatccaagtccatcctcctgtcaggcactgtcctgcccagtgctcagaggtaagccaagggctccagtgacctctgggaagagagagcccttcaaggtcagtccagccattcccctggcttcaggaaggctactgatgatggggaggaaatgggactcagaactcggtggataaaggttcaggtgggctgcccaccccaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtaaggcaccgcagtctggagcttggagaggctcccatgggtgcacagggggagggggtaaaggaggtttgaggtaccttgaacaggatgggggctgattcctctgggatgaaggcccaaaagaagagaaggtggccaacaaattattattattattattattactgtcccgcatgaaggaagtgctgggatctgctttttcagatgaggaaacaaactcacaagtgcaggttacttgcttgtggtcacacagtcagtaagtgtcaaatcagacccaagaaggaggtgttattcatttcttcatttactcaacaaccattttcttgtcgcctgctttgcgcaggaagcaccccacatgctgggggcacagtcatgaagcacacagacagggtcctgcctccagggagtttataatttaggtggggaaagaacaaggaaagtaaagcatggacagattgtcacagataacgacagtgccacgcacaaagcaaaacagagcgatgagatagagcgagcctgggaggggcagctagggccaacgtgcagaggcacgggtgtggcctgtccaggaacagcaggcaggcgtgctccaccctgactacatattcaaatcacccagagagcttacaaaggaaatatcagtgctgggaccccagcccaggccaatgaggcagtcagctgggcattcgtattttaaaaatatgccttaagtgattatactctgcagtcagagttgaaaatgactgatgtagggctttgcagccatggaaaggagcttggattttaacacagtgaaaagcctcaggagtgtttcaagccagggagcaacatactttgatttgtagacagctgtgtgacctcggacaagtgacttaattattctgtgcttcagtttcctcatctacaaaatggagctaataatcatgaatttcctagagttgtaagaatggaatgagacagtatctgtagtatgcttaggacagtgcctggcaggtggcatgtgtgataggagtgttagctattgcaaagggaaggaggttttaacatttgtaccctgactgcttcgtggagaaggcattggggtggaaaagacaagttaggagactgatgctgcaggagcccaggcccagagcactcctgtgtgctgggcctgagggatacagacggcacaggccagtgctcctgtccctgatggggtgggaacagtattctagaccagggaacagtacaggggaaagagcacgcacagcctgtttagtgaagagccgtcgttcagtggggatagagtgcaggtgaggggcttattaacaactgaggagggagggagggtgggagggagggagagaggaggctgcagtgagggtggaggacttcccaagtgtagtgcaaacggcatgatctctgcacaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtgacgtcctcagtccctcccctctgacctttaacctcactctcaccttgcaccgtgcaccaacccttcaccccctcctggaaagccaggcctgatggcatcccactggcctccaccaactgaccagagtgttctcttcaggggactggctcctttcccagtgtccttaaaataaagaaatgaaaatgcttgttggcacattcatgtgggttgaccgtggcttctttaattcatttggagacattttggagtctgtggaatcgggcggaggtgctgctgagaggagtgggatgggaaagcatggactccctttgggcagggggtcctgacctcacacctcctcccagagggtctcttgcaaatcccacgagggtgttggagaaagcaggctggggctctagccttttgggcaggagtctcggacacaggaagggtggtaatgggggacaccaggaaacagccccatgcctccgagatgggagaggggctggggcagagcctgtgagggccacagcagggtcagagctgcctcctcagacctggcgtcccagtgggaggaggtggcttggggaggggggtcaggagaagctgatccgaagcaccgtctgggtgtgtgttccattgtgggtctccccggcattaggggttagggcttgcgtgggaaaagtggctcagtgttcatgtgtggggttctgccagccactgggccactgcccaacagcccagctccgcgtccacgtgatgccaacacatcctgcttggctcagcaagaatccagttcctcaggccccagtgtagtcctcggagctggcagcaccagcagcaactgggagcttgttggaaacgcggcatcccgcgcaccgcccccctgccccgcgacacacacacatacctacctgagagatcagagccttcgttttcacaacaccccaggtgagacacacacattaaagctgagaagccggctgggcatggtggctcacgcctgtaatcccagcactttgggaggccgagacaggcagatcatctgaggtctggagtttgtgaccagcctggctaacatgacaaaaccccgtctctactaaaaataataataatttaaaaaaaagtagccgggtgtggtggcgggcacctgtaatcccagctactcgggaggctgaggggggagaatcgcttgaacccaggaggcagatgttgcattgagccaataatgcgccattgcactccagcctgggtgacaagagtgaaattccgtctcaaaattaaaaacaaaacaaaacaacaacaacaacaaaaacacaaacctgagaagccccggtccgggagcggactcctggctgtgttgctgagatgcacggctgtcgcgcagggcacagagcttttctggagcctgaggttgacactacaccttctcctgccacctgagactctgctgctagaagagggaggggagagagaggggcgaagtcggccagggcggccaggaggcagacaccaaacccgagctgggagccgtgtgttgctaggaccccagcgtcccctgctgagctccttccttggttctgaccaggagaaggaaatggggctcagtctcttaagaagccttccttggccagctccaaacccgggagggtccccaatccctcagacgaggatgctgtggcccacacttgcctcgacatgttgccttcccagggaccacatccgtatgagacaaactcacatgggacaggtggccccagagcaaaacgctaagacagtgtctaagaagaagctcaaggccttcccagaagcgctggcctcatgtgagaatcccacccacgccagaccccgtttcagatcctttgtgagggaggcaggcctgtgccccctgccctaccacaggtctttggacaagcaacgaagctccatcttctgctgtcacacctggcagccatttcagaggagccatggcctgcctgggttgtccctctgtgggggatctgtccaggctgcgacacccaccagctccccactctgtataactgagggccacattccctacaaaacagcccccaacccccctcccccgccacacacacatacagtgtgattaaagtaaaatgcaattcatgtaaatatctccatcaaggaatcatacagggaagacccaagtggccgttgggaacagactgggtgttagttttttaaatacagag

SEQ ID NO: 682 - DNA, 10885 bp, Human
gtgccttctctccctttagggaaaagtcttctggaatcaacaaagggcttgtggctacttttgctcccatccctccataccagatggagggtggcgtgagttctgacaggtagccacgtggcccgccaagagtccctgtctggaggattgtctatagggtaaggtaccacactggtaagtgcacaagactattgagcctacatgggagggggtgcatcaaaaaatgtgccagaggcatctgctttgcttgctgttgaattactttgtatgtagattgttgacacacatatgagctggtcagttggttgactgagtcaaggaacaaaggcaataatcagatttaaaagggagggaagagaagacagagagagggaagctcctagcagtggctgctgctggcatattcttttggatgagctgatttgctggtaacagaggtcagcctgggcattctgtccttagacagccatctaacaggcatcaaagctgtgggaacaaggttctcggtggagccccagtggctgaccttctctgtgtcgtggccatgtgtgtcctcccgtcagctcctccacccaagttgggccggcttcaccccatttgcctcattaggattctcacatgtaaactagggcagaccttctgtagggtaagttgtcaacacatatcaattgcctgccttcaaattgtgtgtgtgctttgattcagcaagtctacattaggagtagatcctatggaagcaattctggacatgaactgactgaaatttggccttctttcactctacagtctagattagtaaaaaaatatcagaagccacccatatatccatcaatggggcttcattagataaatggtatagcagtataataatatatataatagtataatgaaataggaacctgcctttttctttttgagacggagtcttgctctgtcgcccaggctgcagtgcagtggcacaatctcagctcactgcaacctctgcctcctgagttcaagcaagtctctgcctcagcctcccgagtagctgggattagaggtgcctgccaccaggccggctaatttttgtagttttagtagagatggggtttcaccatcttggccaggctggtcttaaactcctgacttcgtgatccacccgcctcgggctcccaaagtgctaggattaccatcacgagccaccgtgcccagccaggaacctgcctttcacaatgttactagagaggaatatttagtgacatagaaatatgtgcaagttatatcagcaaatgaaaaaataggctacgaagctctgcatatataacattttcctaatttggttggggaaaagtatggagagagagagagacagaaagagagacaggcagcaacgggaccacagagggacgtacaccaaaatgtcaatggtgcttaataggtttgcaggtgattttaagtttattgtttaggttttccaaatcttctacactgagtgtatgtttcttttatcaaaaagggcatggtggggaagctaaggcatggtgctcacacctgcaaccccagcactttgggaggttgaggcgagatgattgtttgaggccaggagttcgagagcagcctgggcaacatagtcttgtcttaaaaaaaaattgccaggcatagtggctcatgcctgtggtctcagcttcttggaaagctgaggcaggaggattgcctgagcccaggaggtcgaggttacagtgagctatgatcattctactgcactccagcctgagtgacagagtaagaccctatctcaaaatatatatatatatatgaatataaataaataaatacattaaataaatagaaaaaaaatgtgtttaaaacaaaacaaaacaaaacaaaactccccagtgccagaaaagtggaagtgaaagaagcatgtgttgcctccatgagagtgggggctgggagggagggctgggcaaggctgggtggggtgcatctgatataagggggcagcctgcatggaaagggactgccagcatctgcctccactgctctgtgctgggatcatggaacttgcactgctgtgtgggctggtggtgatggctggtgagtcggggacgggacccaggctgggaagggaaggagggaggccagtgtacccctgtgctctctttcccagattagggggctgctgctctgatccccaggagcctggcccccactccccaatccttctgcccctctgcaaagagccttcagtggccgtcagtctcctagcatggtagcttcagccagagagctctggctggccaagctgtgctgcacatctctggactgctgtgaaagttcaaactagaagtccagcaccagggtctgctgggcccatgatgatgacgctttggacacaggtcacttcacccctacctctcccactgaataggagcaacccgtacgaatgcatagcactccatatttttagagccgtttcatgttcatgatctgccttgaacctgggaagagggttcccttgactttcggtgaagagggggcaatttccatttgatcttaagcagaccaaatataaagtgcagttgctagcaaattggcctttttgtcctcaatccatctcaaaattgtgattttggaaaagacttgcattttaaaatgtagttttatgttatcttgggactctgaaattctctagaggaacatgtctccaggattacagcaaaaaccattaggaaatttgcaattgagctgcaaaaattcatctctcagatgtaaagagggaagacactgtagagatcaaatacacagatgaacctgcagtcaaatgcaggccccgccatctcttagcagtatgactttagccaaatcaccaaacctttcaatatcctcatctgtaaaatgggtacaacccccttcacagggctgttagagggactctaatgggaaaacagacactaagtgttgagtaaacttaaataatagcttcacacatggcacatgcatgaaagatggcagtggcacctcctcccacccactgtgtccatcccttgggagaaggagcttcacccctgtcagtggcagccaagggtaggaaaagttacccaggcaagaacggctgacaagctaagccagttcatcaacacctccccagccacagctccagctccgtttctcaggctgggtcctcctcaccttaaaattatggcaagtaagaccacccgaaagcattctgaatcaaagctgaatgtatttttcacatggcaagaaagagctgcatcattcaggtgtgagttcagtttatgtatttctgagcccagattgaaagggctatatttagggcaaaaaaaagaggaccggggtaccctaagaaaggcaagattctgaacgcggggctctggttgatctgcaaggtggactctccgtttgcagttgggttccttatcatggaatctaggaatctctgatggattgtgtatgattccagagggcccgggatccttcaccagtgcagccaaagcttagcaagtcttctcttgtacatgtcttaacagctagaggcaccatgtcaaacaggcgtggcaacatggactcccacacattgaggggacgtactggggacatgatggcccagtcactttgagttgcaacccaaggccacctgtgtgtggtctcactctttgtccactgcatgagtttctcccaaccacccttcccagcccaacggtccccaatgtgtggctcacccactgtgtactattgacttcatttgcctgaggttgggtgcgggttccataagtaaactcactcgaagaggggctgcccagcccagtctccctgagactctgggctccatcgggacgtgtgctccctgcattctctaatcatctctaggagttgcacacaggcacagctccattcccttctgccatctgtttctcccaacctcccacttgaattcatggacttaatatattttatttctcctaactcaacataatgcattcctctcttccagtaaaataaattccccttactatcaattctaatcagcagttattatgagtgaaataaaattatccatgaaaagcactgatttctaaatcatgctgcctcccagaagacccacacactctctttattacagactcagatttttctaggggctggaggtaagaagggtgacttgggaccattcttcctattatggagtgggaaatcaacacccagagacagagaatgaaaccagactgttgtaaatgatgaattctggctccatttaccagccactaagactctgagcaagttactgagcctcaaactgctcatctgtaaaatagggtttaaaaataatattcattgtaccagtgttggttttaacaaatgaatcacaagtaagatgataacatttgaggaaattggctgaggggtatacaggagctttctatctttgcaacttttttgtacatctggaattattccaaaataaaaagtttatttatttaatatgacagtaattatccagccagatggagtcgagaaatcaatacaaaagaagacctatagtaagcactcagtaattgtcactttttttccttgagacaaagtctcactctgttgcccaggctggagtgcagtggcaagatctcggctcactgcagcctccacctcccacctcagcctcccaagtagctgggacgacaggtgtccaccaccacgcccagttaatttttgatgttttgtaaatacagggtgttaccatgtttcccaagctagtctcaaactcctgtgttcaagcaatctgcccaccttggcctctcaaacccgagatcatgccactgcattccagcctgggcaatagagcaagactttgtctcccaaagtgctgggattacagacgtgagccactgtgcctggcctgtcgctatatttttaatagcagtagtagatgtcgttttattattatcatcatctgaggtcactcatttggtctgggcagagcagaggtgccgtcctgtgcccattggcgctgccctgaaattcatctcctcttctctcctggttgctgggctgcttggcaggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtaactcctttctcagggctggcaatcctatactgtccccgactacggtactcttcttttctctccacccacctgttcatttagttgagttgaatccattttgttgagcatctactatgtgctaaataccactgggtgccaatacggtcccagccctcctggagcttgccttccagaaggttccccagggtccctgaaggccagacgcccccttgcactcccatcccctactctagtgacaatgcccacattcactccccactgcaatggacgttggtttttaaagccccctcaccacctctttttttctgttatctcatttgatcttcataacaaccctgggagtcagctagaggagcggtgagagccagccaggcctggggacactgccacgatctgccacttacaggctgtgtgaccttgggcaagtgtcttgacctccccgagtctcagtttcttcatctctgaagagcggataatatgagtacctccatcccatggtggttttaaggagtaagagagaatgcatagataaagcaagtgtctagtgcataggaatcgctcaaaaaatgttagtcatcatgatcctgaggaagactgcagccctgcaggccttgactcttcccaggtggggacacgggttcttctccagtagggggagcagccagagaccccagtaggctggggacccatgcagctgtgcaccctgtctgctccaggtgctgccagacccatgactgctgctatgaccacctgaagacccaggggtgcagcatctacaaggactattacagatacaacttttcccaggggaacatccactgctgtgagtacgcagacctcagggcaggagctggagaccccaggaagggagatctggcccccactgccttcacagcacagctacttgacctctctgttttttttttgcatgggtccactggctgcagttgggctgtgaagaggcaagaatgggtatgggggtatggagaggacccatgggaggtttggcccctttagcacctggaattcaggcccacgactgaccagcttggtgaccacattgcttaacctctctgaacctcagtatcctcatctgtaatctaccccattaagttattgcaagagctaaaatgagacagacagaatgggcctcacaggatgcctgccataataaattacacagagctactgattggctgttactttcatcatcactgatgctcgtggcagcctgtcgaggatcggcaaaaccctgattatctccattgtacagaccaggaaaccaaaactagagtggggaagtgtctgcctccaactgacagagcctgggctggaacccagggcacctggcccctacatcctttccagcatcacaagcatagaaatgtagcaggtcctcagggctgggaatctaaagggctcatcacagcagctgctgttaattgagggcttcataataatagtaacaataatatccaacatttattgagcacttactataggctaagtgccttgtcttgttactttaactctcatgacagccccctaggcaactcttgccattatccccgcttcatggataatgaaactgtgatccctcctgcccgggagtctttgcatagactgttgccatcccccactcccaaaccccagcttcctccaggaagagcagacccttccgatctcagctcaaaaggctcttccaccctgttttctgatctcctagccctgcatggttcctcatgttaactttgcatagttgtttttttcctccctgtggtgctctaatacctgcccctctctcatgtccctatcgttcagtcctctcctgccgtgacacggtaggtgctcaacaattgtttaatgaatgggtgaataaataactgaaggtgcaatggcacacagggaggtcacggtacgtggccaagtcatgcagctagaatcgaggttgctgggaccggtacctctacgactgagtaggaactgcactgacttcagaggctgctagactcatacctgcctctgtctcggaaaaggacaaacacatagctcccccttctccgtccacagctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcttccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcagcattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaatccttgtctcaggctctgcttctaaggaaagagactgaagagggacaactttttcctatgaggactcccaatctgccatttgtgtgtggctagctgtttccagccagggggctgaggcacctgcagtcacccacactctgggcctgtggcaccatctgtgcctcagctgactgagcagttctgagatgtggtgactcatgtgaagtggtgtcataggaatgaaggactgtgggcgctgggttcaaattccagttctatgcaccactccaggtagggatacccatgggggcagctgtgcctgtgtgggggaacagggtagggaaatctccataccttctcaattttgctgtgaacctaaaactgccatataaagataaagtctaggccaggcatggtggctcatgcctgtaatcccaacacttagggtggctgaggcaggcagatcacctggggtcaggagttcaagaccagcctgcccaacatggcaaaacctcgtctctactaaaaatacaaaaattagccaggcatcgtggtgggtgcctgtaatcccagctattcaggaggctgaggcaggagaatcacttggacctgggaggcagaggtttcagtgagcccagatcgcgacactgcactccagcctgggcaacagagtgacactctgtctcaaaaaataaaataaaataaaataaaataaaataaaataaaataaaataaaataaaataaaataagtctagtttttttaaaaaaaattccacttatatcactgactaaccatgtaccttacaggaggaaacattctctgcatgtaaagtataaatgaaaataagaagagaccagcctgggcaacatagacctcatctctacaaaaaataagaatttttttttgttattgttgttgagacagggtcttgctgtgttgcccaggctggaatgcagcagcatgatcgtggctcacggcagcctcgacctccatggctcaagtgatcctcctgccccagcctcctgagtagccaggcacccgaacacctgggtaatttttgtattttttgtagagatggggcctcactatgctgtctaggctggcctcaaactcctgggctcaagtgatcctcctgccttggcctcccaacatgttgggattacagtcgtgagccactgcactggactgaaaattttttaaaaagaagagaataagaaggtgttcatgtttgtattaaataagattagcgtagattaaattcttagcacagcaggcacctggcacagggtattaactttaaatgttaacggcatggttaatgttgttgtttcgtagtgaccagatctaaagtcacccccaagagaaatcaggaggagaaagtgtcctcctcctttcccgccaagtcttctctcagtgacactggatgcatttactcaagagacaccatcgggagctgatgactcttatttgtctaccaaatttggcccaatagctccctatggctttgcagcaacatctctcttaatattcatgttggctgacttagccattacgatccccattttataattgaggaccctcctgaggtcccacaacccgagaaaggcagagccacagcttcgccccagcctcttcttgctccgctccctcgccgcatcacgtttgtattggttaagaagcttccagctaaaaactgtgactcattgggctgaaacaatgcaggcgtttatgatctcacatgatgagacgttcggagaggaggtggttccaagtctggctcttcggagcttgatatcatcagggcctggtttccttcctgctcctggcaagccacctctgtgtgttggctttgccctctaggtgactcccctcacagctccaagctggcaaccatgatgccagcccgcaggccaggacgtgacagcatccagccaaggagacgctgtgtcttcctctcttcctgtgtctttttgtttgtttgtttgtttgcttttttgtttgtttttgagacggagtctc

SEQ ID NO: 683 - DNA, 9880 bp, Human
ctggagccgatatgggaatccagcttccactaagccggacaatacaaagattcgcaccaacgtagaaccacgccacttttctcaggcgggtttttcatttttaaaagtatgattgcttttcataaaacattatgctatttatgttaatgtgtaatagcaatattttcttatttttaagtgaattggcaagtattctgaacatttctgttatgatttagaaaatgataagtatccataggtataacccatacaaacaaaaaagttcttcagtgtcctcaattagttttttttgtttttgttttttgtttttttgtttttttttttttttgagatggagtctcgctctgttgcccaggctggactgcagtggcgcgatcttggctcactacaacccctgccccctgggttcaagaaattctcctgcctcagccttctgagtggctgggattactggcgtgcaccaccacatccagctagtttttgtatttttagtacagatggggcttcaccatgttggccaggctggtctcgagttcctgacctcaagtgatccgcccgccctggcctcccaaagtgctgggattacaggcatgagtctcactctgtcgcccaggctggagggcagtggcacacacagttcactgcaggcttgacctcccctggctcaggtgatcctcccacctcagtctcctgagtagccgggaccacagacacagtctcctgactagttgagaccacaggcgcactccaccacacccagctaatttttgtatgttttgtagagatgaggtctccctgtgttgccaaggctggtatcaaactctgggctcaagtgatcctcccgcctcggcctcccaaagtgctgggattacaggcatgagccactgcgcctggccctcagtgacctttaagagtatgaaggagtcctcagataaaaacatttgagaagcacggaggtggaaatttgtctttggcctgggggcctggagtctaaatactgcattgagtggctgatctgtggttttcgcttaaaatacaggttagatcatttgtttctgtttgcattctgtcctagttgcttctatttattttttctctctttttgaatctgtgaaacattaacagggttccaaacatcagagtgttttgtctaagcttaaaagccctctgggtgattccgatgagcagaggccgggaaggattgagcaagaccatccccgagctccttcctccgctctgtttccagatcccatgactggggacctataaatattttcctgacatggagcaggatcaacttcagcatctgttagcttcatcccaaaggcagggaagcctagagcccctgggagggctctgcaccgcacacaccgccggcctgcagccccagccctgtgcggggtcctggggaggggggccccctttctgtggctcttcctgactccctgcgcgttccaccccagaccctcagcccactctgacctccctccaggagggatggcttgcaaatgccctctggccacagtgcagaccgctaggctgttctgtgcagctttaggccatgccaggaaagagacttaaagccagggccccaaaggccagggatgcctgcgccgggagccaggagcttccccagccacttccagcatgtagactgaagtcaggccacgcacagggctctccaggtcacaccctgcgcaagaaggtgtagcacgctggctctaatttcgagaaggtgaaaacaagagcccctctgcccccacgccctgagctttcccgaaaggcttggggcaaagaactcccctcagtggcacctagggaggcaccaggaaggcgcttgttggaacgggagagaaacggggagagggaggaggacaggggggaggggaggaggggaggggaggaggggaggggaggaggggaggggaggggaagggaggggacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgagtactgcgtgcccccgggacacccagagagggcccgggcctcctgcactttccccgcggcccagaaccttgtggcacctccagagggacccccaggactggctgcgaccgagctttaagggtctagtcccgggggcagccagtcggccaaggccccgggtccctgcgacggcgaaggcatcccggaggccgcacccagaccggcccggcaagctgcagggactcggactgaaaacctgcccgttacccctggtcgctcgcaggcgcacgggcgatctaaccccgcgccgtccattccgctgatgggggtctcggaagcgccgcaggagagctttgcggagcagggagggggtcgcgggtgctcggggccgtcctcagagcccaaagtgccgcagccctctcggctttccaccccgaggctgccacgacggtgccagcgcgcggctgctcccctctgtgctcccaggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtgagcgcggggccggccgggggcggggtccggggggccggggccaggcgcgctgagccgctgtcgccgcaggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggccgccccttcctggcctcggtttccagcccgtgttccgtgggatggctgagaggagtacatgggaccctgtccccaacagtggtgcagagggcacgctggacgctgggcagtggccccagtgaggccatacgcataccagaaggtgggcttctcggaccccaggccaacctcctcttcttcctccccagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcctagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgatgagcattctcctagctcttccaggcacctgctggacagggcaggctgggaacgctggggccgagtggcagttccctccctactcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgttcgtggtgtgcaactggtctggcgggaagagcccctcgtgggcagagggtccagagaggtgcggtttgccccacatttgggggcactgggccacagtgggcaggggagcacgtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggatgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtccctggctgtccccacacttgttctgggccccgtgcagtgcagggacccgtggtgtgcgctaattggggacacacattcagaaggcgcctggtgctgccgtcagggccatgaggcacgtgctctgtgtgtgtgtgggaggcaggcctgagacctacagatctccccacaacagacgccacccctggcccatacaggatttcagaagacacagcaaatggcatgtcagatgcatccacaaacccggcaggcacgcgcctgcccacaggacgatcagaagctcagacaaggggcaccttgagatccggacgaggccccagaagccctcactctgccccctcctctgtgggagcagcttgcattgctgctgttcatgggggggccactgaccaccaagaccctcgcagcccatcaggccaccagcagacacctcctgagacctgagctcagaggccccaacctcaaagatgtcctcaggggctcactgtaatctgtcgtggccctttctgcagcaggggtccccaggcctccccaccagtgccactcacctggtggaaccccagggccctctcagtgcctgggcgggagctctgtgtggtttgaggatggagatgcttgggggatggctgcttcttcagtcctctcccagtgactggaaggtgggggctcacttctctcaccgaggcctggtagacgacccttcctcgtaactgtctaaggccctccagccctgatgcttctagaaccagaccccaggcccagctcccaccaccctgcacgccatccccgcccaccatccttgaaaacaatgaactaagcccaagctcacgggcgcatgagctctgaggtgacgtggagatctgaaaaacccctggcttaaagttttcttaaggttcctgggactgacaatgccaggaggcccctgaaagaatggccgtaaatcctgtgtagagatcacactgtgtacttggaactcaagaggatccccaggaacatgaacccacaatcagaacccataaaacgcacagaacaccagccttgatgctcctgagtcagagcacatggcaaactccacggtcagagccaccgggccgctggggctggcatgaccaggagaagatgctgaccgagttaacctcgccaggagctctaaactcaaagacaccagagcagcacaatggggtggtgcattgaagcctcgacagacggacacaacactccagtcaaagggcagagactgcaagagcagactcacagaaccatgcgctactgtggagcctgtgaagtcctgtaggatcactgaaaggctggggaaggggttgtggtgcagactcctgcagacacctggatccacctgccctccctcctggagcatggagctgggggtccctggggtaggacaggcgtcactttggggccagaacatttactgcccaggtgagaggctattgtgctttcctggcctcagggaccccagggcatgtgttgacgtgggtgccatcactgaagtctctggggccccagggcatgtgttgatgtgggtgccatcacagaagtctccagggccccagggcatgtgttgacgtgggtgccatcacagaagtctctggggccccacgccactaggacggccactgttgtgctgaggcattgagatttgaaggagaccaatggggaacgccatccggtaatggaatgctgtgtgaggaatcccacaggggccgcctggccggagggtggatcagacaggacctatgtggctgccctctcctgaatgaggtggggagcacgggaaggcgcagagtgcagaaacagcactgcatcagtggccgccatcttgacagcagtgagtagtgggtatagacaggaaaatggagaggagaagcccctgcaatagtcccaaaagagagaggtttgggcctcagagacacccgtggacatgggaagaaatggatgagtctgggtttgttttgatgaaaacgcaacgtgaatactt

SEQ ID NO: 684 - DNA, 72048 bp, Human; identical to SEQ ID NO: 600
  misc_feature (1)...(72048): n = A,T,C or G

SEQ ID NO: 685 - DNA, 12626 bp, Human
cttttccagtgtctatagacctaatgcatttcatccagactctgcaatagggccacatattgctcaactccatggaacctcattcccatagaaggcaataggcatggtaacctttctgagcaaggcagagagggtacctgcctggccataccctcgtcttatttccttaattgttttctttcttctttaagatatagctgattaatcattattatgaaatgcctctttcttctgggtcttgacatgcagcttctaggaaaaatgataaactccccatctccatgcaaatgagattttttttgcaattctatgttcatacagaaaaatccaagttaggtcactttcctgagagctgtggcatgctaccaagaagagaagggagataaggaagaagagaagagagtgaaccagggtttaaatccagaactacgttgtgaaccactatagtctaccacttccctcaacacttaccattttattatgtccaagatgctggaccacaagacatcaagtccctggggtttctttcccttgcacctgtcccgtaaaaggccctgatctttcctgtcccttttccttctctgccggtgccctgtggccctctctgtctcccaaatctggctgcaggaacagggtttgtaccagcccagtggggtctcataattgcacctcatcccaaggtcacttcatttggttaaaaataagctccatttattctgggagtctgtgtttggggatgtcaaaagacaaaattacaacacatttagtttaaagatcttaattggcttttatttgcaattctagaatcaggcaacatcctattttataaaaatagaatgagtggtcccatgagctgacagaggagagtggttttgtgggcagacaactgctagaggaagcagaaacagagaacaaaaagcaaactggtcatttaaaagttactttccttgtaaaggttagagcagaggagacttccttatacgctggctaaaactggcttgtttcaggatttggctattatctttctctctcctgatttctcagaaggttagataaacagtttagtttcagcttggtggtgtggaacttcattcagcatgagcgactccatttaggtttggcctattggcctagtgcagtaactcagtccaaaccaattaccccctggaaattttatttaatgggaagaaactgtttataccctatcttttcattgccccaaacctgatccctagagaacttcttggtaaagagtttatgtaaaaaggtaatttagttagagagtcttctagcccaagaataaggatttcaggtcctggctctgccactggctgatcttaaacctctcttctttccagtctcattttctctctctctgcattaatcaagaatgagagaaccctccaggggacaagatgaaggggaaatagatgatgtgcaaagaaatccttgctttatgaggggaaaaagtgttcctcatgaagttcaacaaaatgatgcaggtaaagcagttagctagcacctggcacatggcagacactcatagctgcctaaggcattggagaactggatcgtgctgcagccagaggcacctgcagagcctcatgggctggctgctgcagggtgtggctgattgagagtgcttttgtgagttggcctgcagggtacacttggtaacgtgccacagctctcaggaaagtgacctaagttggatttttctgcatggacatagaattgcaaaaaattctcatttgcatggagatggggagtttatttttcctagaagctgcatgtcaagacccagaagaaagaggcatttcataataatgattaatcagctatatcttaaagaagaaagaaaacaattaaggaaatacaatactaagaaaacaaggggaaaaaacaatctccccaaggtggatccacccagcaaaccttgagagcatttcctcttatccacctgaataaaaatgaccagccctttccaaatggcagagagcactgagaggagacacaaggagcagcccgcaagcaccaagtgagaggtgaggctcacgctgtccgtcatcaggggctcctatgcaccgccatcctagccctcctccttcactgccgcagggaggtgacctgttaccattgtgtatggctatgatgttccagatgctgggcatttggtagaatgggaaggggtactctatagaaaaggtgaattttctagtatcttattttcaacgagaagagatagagagtgggaaagaaggagtgaaggaaggaaaggtcaaggatttaatgtctttactattgcttttttgttccaagaactgtgttgggcactttataatgtgttatcattgtttaatcctttgcaatgtgaaatatctttttaaatgtaaggagcatcactggttcagaaatgggttcctgtctgtctggtgtcaggggagctactgggatcccaggctatgatgtcagagggaaacaatgttgtaagtggggtggagtagcagtaaagacagccagctcagggactggcccgccttctctcaaaccctggcttgggcaggttacttcatttttttggtaaaatgggaacagaaacagagcctacttcatagggtggttgtgagcattaaatgagaaaattacgtaaaattcttgggacagtgcccaatgcacatggcacgcaggataaatgttacttactactaatatctgaattagccaagatgtctggaattgcctcaccaagctaagggagacatctttctcctccacaaaatgcgcaagtctcctggcatgggatgagcaggcaatatctgcctgcttctgagagttaccttgtcagaagaaaaactgcactctctttcttggctttctagaagcaccccagtagcgttctgaggagacagagctctgggggactctctacaaacttccctggcaatggggcccatccttgtttagccagaaagagaggttgataaaagaggaaaggagctctttggcttaatgcctgccacgtggtaaggtcttgacatacacctgtctattccctgggaatgatgcccagttaaggagagacaggcaaaaatggtttctaaacaggatttgctgtttctggctttccagaggagctgggaatcctgaggaaggcatggggagtgggggcagctggggttcacactcacacgtgtgagttacagcagctttaactatagctctacagtcctcgcagctggctccctgtgtcttatgccctcctctcctccacggccacacacgatacacttaccttggcacacacagctgtaaatgggagatctcagtgggcaccatgcaaagtgcatagcagagggctgctctcgtcacatgtgttgtcataagacatgcgttaaggctaagctctatttataagcttgtgaaatgtgggtgaaaacagagataaccccataagctgtaccattatattttacgcacttttctctgtgcgcattatgtggcacaatacaaagtggttaaatgaagaggcagcaagaaagacagaggcaagaagggtaagagaatgagaagcggtggcaaacctctcagggtctggccctggctatgaagcagctagctgcaaacatgcccctcataccctttggctcagcaggtgaccgacgggaagttgccaagctgccctctaccattggcttcttcccctagctccttattgtggctaattagttcttgaagatgccttgtgcctccctttcccatctctccagaaggtgaaatctccacagctggcttcaaacaaatgattttaagcagatacactcttgaggtttataataaaagggtgttacttatttcaggggcaaacatcaaaaaccaagtgtgtttttatggtttttcacatctgttgccgaattcctagggcatcttaccaaccctgcttttcctatttaatttattaaaaacaatgcttttcacccctgttgacaaagtaggctgtgttgagtcataggagagtgatatgcatacaagtatgcttcctgggacttaagagagtggtgtatcgtgttttctggggtggaggtgggggcatggggtgagggtggggaagaactcatatccagttgactcaagaaaaccagaggagatacatacccctgtaactcctcaaggctgaagtgtttagtgttgttttcttgtattcctcccggcctgccttcgaggctggaaaggagcgtcaatcaggggtcttctttttcattgccctccactcttggctggacagctgacttcctctcctttctgcaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatcgtgagtatgggttggtgtaaaggtgtggatgacggagtatccctccccttacatcttagcttgaaaatgagttccttctcattgccttttgcatctcagaagaacataggataccgattgcttatgtctgttcttatgtttccctccacagcaagctaaggacaccttcccaaatgtcactatcctgtccacattggagactctgcagatcattaaggtattggcctgtgtctgctttttccagtatttttatcttcatgtctaaatggctctgggctgagaaagaaatccctaccttgtccccttctctttcctaatctccaatgtactctaaatgcaccaggcttctttgtcagatgatgtgttagggcacgctagtgtcccagggatatgtaacccctgggaggaattaaagaagtgctgcttcctagagagtgattgggggtgccaggtgctcagaggggacaggatttctgtggcttgggggtaattttggaaggtcccatggaggtagctaagaaaacaaacggtgacttaacccgaggaggttgtagatcagtgaataagagggaggaaggaatttgggcaggataagataatgggtgtaagatcagtgaaggtcggacatagaggtgaccaggtttgtgacccaaaggacatataagtgagtggtgggagatgaggtgaaaaaataccctggagtcattttataaaggtccctggagccaggctgagcctcaggcttataatacagacaataggctgggtgcagtggcttatgcctgtaatttcagcattttgggaggctgaggctggtaggattgcttgagatcaggggcttgagaccagccagagcaacatagcatgacctcgtctctacaaaacaaaacaaaacaattatcagggcatagtggcatgcaactctattcccagctacttgggcggctgagatgggaggattgcttgagcctgggaggtcaaagctgcagtgagccatgattgtgtcaatgcactccagcctgggtgccagattgagacacccaaaaagaataaaagaatgtgtgttagggcatgctagtgtcccaaggacttggaatccctgggaggaattaaagaagtgccgcttcctagagagtgattgggagctcccagtgctcagaggggattaggatttctgtggcttaggggtaattttggaaggccccatgggggtataaaagaataaaagaaaataatagcagcaatagagagtcaatgagatttttgagcccaaagttatatgatcataaattgttttagaaagacaatctggtgctgttcttacaatggacaacgtgaggcaggaaagccagtgacaagatctgcccaatcatctagacaggaggtgatgaaagtatgttacaaaatagctggcttaccaggtgatcattcattttacaaaaaggcccatgagagatgcctttaaaagagagctcctccagtcctgggaagtattctagacagatccagttttgggagggattttgtatgacagagtgtaaggtatatttgtattgagttacttttttctcaggtttctctgcatacgtgagagacacacacacacacctcttcataattcttctaagcagtgatttatttgtggtgaagagatgtagccacttactaaataatattctagccaactgtattatagacacagaagatatgacagctagaagggacccaaaagaccatctattccaaaaccatcattttcaaatgaggacagtgagaccttgggagggagcatgactagttagtggcagagttaggaacagacccccaaatatatgcccccatcttcagattctttctcctctcaaggttgggaagtagctcatgtggaataagaaaaggagtcaataaggattcaggttccttcccttcctttcccttcccttcccttcccttcccttcccttcccttcccttcccttcccttcccttcccttcctctctccttcccttcctttctcactcccaccttccttttttctgcagtgttcctttttctagtaccacagtctttgatagtgcagaggggtgtaacattttgcccttctggttaagagaatcagcaacagtgaaggaagagaagggtttttgtgttgccatctaggaaaagctgacactggggccaaggaggctttgcttcttgaatgaagatgggtgtgctgtcccaccgttaaccactccctgcttagactgaacagttaatcttctgcagagtaactggctctcagggcagatggcgggcaaacttctagaaggaaactgtctagccaacttcactgggctgtgcctgggaatttagagactatttctttgggacatctgcactctgcaggctgcagacctacccaaatatgcccatttctgcagctgtcggtctctcttgcaaatctcagcctcattccaatgacctttctggttttaaaaggacagactacaggagagctgagcagtgtggtccagagtaaggtggccagaatgaatgcaatgtgattacagttggaggaatgcatacctagcaggatgactggcatgcaacagcccttgcatgttggcagatgggagacataacagagaggcaacttcagcccctgtagtgtagggaagttcttttcaagaaagctgctcagccatcagtccttttaaaaaggaggcaactggttcctggaaagatttcagtggaagttagtgatgacacgctagggatactgcagagagaattagcctatgatggattctgggccccatccttagtaaatgtatttctcggccatacagaaaaaggggagaactggaatctcttctcactatttttgtcataagtagctttgatgggaataagagaggatgaacactctgagaccattacgaatttttccaaaatgacttttagttctctcatgtgtcgctgcccctactcaaatggactgccctggtctccaacataatgagagaagaggcctctagtgtttccctaatttgtgtttgtagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtgtgagtcactgggtcagaattccagcatctgctccctgtctgcccaaggagaggccaggaagtgctggcccccatcggcctcctgatatggtgcttggagtcaaaggaaattctctgcgcacgtccacagggagaactgtggagaacctctcccagtggccactgcttccccagggctccctgcctgctgacaactcctcagatggtctcctcctagataaccctcctggggtgaccaacttatgtcaacatattccttagtaagaggcatggcaaggactccagttctactgtaagcatacccctggtttctttatttctggccctttggtgtctttacatcaataaacctctgggtagttccttggtatggcctatccctaaaggttacttagaaattcattgcgatctatttaaatccaacatcagaaacaaaaccaacacaaaccaacaaaaacttagaccaggagagaacctgggctctagccccattcctgctaatgatttcctgtgagactttgtggcaagtgacttcacctctctgtgcctcggattctaaaattgttagaagagttgatggcccctgtcctacttgcattaatatgataatggactcaaataaattcacctaaccagttgtttaattaacaattcgttaaaattaattatctaattaataattaacatttaacaaatgtttgttgagtgcctaccctgtgggatgcagcactcagagtggtgataagacagatatggtgcctgctttcctagtgctgacagtctgatgtgttctaaatgcagaaaaaacaaaaggcgtgggcagatgcaggtgactctacagacaagctctattcttccgtggctgctcccacctgagtttactcatctgactctcactgtgggagggaggagaaatgtcacttctcatgtggggaggcaggagtaagagagggccagagtggaaatgtcctctgataggagcttcctccactttatcacagcaggaacagaggcagtgtcactgcaggcaggaagccaccaatgccaccagagtcatccatgacaactatgatcaggtaagatctgggaagaggttggggaagatggaagatgagaggtagatccggagggtgccaggccttcagcctcctctccacttaaattcatgcattcactctataagcagccattgtgggcaggcctcaattctctgtgtctgtaaagagagttttgattttacctcatttgctaatctcctgggctccccatctccatcattcctccaccattttctcataccctcatatatcaagcctgacctgtatgatttggggaaagcacccactgcttaagatgggatgacacagagggagcaaagatcccccatgaaatgtgagctgttacgcctgaaacgtgttacctgcacgctgtcactgcgatcactacctgcccccccatattgtgtgtagtgatgaagacatggtacttctcatgttgatgttggtgtaaaatgcacatctcacgtggaggtagaggaagaagcagtgtttctcatgagcatcagttcaagatcttgttaaaatgcagattctggctcagcagggctgggatgagcctgagtttctgcatttagatcacactgtcaaatgataccaatgctttgaagagcaagagttagggagtctgttatgggctctgcttctttgtggagagactctgtaagataatgttatagaaatagctaagagttacatggttcttactataagccaggtattgctctaggcacacaacaagtattaacacacattcgtccttcccaacaatgctatgagtcattatctgcattggatacattaagaaactgaggctcgagcaggtaaagtaactaaactaagttcacactgcaactgcacggcagaggtaggattcaattccacgctggctggctctacaggacgcgctaaaagcatgaactcagtctgctgaggaaggaggtggaataaggcaggagacttgggtttcatttccagctctgttactaactggctgtgtgacattgggtaggacacttgctctaggggctttagtgctctaatatgtcaaatgaggacaacatgctctccctacccactgtccagcacctcagggacaaagatgttctgggataacagaagcactaaagcaagctggtgtggagaagaaaatcagcggaactggccagtaaggcagatttttttttcctgtgaaaaacagaggaaaaaaaaacctgagggaaaagaatgaagaattttaaagttctgtttataaggagctgacataatttaactacttgtttgtggggaaaaaaattggttgcctgcgaggaaaataatattgagtctgtatgttatgcaaatatatttcgtgacaaaaaaacaaaaacagaaacaaaaccttgtgggaaccagcatatgaagaaagtgacttgaaaaccattacacagtctagaaaggtgggttcttacattgatctctgatttcagctggaggtccacgctgctgccattaaatccctgggagagctcgacgtctttctagcctggattaataagaatcatgaagtaatgtcctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatgaatggaaggatcttttcattcagggagagtcagtcaagactgaggacagggtgtttctgacagagggatggttgtcatggtgacaaagctgaacaagcacagacacaagtaagtagagaggccactgggtagagaggctgaaaagggtaccaacatctagatggacactgcatagatgattcagagcacaaatgtgtatctttcagatttcatatcacatgctttaatggaaagaacaagacctctgaagtccaattgatctggttccaatcctatgtgactttgaacaaagcacttaacgtttctaagactcagtgtcctctgttgtaaagtggagatattaacaccagtcctgtagtgttgctgtgagcatcgagtaaggaaaaggtctctcatgacctcagcagggtgggagacagcacggtgcaatataaagactgccgactcaggggccaccttctggttctaaggcatctcctgccatgaatttcccagggcaggtcagtacatttctttggtccttagttgttagtattgtggatactgacccttctgtactacctgctccatataattatttatttatttatggagacagggtctcactttgtcacccaggctggagcacagtggcatggtcatagctcactgtagtctcaaactcctagctcaatcaatcctccctcctcggcctcccaaagttctggcattacagacttaagccaccacacctgcctctataatcatttaaaagctggagtcattatgagggctttgacaaccctgatatctgcacacacacccctcctggctgttttccctaactgtgtccctgctccttccccaggctcactgtgacccagccatagttgtttgctctgtgtttcgcaaacacaccaggcatgttctcaccatacagtgtatgcactttgtgtacatgcacactcataaactgaggtagggttaaaaaataaaacaaaccctccacacattatgcgttaatgggattcatacgctattagggagcagggttgtttgctgaggacctaacttttccaaagtgaccttggatgggcacccaccctgagcaggctgggtgatggcagttatagcatttctgatcttttatcactgccctgggatgtgcttcccctggacacctgcatggcttgcacctccacgtctttcagaccttcactccaaaggtctcgtattggaggataaccccccatttccaccttcagcacactttgtacccctttcctgtttatctagcatcctattttgtttattagctgctcctccacatgaatgtaagcttcatgagtgtagggatggtttagtttgttcactgcctggcacttagtaggtgttaaattcacaattcacctagattatttattcaagaaatgtgaataaccacaaacatgtatatagtgcttcctatatgccagccgatagtctaagaaatacacttcttgtaatataatataatataaatacatatatatatatttcatttaattctcacaacaatcctattgtaggtttttagaatgaaataaaatgaaaaaggccacctcattgattgttagcagtatggataattaaaccctaagaaggaaactaggcacagagagcttaagtaacttaccctaggccacatatcgcataagtagaagagctgagcttccaatccaggcagccacattccagaatgaactataatgtccacaataatgtacatatgttgagttcatcatgtgccaggcaccaaggtgagaacttaacttatggctcctcctttactcctcacgatagttctctaaggtacgattataattataatgtgaataactctgcactttgggaggctgaggtgggtggatcactaggtcaggagttcgagaccagccaggtcaacacggtgaaactccgtctctactaaaaatagaaaaaatagccaggcatggtggcgggcacctataatcccagctactg

SEQ ID NO: 686 - DNA, 26191 bp, Human
gtgtatgatgagataaactgattcaaaatggccctagtgtgaaaacttcctgttcaaatccgaagtgatacattgatgaggaatctgctttttgcactcttgcctcactctgagctttcacagggcagtctgtgaagatcagagatatctgttttttgttttttgtttttttctgagacagagtctcgctctgtcgcccaggctggagtgcagtggctcccgatctcagctcactgcaagctacgcctcccgggttcaaccgttctcctgcctcagcctcccaagcagctacaggcgcccgccaccacacccggctaagtttttgtatttttagtagagacggggtttcaccggatcacagatgtcttttgtgtcgttaagaggtaacctgacctctccactaaggggcgtgtgactttctgatgacagaaggtatgtgttgctagtctcctgtttctctactagctcatctcctttagtagaaaattgtaaatattaaatgtgatgcaacaaggtaaagttaatacagaataaaatcaaagtagaactgtctgtacatgaataattcagggtgaaaagcaacccaaaatataatatatgtttgaggatttcttaaagtatttacattattgcctgtggagaattagtcaagcacatgcatacatcataataggtttgttaatcaatataatttagagtgaaaccgataaatatcacgacaatgaagaattaatttgaaattttataatcattatagatgtaataatactttatatttagcccagactttaaaaatgcatttttaatggatacatcaaattgtgaatgtcaaacataatttctcatacacatacttatatttaattgaagcagattttatttttttaagaatgtaataatgaagtagtttccataaaatgcaaatctaaacttaattataaataataggacgacctaaaaaaaattgagccaaacaaacattgcaaaaaagatgtactacactgacatgagactcctacctcattagttattttacacactcagtatgaattagaaataataaaatggcaattgtgttaaaaataattaaaatatctaatatgtattgaggactaatgtgtgccaggttgtatgttaagggttttatatacattatacttcataaattattttccccaatctagattagtaaactggtgttgtagacaccaagtaactttgtaaaggtcatgcattatgagtttcaaagctgtaattaattttaggtctcactggctacagagctcattgactagattattaaattatattttctgatttattacaattacttacacaaccaaagtgaccctcgctgccttttaaaacaaccacagggtctttctgaaagtttgaacttaaagtgttctttcatagatggtccaaacttatatttatcattttcagttttcctattttagtcattaaatcaattaccaatcaattctgtaaaataaagagttaaatctttttcagtagtatttagtttatgcataagttaatgtaatgttttacaaggtataaaatatttctttaaaattttaacaatttttctgttttcctcaatcattcagaataaaaaacatttgccaagacctcatgcccttttagtaaacgaatgtaagtcactaacttaatgtattttagtattaaaagttgttctatatgccaacaaattattcctccatctttagcgctcaatccttacattaatgaattttaaaattgtcatacaattagtgcattttattttcaaatttcaattttagttttttacacaggtattctattggtgataaaatatttctgtagaatctgattttaaattaatgaagatatttatattcagttacttcttagttttcacaaatgtattgttttttattgttcccattaataatattatgtcaaatatagaaggccttttaaaaagtgacctattgtttaaagagatttcagtttaaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtaaaacattaaatagatcttcaatattattgttctaggatgtgcagttgaatgcagaaaggtggggaaagattagggaatattttgcacttgtgagaatcagaggtcaaagtcaggatctaatattctaatatgaaatctgaagcctgattttattcaggcattgttcaattgtaatttgtgattaacaactcatggagcattatatttactgataatgaaatggtatattctgagagaaagattactagagtagatgtagatttagaggacagagtttatcattatgttttcctgtgcacgtgagttctcttgtacgtaaaccttctcatcaactctctatctcccctctctcagtgcctctttctctccctgcaggtttactgccacctccagagaagctcactgctgaggtcctaggaatcatttgcattgtcctgatggccactgtgttaaaaacaatagttcttattccttgtaagcatattcttgaaagattataagggaacttttcactataatgattggaagcgccttgaaacatttcataataatgaggattagaattctctgtttaatgtatatctctgaaccccaagataatatgctgcttctgaacttttcaaatttataaataacagaataattgtagaaaacatttatttttttgtgtgtactaaatatatatgtatatatgatacacacacacagagatgtattctgatttcatgactcaaagacatgttttaagagaaaaaatatttagaaaaacaaattaatttttgaaagtggttagatcaaatactataagagatggtgaagttttatgctaatggctttaaaaatatttgttttaaagatctcattatttttatagaaaagtcatttttatttcagattgttccaatttaaaataattttaaattttgtatttcaaagtaagcaactgaatttattataatttgtctagatattaattttgtaagaatcactttaatttttctaggtattggagtactggagcagaacagtttttccctgaatagaagaatgcagaaaggtacattatgattgtcaatgttctgatgttagtacagtttatattttgtctctaaagggatgcaaaatgataataaaatgttttgggaaaataaactataacattgagccataaatgtttataaaataaagattatatgagggcatgtccttttctccaataataagtagaaatgctcagttaaaatcattataccctcttgttgcatttaattaactgaaatttcctactactataagatgataagagataaataattttactatacttaaaaagcagttttgttcagtgatgtttaagatgtgtagggtggatttttgttggcgggcttgttttgtatgggaacacaattaagggatgagaggtggaccttttattgtgcatgtgcgtatgagtgactcgttattttaaaatatatatttaacaacttatgaggatgcagatattgtgtacctgtatgtttatagctttgcaaatatataaaataattttcatttgtaaacatattgttttgcatagtaattcatatttttatttagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaagcatgtcatggtcatgcatattgatcacaaagtgaatggattcatgatacagggcagatcatgaaatagaagtttccagccccagcagtcctgctcctgtgtatgccttcctcacttttcctgcctcctctccaaacctttgtattgatgtttaatgtgataaataagctttgcctgttccagaatttatgtcaagggaatcatacaatgtgtattttcatgtgtgtcttcttttactcctatatgatatttgtgcaataatgcagttagctgttgtttgttgcttttcattgctgcatgatgtgcatagaacatttacaatctgttcagtcctgtgtctctggatggggaagtgagtctcgtgccctcaggaacaaagaggaacctggatgggcacgtgtagtcatgcggttcctttgctgatccctctcaccgcacctaccctgatgtcttttggtttgggaggagaagcacttcctctagctcctaactggtagcaggcctcctggtaggtcatccttgccagtggtaccaggcttgcctaatgttgctggcaggactccctttcaatacagagtgggaatgggcttagctgacccacctcctgttaccagatttggttctgagaaacagaggactagatcactttcttctgctgagtgggggactgaagatgcccggacactctgttgatccctgattctggggtcccaaactattttgccttcctctttccacctttcagagttttcctgtgtgtctttcattacttgcagagtttagagttgtatttattagggagtagcagagaaaaaggagtccatgtacctggtcaagaccattgttattccaccaaaaccaaatcagataaaagtgagggcttatctagttagagagtggtgtggtgcccagaaaagccaatttttggctgctgtgtcatttatttcctcaatggcaacctttcaatttccttctaaacttcaaggaggaaaagttccactatgagacacatagtggaaaaatacatttatttaatcagaatatctggagaaatacatgcacagtatcaggaaatttatttcagttcttactgtgtctgtcttaccaacacaagcaactgttaaattacatgaatcacaattttgcttgttaaaataagaagaatgaatgtactaagtataaaaattgaagagttcattttaagtcaaaattacaaaaatttgtaatagctttttacactataaaagttgttttcaagtttactattttgtttaaggtatttattttgttttgaaaattaagcatcctttgaaagaatgtattacctgcacttttaaaaattaataaaagtttagaattcaaagaaagcacctaaaaattagtaaaatcttttatagttattatttaaatgaaaattttttatttttcgttagaaatttctgggctccctgtcagttctctcatgggttggcatctctcgtagtagcagtgatcatccatgggtgtcaataaatggctcaacgttcaaattgaagtaagttttttgaatgatgctatatagtagaagaatataaaaggacaggttcagaataacattatgaataaatttaagtgcaattatagccataaataaagatgttgaaagttagtgaaatgttgatataaatgttaaggaatgatccacaattacattttctgtggttttagttacccaggctcaaccacggccaaaaatattaaaaggaaaactctaggaagagaaaatccatgagttttaaattgttcactcttctgagtagtgtgatcaaatcctttatatagtgtatggctccatctcacctgggacatgaatcattgcttcgtccaggatacctgcacagcctaagttccctgtccattagtcactcagctgtcgcagttatgagattgactaaggtggtatggtaccgcttgtgttcaagtcactcttagtttacttaataagggccccaaaatgcaagagtatttatgctggcatattgttataattgttctttttcattattattagtttgttttaatctcttaccgtgcctaatttataaattaaacttcatcaaaggtatgtatgtatagataaaacacagtatatatacagttcagtactatctatgatttcagacatccactgggggtcttagaacatatccactgtgcagatgaaaggactacttcattcagttttcatattatgatatgcagttttcccagcattatttttgaagagactatcttttttttccaatgtatgttcctggcacctttgtcaaaagtgagttgtctgtaaacaaatggatttgtttctggattcattggtctgtatgtctgttttaatatgagcaccatgctgttttggtttctgtagctttgtagtatattcaggtaatgtgatgcctccagctttgatattttgctcagaattgctttggctatactggatgttttgtggttccatataaatttgaggattgcttttgctatttctgtgaagaatgtcactggcattttgatacagattgcattgaatctggactagctaaggttttattttgaatgttgaatagaaggcacagaaaggttatatgtatatcatatgtatcagttcctattttaggtaaaaagattgcaacatttcatccatatttacaaagtgtgttcgtttttattatacctttctcatattgaagcagctttatcatattcctgtttttctaatagattttgttatcaattgtaacatttttattattttggcatcagttggaatgatacatgttttctctgcataatcttaataagtaaactatttcaattctctcaaatgttaaaccagtctgaaataaaaccatactggtcattctgtattgcctgtttaaatttattaatgcacaggagattatactgtgtttttatttatagctatgtacatgaaagccttttctcttaagggtatattgggaagcatttctctttttctataacctagaagactttgtgtaagggtactgttttaaaatgtaattattcattagtgatgccatctgagtgtgtagaatgtttttgtaggaaagtttatgtaggaaagtcaatttctttagcacatacagacatttcatccatatttacaaagtttatatttatagaggttactcagatttctgtttgttgtattgcaatttggtaatttgcatattcaagaattttctatctcatatagatataaaagtattcataatatggtttcattatctgtttaatatctgtaaaaaccataatggttttcccttatttaatctagaaaattatttgagccttctcaaattctttaagtcttttatcaattttattaagtcctttcaatgaaaatatcttcagcctcattgatcttctctactgtaattttgctctttgtcatgattttttactatttattgttttcttcctaccactttacttctatttaatttcagttaatttcatatttctgtttttattcagacaattcagtatctgcaattttgttgcaatatatgaatttaaggcaatccatttttcccaagaaaatattttgctctattttccttttaattgatgtaaaaattgtgaacatttattgtgataatttatttggcccttaggttatttagaattatattactgaatataaaaccatataaagttcctaaagttttgattattgacttctgtgttagtaaactgtagttagaacattttctgtgaggctagaaatgttcttcatctctgtgtaaatatagctagtgtgactaataaacttatgtttaatgttatttacttctaattaattaatattaaacttgaattggtgcattttaactgtccactggccaactttggctaatgctactgtacttatagcaaacttctaaattttatattaaaatgcataggtttatgaaaatacagtgtagcttaaaaatattagtattccgaattagtatacagtttatatgtgtgtgtatacacaggtgtgttggctaattgtctagtttaaatctctgtatagagtcagtgatgtatctgtttgtgtgatgagatgtgaaagagaagtgactaaatccctaaatttattaattactcatttatttctttcaactttatattaaatgtgtattattaggtacatacaaattattttaaaattactaatggtatagataataaatatatcactatgaatatgcttcttcatttttaataacaacttctgttttatattattacagtatattaaagtggttttctaccagtttgtgttgcatggtatattttttccatttttcatcttcatattttttatgtttatgttaaaggagtatttttatgagtatctcataaagacagcaaactactatttttaaatacaagcactttgtaacaaatcaaaatcattccatatgtatttgttaaattttaaaataattatttatattttcaattgtatgtataaacgtgtaaatataatatgtttattgactgtaatattatattatttcatttcagttaaacacttccaattcttgacctctctttttcttaacttttatattaagctctggagtacctatgcaggtttgctatatagttaaactcgtgtcacgggtttgttgaacagactattttgtcatccaggtatgaatcctagtacccattaattacttttcctgatccctttcttcccccaccctctaccctcaggtaggccacagtgtctgttatttacctctatgtgcccatgtgttctcatcatttagctccacttataagtgagaacatgcagtatttggttttctgtttctgtgttaattggcttagaataatggccttccactgcatccatgttgctgcaaaggacataatcttgttctttttttatgactgcctagtatttcatggtgtgtatgtaccacattgtcttcgtccagcctatccttgatgggcatttagggagattccatgtctttgctattatgaagaatgctgtgatgaacacgcaagtgcatgtgtcttttgggggatatacccagtagtaagattggtggatcaaatggtagttctaagttcgctgagaaatctctggactgccttcctcagtggctggactaatttacattcataccttcagtgtgtaagtgttcccttttctccaaagccttgccaacatcagttgtctttgacattttagtaatagtccttctgactggtgttagatggaatctcatttcagctttgatttgcatttctctgataattatgtttcatatttttttcatgtgttttttggccgcttgtatgtcttcttttgagaattgtctgttatgtcttttgcctattttaatgggattatttattatttgattatttaattgttcctcatagattctggatattggacctttgtcaagtgcatagtttgcaaatatttttcccattctgtaggttgtctgtttataggagcttaaagtttcttttgctgtgcacaagttgagcttattttgtatgtggtatgaggtatagatcaaaatattttgtgtgtgcatattgatagccaagtgtttaaacatttgttaaaaagattatactttctccactgaatgcctttacatctttcttgaactattctacattccatatatttgtggatacatttttgcactttgtagtctatttgattaatctaggtatctatttatatactggttccacatcttgtgaaaattgagagaaagctacagagacttcccatggtcctcactcatgcactacttctcccatgatcaatatcccccatcagcatggtatatttgttacaattgaaacatcattattattgaaagaccatagcttatgttaagtttcactcagtgttttacactttatgggtctggccaaatatataatgataatgacatgtctttatcatcatagatcatacagaataattgcattgccctgaaaatcttctgtgctctgcccattcatcctttcctccttcaaacacatggcaagcatcgatttttgtactgtctccatagttgtttacttttccagaatgtcatatagttgaactcatacagtatgttacatctgagccattacatcttaaccatatcatatatctcaaccatttttaagtgaacaggtcagtagtgttaactatattcacattttacaacagatttctagaatttgttcattttgcaaaactgaaactctatacacattggacaactcccctttttgcccctagcaatcagcattctactttctgtttctatgagtttgaatactttagatatctcatataaataaagcaggcagcattttttttgtgtgactggcttatttaacttagcataatgtccttaagatttatccatgttgcagcatgcaacaagacttccttttttaaaataaagtatattatcctttttaaaaatgtttaaacaactttattgaagtatgattgacatacaaaaagctgtacatatttaatgcatacaacttgataagattagagataagtgtataaccatgaaaccaccacaataatctgtgtcataaacatatctgtaatctccagaagtttccttccaccttctttattattattttttgtgatacaaacacttaagatctacgctcttagccaaatctttagtatacaacattattaactacaggttctgtgtagtaaaacagatatctagaccttgttcatctcgtataactgaaagtttgtaccctttgactaatactctcctgtttttccctctcccagcccctgacaaccacccttctactccctgcttctatgaatttactattattttactcagcataatgtccttcaggtttatccatgttgttgcaataggtttttcttctttttaatggcagaattgtattccattttatacacatgccacattttctttatccaccaattcatcaatgggcttgtatgttgcttctatgttttaactgttgcaatgaacatgggagtgcagatacctgttcaagttcctgatctcaactcctttggctctacagaagtaagattgttggttcatatgtcaactcaattttaaattttttgaggaacctccataatgttttccatagtgactgtaccattttacattctcattaacagtgcacaagggcccaaatttcttcacaacctaagcaataattgttattttctgcttttttcatagcggccatgctaatgggtatgaagtgatatttaacagtggttttgatttatgtttttctgatgatagtaatgttgagcatcttttcatatgcttattggacatttgtatatcttctttggagaaatatctatttgaatcctttgtccatttttaaatagggttattagggtttttgtcattggattacataagttcttaatatattctggatattaatcccttattagatacatgattttgttgcttcaatcatttgctctgcagacatttttaagtctgatgtaatcccatttgcctattttttgcttttgttggctgtgatttgggtgttttatcaagaaatgattgctaaatccaatttcatgaagctttcctcacatgttttcttctagaagttttacagttttggatcttatcattaagtcttcaatacattatgagttaatatttgtagatggtgtaatgtaaggctttgatttcactcttttgcatatgtttagccagttttctcaacactatttctggaagatactgcccttttcccattgaatggtcttggcactcttattgaaaatcactagtccatatgtaccgacgtttatttctggatgtattaagttgttgtttctatggggagcaagtgctggggtatgctattcctctatcttgttgatgttgcctccttccaatctagaatagtattcagggcaaatgtgggttctctggaaggtaatgtggtcaaaatactcctgctggtgggggatacctcaaccattccctggcattcacacagactcaagtcatctcataatccgtcctacctgttcccttgattatctcagggtctttgtcttaaaatcctcttcaatcatttgattatgatgttttgagatggggatttctacatgctgattctattagtcattagtttgcttagcatcttggatgtatacatttttaaaaaagcaaatttgaaaagtttttaagtcagttttgtcttaatattatttttctacatctttctgtattctctttttctctgggatgaataatttctattaatatatcccaaagttgatgaattcttccttttgaatctcaattttttttctagccaatttagtgaatttttcgtttcaagtaatgtacttctcaactcagaatttggtttatttcttggttttcatttctctgacaaaatttcctacttgttttctcattgccatcatattttcatttaattaattgaacatacttttctgtataatttaagtacatttataatagttactttaaaatatattttctgataaatctaccatcttgtcccagaaaaagtcagattttattgactgattgtctttccctccaagtatggaagacattttccagtttctgcatgttttctaatttcttataatagacattttttataatatagtatcatacaaataaatttggggggtttataaagattttgggggggtaacttacataaaattttactgcagaatctttctcctttaaaatgcatttgctgatgtttttgtttcaaattctaattttttatttttattttttagccccatttcctagggattgcccttgtgaattgcatagcttggttgtcagccaatatattattttaaaaggtttattcgaaaaccttaagttagtagaggctccactctgtgctagcggtgtgtgtgtgtgtgtgtgtgtgtgtgtgtgtggtgaaggaagtgttcataaatttgcaatcagttctcaagtctccttgggcttttactttttactggaatcaccctggtctcctctacacatatgcatatttttttcaataatcaagaataaaatcctgtcatttatacaacatggatgaacctgctgagcatcatgttaagtgaaataaggcagatacagaaagacaaatatcacataatctcactcatgtagaaataaagcaaaaaagagctgatattatagaagcagagcgatcaccagaaaaacaccagaacagtggtcaacagagactggaggagagaaaaagagggggacagggtgagagcttggtcaatgggtacaaagttatagttaggtaggaggaataagttctgttctattgcatagtagggtgatgatggttaacagtaagatattgcatattacaaaatagctagaacagaggcttttgaacgttctcaccacaaagaaatgataaatacatgaggtagacagatacactaaataccctgatttgattatttaatgtaacatatatatgtattgaacatcaagttgtaccccataaatatgtacaattacaatgtgtcaatttaaaaaaaaatttaaagaatatgtagagggctaatgtcatgaggtctattgcactctcatgtttaggattttgttatatttatggctggcactgttcttgccccagaggagactacacctcagactaaaaaaaataaaaaacaacaaaaaatggggttttctcattcatttcctgcaaaattcagcactttcagttgaaaagcagtggtctgttacactatgccccaacctctgaccgctaatcaagtctgtccttgtggcaaaaaacactgttgattttcccccagctgtaaaaactgcaactgttactcactgtgctgggtgtggtgggtgggcagaaggcacgggagcagcactaggtaaacttactacaaatttgctgcactcttccttgaatctctagcagtttttccaagaataaatagttcacaaatgattattagcctttgatcaatttccagggcctcggaattgctttgttaatttgtcctcttcattcagtcacagcaatacatttgtatgtgttcagtgcgtaacactcattatcttagtgaattgaaagactgaaaagtaacaagaattagctttgctattacaaaatttaaattagtataatagtattgattttgcatctcataaaatttgttttcttatacaaattctcaaactctgccagtaattttttatggattgcagtctcccgcaaaaccaataatcatttgcaggtgtggccaaatggcccagctttctattgcaaacactaatcttcttgagaacgtctatattttatacctagaaggaataacattacaaagaaaagagcaatatgtgaacaattgtataaatatttgtttccatagacaaattatatagaaaatattcagatttagatacgtaactattaaataagtcatctattcataaaaaaattgttatatattaccagtattagcaatacatttccaatatcttcagagaggaacaagaactgtgcacatctgaatttttacaaagacaaacttcttttgaattttgttcggaaataaaaacatgcttgtaaacaccagcttataaacatgcttataaacacttaagtgttatagcttacacaaacttaatataacattactcccaccatctgtaaagaacatacttctagttgcttcaaaagccatacaattaggttcttcgaactatttttaaatctttacattattttaaaaatacatatccaggtacatactctttctttctttgagacagaggctcgctctgtcacccgtgcagtggcagtctcggctcactgagatctcagccttccaggctcaagcaattcttcggcctccacctccgaagtagctgggactacaggcactcaccaccatgcctggctaatttttcgtagagatggggtttcgccatgttggctacgctggtctcaaactccttaccgcaagcaatctgtccacctcggcctcccaaactgctgagattacaggcgtgagggattgtaggcgtgagggattacaggcatgagccaccgcgccctgctatgttacttatttcttaaacacctgcaattcattaaaatacaccatgtataaattataaatcataatattatcaagaactgttatttctaagtgctgaataaaatgaatatttccacgatgaattaatttcttctagtctttgaaggtgtttaaaatgacaattcaacaattgtgggtggccctaggacagggcagttctaaaactagcaagttgaaattggcgaggatggatctcacgctgtgactggccaggaggaagagttttcattccagagtgctggagctagataccggaaggcatgtaacagggatccggacagctaacaaaaacttgctggagggtaaataccgcaggatgttatgcaaacatgcagctggtagccacagtcataggagcaaaaggagagaaagtatcataaaaccaggaagaaaaaccctttttcctccagactacacactgccttttagggacaaaatttatcatataagctggcaagggagaaattttatgggctctgctttcattatggtagagcaggatggtgaaggatagatttgaaactaagaggcaataaattggtaataaacacacaaggttactatgcagcaaccacaatgttgctatataacaataacagccatttagatacaccccacttcctcagagaaggaaaccaacattacattctaaatctgttctagtgtagcattgtcagtaattagttctcctttctggtagagattggtatttccactgagaaatagttttctttgttaatatcacagttccacgtaaaaacatcatttgcttctatggcatgtggcccttaaccatttgtgcctgttctagccccattaatatcaaattcattatcttctgagtaggtcacattgtctgctcaaagcatggaaaccctgccttgttaacctcttccttaaaacccctcaaaggctttttactgactacatggtactatcaaacaacatagcttagattataaatctttcttctcacttgaaggggtggcctgcccctccacacctgtgggtatttctagtcgggtgggacgagagactgagaaaagaaataagacagagacaaagtatagagaaacaacagtgggcccaggggactggcgctcagcataccaaggagctgcagtgggcactggtctctgagttccctcagtttttattgattattatcttcattctttcagcaaaaaggaatgtagtaggagggcagggtgataataaggaaaaaaacatgtgagcaatagaatctacgtcataattaagttcaagggaaggtactatgactggacgtgcacgtaagccagatttatgtttctctccacccaaacatctcagtggagtaaagaataacaaggcagcattgctgcaaacgtgtctcgcctcccaccatagggtggtttttcccccatctcagaattgaacaaatgtacaatcgggttttataccgacacattcagttcccaggggcaggcaggagacagtggccttcctccctttctacacagacacagtaacagtctgatctctctttcttttccctacatcactcacaccctttcttgtggttccaggttgccccaggctgttttcatctccagctcttcataacgccacttaataaaccaacaatactggactgcatatagcattttttattcattttaatgtctctcttctatgttttagagatttctgtctttggtattttgtatgttttaacaacattaccttgatttctaacgttttttttttaatctccagaaatcacccaatctaggacaccttctctaacaccattttctcacatttaatactggagacctattagaaaattgtcctttataatactatcatttaaaacacccagagtttgtgtctaccgttgtgaattacatactaatttaaaaccatctgcttctgtgtatgccttaaatagagtgtggacaactagatgataggaactgtgctttatactttattgaactttgtttattcatggccaaacaatatgcttgctccataatagataaaagctcaataaataaatatagaatgatattatgaaaatatcagtaatttcctatttacttatttttgttaagctttggtactattacttctatgtcaaattatgaagacaacattattacagtgcagaaaaacgccaggacctcttggctaagacctcaagaggaacattgtaagattttagtagtgatttttatattcgccaaaatataatgcaagcgttgtagacttttaaccacttgcattttttattcctttgcacacaaatgaagctactggggataaaggaaggagaaataagtcaactaaaatttgagcacctgctaataggtacgtaagagggaaaaaaacgtgacttgagacaccttgcttcactcatttctacaattaatgagccattttccttaggaagaaaaatgctgtcttatccctatatctgtgtctttaggcacttgtggtaagtaatgtcacaaatttaagacatcttcaaaattctagacttctttgatatttgaagcactgaagtaaacacaaaatccatttgaatccaagatgcagaagtcgttaaaggcatcgttccatctatgaatgtggagattatcactatagcaggaaatggaaggtttaatggcaatcaaataagcaatcagagaaaagtaaccaggatgctaataaaaaatatgatgtcatctgacctgcaaatcatgcatgtgacttacttgagagcaattgtttaaagttactatttatgtatggctatttatgcacaattataaagataataccagagtgggaaaaacacttttctgttccattataccatatagattgcaattaaacaatcaaaacaatggtgtgtcctagcatggattaagttaatataacacaaatatttgctaaagatatttcaattgaattgctaaattttagaattatacaaaatttcaactgagatggggcaaaaaaatcatttaatcattcctggcttaggaagctgtgccagagaaaattaattaattgccaagatgatgacctgtttttccccaaagtataaattccagatttatggaatctctgccttgagttcatataattacaatacaccagttaacattatatgtcagtatgtgtagcccagtacataatacctagctgaatggaaaataggttctgaaaatatatatatacatatttcttaaaatatgtttgcagacttttttacttttacattagtcatcatttcacttctgcttcaatatgcccatgcgtgtccagacgagactggatgcatcatggtggtgtggccatagatgcccctgcatatccaaagactcagctctatttcttccactcctttttattttctttattgtccatgtgaattttaaaaatttgtcctttttgacatgtcttttgtcaattcaaacacatttaccaaaaggtcaagattacaaaatttttgcttggcaatagctgcacatacttaagctttcatatttgggcaagcgtccagtaaacgcctctgaccacatccagctttagtgtcacagcttgaagccagcaacctgccaagcactctgtttctaaccacaagttggctgcgtgttaagtctttcctgtgtaccagaagagaagggttttctgaggccacagtgcgagttagcttactgaccaaaaaggccggttgattgttggctcttctcaactaatgaaagtaattaaatagtttattgtggtgatggatgttctcaaatgacttgagcccaggctgtttgcaaaatattgtaatttttcttctaacaatagtttttgaaagttatatagatacgtctatatgaagtttgttcaggtacttttatagtcaaattattctttctgcagaagttaattgcgttggttttatttcacttattagaaagtattttatctgaaaactatgctatgtccttttgcaattcacatagaataaaccagtacaaatgcccagcaaatccccaataagtttactatcatgactacagcaaagtgagtgtatgttcaacattgagaaagaaattggagttttaacatactatttctttatctaactaattgttttaacccgacatacaggacccattttagaattttcttctttaagaatcctttccacactctgtcagttggtttagggacctttatatatgacaataaaactctccctggtgcttagctttatcatggtatttatttcagaaatcttcttttaggtatgtgtggggacttcccagttggctgtaagttgccatttgaactaaacgaaataggtaggatattcaaatgttcttttttatcctattcctatcccccttttctcaattctgtatttaagagacaatctctattcaatcgaaaactacatatataaaaataactcttcaggaaattgtgattcaggtttttcccataaaaagcctgcatttactcatttattcatttcctttcaaaaaccaaatatttgttaaaatgtagttgttagaaaatatcagcctatatttcctctatatagatctatttttactatataaaatagctaatagaaaatgttgattagctgaaaagaatcttggtatgtcagaaaataacatattttcttcaacttgttttatattcacctatcttgtttaattttgaatttgttttatacttattcattttatatcacctaaactaaaaagtaatttccagctgggtgtggtggctcacgtctgtaatctcagcacattgggaggctgaggcaggaggatcacctgaggtcaggagttcgagaccagcctgactaacatggtgaaacctcgtctctactagaaatacaaaaattagccaggtgtggcggcacatgcctgtaatcccagttattctggaggctgagacaggagaattgcttgaacccaggtggcggaggttgcagtgagccgagatcgccccgttgcactccagcctggacgacaagagtgaaactccatctcttaaaaaaaaaaaaaaaaaagtaattaatttccatgtgggcaaaaactttcttttggattgtttactttgacattctcaagatctagaaaagtgcatagcaaatagcattcgctaaagaaaaaaaatgttgaataaatttattgtccaactttaacacatcaccacatgaaagctgttttccttccttatatttcagagttttaagattaatagctttggtttttgttaaaatgttataatgtgttcatcttatattactttatatgatgtcttatgttagtattttaaattaataaacataaaatatatatttagcttatcttgttcattggtatcaattcatatattattcttatgtatactggggtatatatttaagtttctaattcttctgcatatgatgtagatatgacagagatgcaatttcatgttttttatattaaaatttaaaaattcccaggactaattttttgtaacttaaaggccagtgtgatagtaacccaggacaaattattgaataggagctaatttcccactttatctgcaatgttaccttatattttttaatctatgcacatgactttttcttgtctgtatttttacccttctcaatttgtctatctatgccccacatgccactttgcctttattaatacggttttaacataggtcttactatctagtaaaacaaggctcccacattttcttcatcttcaattgtgactttcctagtcttgacttttgtaatttaatgtacatgtagaattctgctttgtaagttctacaacaaaacctgaggtattaactggaattgaattgaatctctaaaatatttaggattaaatggcatcatttaaattcatcattttcaaatcctaaaatgttatttaaaataatggcaaaactacaattacttttgcaccaacctaacatttatccaacaatgggtggtcttaactcttttaccaaattaacaatatttttgtagtgataaggcggaagtactgtggtttatgtttttccacaggaagatgagattataatatttgtcacatctttctcaaagatagaaattcactaagtatctccactttcaattctagatcaggaactgaggacatatctaaattttctagttttatagaaggcttttatccacaagaatcaagatcttccctctctgagcaggtgtgtgtatgtgtgtatgtgtgtgtgtttattattcaagatatgagaaattatatttcaacctcaaaaaaataaaaatatttacactataaggtaattctaattgtttcttagatgcttgaatagaactcctgaggatacggaatgcttatcatttctgatgtatattctatcactgtatctgatgataggtaattaggatatacttattgaagaatcagaagttgtaatattactataagaagaagccttgtctctaagcaaaactagaaaaatgaatctttacatttaggatgagaagaattgagattcaatttaaattgtcaaatttttgagttttctgatgctgtagggggcacttacctttgatacacatctttacatgcaaggtgaaacaagttatatctgtgctttccaactatcataatcaaatatgaaatagcttttatttttgaaatctaagcactatgcttatttattaaatggttttttctggaagctctgctgtgcattgctaagatgttactatataaacatgtgagattagttttgttaatgatgatggtgatgataatttgttgatgatgatgatatgggcacgttggattaaaatgcactagaaaaggacattcaacaaaagtgcatataacttacctgagtttagcttgcagaaagaaaactaaattattgccagataaaataaacaactagaaacacttgatcttagctaaaaggccaagaagcaataaacgactataaacagaaaactgggtgtgttgttatctaatatcagtaacgtaaaatattggtattaaatatctcaatgtaggtgaattaataggttcattatattgttatgacattttgaagtaattggcgattattttacaaccaagagaaatgtataaaattaattttgcctggctttatgtgaattgtcatttctattcttttcttaaaggcatgcacaggggaaaagtttctgcattttacttttctattcaaaatattttatctcaccacgggaaagagaacaaaaaacaaatgcccagttttattttattcaggaatcctttgtgcattgaagactttagattcctctctgcggtagacgtgcacttataagtatttgatggggtggattcgtggtcggaggtctcgacacagctggggtatgtttttaccacataagtgtgtagttttgtttttatacaattttaagataccaagaatttcatacaagcatataaggcataggcaagcaatttactctgattcttttcatgttctatttatgttgatttcatgttatgttcatattgtattttaaatcaagtcttccaaaacttaaaaacttttttccctttattttattaactatattatggtaaagtcgctcacaacttgggacagcttgaaatagtgaaatagatgtggagtcagacttgaattttactcaaacttttaccgctctctagatttgaagggtcaatttgcaacctctgtgtagtttagtttagtttctttttctatcaaatacaggcatgaaacattccatatttatcttagatttgtgtaatattcaaatcaactgacatgtatgttaaagcactttttatcctaaaggtgtttataaatttataacttattcacagttggtaacattatattaaataagctttatgattttggccatctctagcattcaatttcttcatccataaagtgatacctactctctttactccatatgtaaaataactgagttaggtattacatgcgcaatcaatgtctaattttacctataaaatataattcatattatcatttaatttataaaaggcttttgtacaacaaacccccgtgacatgaatttacatatgtaacaaaccttcgcatgcacccctgaaccaaaaataaaagtttaaaaaaggcttttaagtaaatattaatcatcagtaaataattaatatttcaagagagcaaaatgattctttaggtattttgttcagaggcaagattatctgtctttgttctaaatcattagaccccactattttagcctatgtatgtccttcattataaagaaaattagatggctgggcacagtggctcatgcctataatcccagaaatttgggaggctgaggtgggtagatcacctgtggtcaggagttcgagaccagcctggccaatatggtgaaaccccgtctgtactaaaaatacaaaaattagccaggtatggtggcacaagcctgtaatcccagctactcaagaggctgaggcaggagaaccgcttgaacccaggaggcggcggttgcagtgagccaatatcacgccattgcactccatctcaaaaaaaaaaaaagaaaagaagaaaattagacacactgctatttactaaaagcttactaaatgattgatgttattgatgctaagttcattatatttttattttatttttaaaatacccatactggattgtgacagtatccttttcttttttatttctttcgtcttttgcaaattaggaaaactgggatgcaaaagctaggttatttgtgaagttatcaagtttgtatatgtggatctgtgatttaaatacatgtctttctccctacatctgccttttcactaaccaagtccctttctggtaatgttaggtttcattatacattacgaattaactaattttaatagtatataggattttgctaagggtactttgcatggcataaatatagttttatttatatagtaaagtgtaaacataataatgtagtactataaaacaaaagtaagttcatgttgtactttaaaaaggatagtcaggggaagtacatagatggaaatggcaagctgaatttttaaaatttatgccccaaatggcagaaaggccatgactcatataagcctgaattctttttctctagagatgagtgaatttcataattataacttggatctgaagaagagtgatttttcaacacgatggcaaaagcaaagatgtccagtagtcaaaagcaaatgtagagaaaatggtaagtcctatgttccatttgtctactctcagtatattgaaatgaatcttggaaactatgtgattaaatgaatggcaatcattcagttgactttatcttcatgaggaaagcaggaataacatgaactctcatataatattaaaatatataataaaattatggtattaaaagctattgagtttagaatattgtcacgccctaaaaaatgatgagtttattatcatgataatataatcgaggcaggagtttctaagagatcactgaaaagaaaactaaatagaaatgaaaaagagaagagaaaagatattttaaaaaccctccagagatatgttcctaaacattatagaagtggtagcttgattattatttatagaattgtttctgagttcagtgaagaagatatattctccaatgacttttttcaaagcagaatattattggtaatagacctttatatagtttgtatgaaaaggaaaacaacagatgaccctcacttatcaatttttattaaaaactaagaaacaaattattaacaaatagcatctctttacaagaattaatttaaggaatgcaaagtgctatatgtaaaaatccctttttggactaaaatattcaattgttaccaaaatttaaaacacacatgccctttccctcaacaattatcattgtgggaatttatcccagagagagactcaaaaatatgcacagatgggtatgaaatgtatcattatttctcatagcaagacctaagaaacaatttaaatatccactggaaaaaaaaattgacagtccgtcaaaaattagatctgtccagagttgtcagtgaaatacaatgcagctatttataaatttggtatccttatacgccatgaggactaatcaccaggatattgtcttaggtaaaaaaaaaaaaaaattcataggatattttgtgtattatagtttctttaaaatgtatttttaatatgtagttaaggggaacggtaatttttgtttatttttagttggcatgtaataattatacatatttatgggatacagtgatatttccattcaactatacaatgtctaatgaccaaatcaaggtaattagcacacccatcacctcaacatttatcacttctttgtgttgggaacattcaaaaccttctcttctagctatctgaaaatatacaataaattactcttaacagtactctccctacagtgctatagaacactagaaaaatcccgcatgtagctgtaattttgtattcattaaccaacctctcccaatcttctcctcccccctattctttctagccttaaataaccacaattctactctc

SEQ ID NO: 687 - DNA, 234287 bp, Human
  misc_feature (1)...(234287): n = A,T,C or G
cgctgtgtaaagaaatacccaaccatagacacggcaggaaggtgcagaacatgccccttgaagtaggggcggctgctggttgggtttcactcgtgtttcgaagaggatggaagcgctgacaaccacaggaggaatgcgtcatgggttccaggacagcaactggctggacccaactctgggctgcctagctcccccagccttcacaattcaactcatgccacctcttacaggaagtcctcctggatgcccagctctggagtcatctctgtggtatactaggattccagttccaactttctctggaaccagttgggtcatcacaggtcacgagagcagatgcctacagagagtgaggagaggcgggacctgccacaaactgcaaggtaagtgcccatttaatggttgctaagcaggactgtggggctagcgtggccacatcttccaatatctcaagaaaagttaccaatctaaatttccatgtgacatctcaccatgcctgggagctggatccagcctcgggcacccttaggtgacacagaaagagtacagcttgcaggtgaagatggctgtccagctgcgatgctctcacacccaggacccacaatcgaaagaaccaaggacgtgagatcacagttagagcctgctgtgtaagtcgtgtttcccccaacgactgggacctcctggccagcagggagaggcctgagtcatctccgggtcctctgcccctggccaaagcaaagaccaaagccctggccacacagacctggggcagggcaaatgagaaaatcaaaggggtgggtgttcaccctctggggaagtgaggcagaaattgggggtcccagggcagagatgatcaacagcctgagagggggctctcaggcaggccctggagagaggccgctgagctcagacagcatgggaggatcagggccttgctggagaggagggactggggaggggttccggttggcaacgggctctaacagcaaactggccccagaatgggcccaggtgtccttggatgcttgggtggaaaaggtaggcagagcttggagaggccatttcaggttgggggccgggagtgcaatggcgggaggacagaatgcatacgtggggttgaggacagatgagggcaggagcctgactgtgctcatgggcagagagcccaggtctggcaggaagaggctgtgctgaggctgcagcggagggatgggaaggcagatgggggacaggggacagggacttcagaggaagaggaactggggactgaaggagccttgcctctctcagtaagggcaaaagttgatctttggggtcgcgccctgggtgtaccctcctaacagcatcttctggcctttgcggcctctatttgggcattcggcctggctcagaccttggacccagtagtcagtcccccctcccctttcattccctcaccctgtcctgccccagagcacagagacagggggatgcaccccttgaattccagggctgatgggtgggacccggcaccccaagggctctctaggtggggacgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgcctgggttttggaaaagggttacctgggagtcccttgggagggcaaggcctgcgctgaggactttccgcgcccttcccgtgctttagtgagcctcgtgctccaactgaagggcttggctggaaagcaggttgttttgactggtctgagcagggggccatttatgcatggggagcgcccgggtctccaaaaggctcagcaggcaggagcgtgcgcctctctcttttgcctgcctgaacaggtctctggcttgcatccgggggtgggtccgtgtatgtgtgtgtacctttgtgagtgtgtgcacatgtgttgtggaacgttggtgtgtacctgcatctgggtgcccgtgcacctgtgtgaacatgtgcgtgtgccagtgtctcttgtgcacgtatgtgtctgggtttctgcacatcagtgtgttgagcatctgttgagtttgtgtccgtccttgtgcatactggcgtgatatgtgtgtggtggacttatgggctggcagtcagtcttcctgtttccttgcgtgcgggtaataccagcccagggagctggcagtgatgctgaaatgcccagttagccctctgccccttggctgaccgggaatcattggtttttctgctgtggtttcctgttgaactccagctggttctttgaaaagttggttttctctattttgagctgaggggtgcatttggaaatgaaggctctagtgcccatgagctgctcgatcttttgggggcagcgcctgaaggacaagagagaggctaggggatcccttttgagactgcctgcgcctctctagtcctgtgactggagctctgggaagctctgcttcctggagagggcaggagggaccgtggctcagcacaagggggcctcagaggaagcctggatcgatgctgagggaggaggctgacattggcggtgctctgtccggctgcccggggcctggcacacagcagaggccactgcagttttctattttggattgggtgtgtggtggtcaggctggctgtgctggccagacatctgaagccgcccaccatgggttccgctctaattgctactcagggaactcctgccccgagtgagtggccactctcccagcccccgtggcccctgagcacgcccgtactcgggcagctgaggctcatcctacagtctgcagagccggcaattacaccagggctctgcaaccactgtcattctttttatggagacacagaaaatatcacttgttgctttggaaaatcactgcctttggctggatttagttagaacttggccatattgcaaacaactgtaaatatccctggaggagctgggttaaaatggtgagcccttgacatcgcccactgtctctgaggacatcctgggcctcagaggtgtgtcccattttacgctggaggttaatttcctaaatgaaaggagatgtttgctgcggacttagggtgaggtaaggtggtgggagttgacatggggttgcagtctgttggtgggccaacacctgtgtactatgcattcctgatggagagcattttggggaggacttgtcactgtttcattcattcagcagttcatttggtgattcatttttcagccagcaccttctcatatgtttatcccctgtactggtcagcaatgaggcaggtctggtacccacccagggctcctgtcgtcagggtggctgacggacactctggccaggacttggagagtgtgctcctggggggctgtttgaatgggggctggaagaatgagtggccagctggaaaagacgcaggttggcaacccgggcagagggaggagcgtgtgcagaggtaccaggtgtggattggcctgggcaggacaggcctgctgaagtgtcccatgtaccagacagagctgggaagaatattggggttggaagaggagctgggacctgcctgagcggcattgaatgctgtcactgaataatggccttggacagtgggacagcaccattggttctgttttctttttttttttttttttttgagacggagtctcactctattacccaggctggagtgcagtggcgcgatctcagctcactgcaagcgctctgccttccgggttcacgccattctcctgcctcagcctcccaagtagcagggactacaggcgcccgccaccacgtgcagctaatttttttttattttttttaaaatttttagtagagacggtgtttcaccgtgttagccagggtggtctcaatctcctgaccttgtgatctgcctgcctcggcctcctaaagtgctgggattacaggcatgagccactgcgcccagcctcttttcttttcgcttgtcctctttctcttctcttctctttccttccttccttccttcctttttttctttctttctttccttttgatcaggctggtctcaaactcccgacctcaagcgatctgcccatcttggcctcctaaagtgctgggattacaggcctcagccaccgcgcccggcctcttctttccttttctgactttgttgctgcgtatgtgtctgtcctactgttaaatccccctctgctgccaccacgataggcttctttgctaaggacctgggtctttacacagggcacctcttgtcctcacagagccctggtcggggaggcatctcatccctggttacaggtggagcactcaggctctgggaggttgagtgactagacggaagttattcataataatatccacagcgaggggttattcatagtatccacagcaaaatgtccctttgcacaaggcatgagcaaaacaggctgcacagagtggtgttgtgcctcacgttgctgcggaagagttttccagtatctcctgggcagcgtggtaggcgtgctaatttcacgtggtttttacatgcccattaaaaacccagtgagaagccttttggcgtaaaaggtaatgatggtaagtgacagttgactgtgttcctattaacattgtgtgccaggctctcagctgagccccctgtgccacctcgccttgtttaatcctcacagcaccctacggaacatatcccgacatcatcccccttctacagatgaataaactgaggctccaaaagtcgagatagcttgcttcaagcttcgaagccagtatttgaacacaaatctgattccaaggccatgctcactatgttttgttgccttttcctgcatgcctacaaaaagaattttaaaaatgcatttctttacaacatttcccacctttcttatttgactcctggagacgttctcattgtgggtttgaccatcgtcagtgtgagtggagccgggagcaggcctgggagctgagtggccttgactggctcgtgacctgcgctgggctgcagctcctatgggtggcctaagtcctcactggtgggggactgcagctgggacttccgtgggatggaagcaaccctgcccgcctctgcctccccactcagggcagcacggggatcctctcctgccaggctgggcagcagtggatgaagcctccatgggctgggcggtggagatggtccgccctccaaggcctggtccaatcctggggcccaaaggaggaagtgtatgcccttccctggatgcttgatgcgaaccccacaaccctgtgagatagggctgccccactgcgtggctgaggctcagagagacccaaggttgcatggcaagaagaaatccagggctgctgcctttcaggctggggctcccctgcggggctgctgtctgggccaggcacccactctgtcttgctggacattaagagtcataaaggccacagagagaagtcagaagccggcctaagggatcgagatgagtttcatttttcccagcaaggctgctgccttcgaggccacacactgggctccagcaggctcaggtgctagagcagatcaggcaggtgtgagcgggtcctgggactgtgcagtggggtgaggggcacctgagatttgcagctgccgctggtagggtcttccttcctcccaccccaccttggcactgcctggatcgcaatgagaggttgtcaggaagactaaagaggggctgcaggaacctctgggttccctagggtgtcggggctccccaggtaggagcagaggctcctgtgggccccagctgcaagcagcctacacagctgctaaggccagtctcagcctccgccatacttgtcaccttaagacttgctcagtttaagtgacagaaacccctgctcatattggatgaaacaaacaagggacagcatggccccaattatctgggggtcctgaggagtgttggcttcaggcctggctgaatccaggggctcagagcatgctatccatttctcagccctgcctctcagtgttcatttcagaattgctctccacccctcaacccccggcccaccagcggctccaggcccaactcgttttccaaggaggcaacctttgagatggaaagccctcctctctgggtgacacctgtgagagttgggggagggattggaggcccatcttcaaacccatggctgtgatgcgggcctagcccaggtctcctgcccacctttgggactgagggggagggacagactcccaaactctggaatgaagaggggcctatcatacaagaagggaggagaattgtgcagggtggtgaacacggttgtggccacccttctcctggactccagaccccatgttgggcttagaagtcctcctgggctccaggcttgcctgctcggctgcctctggaacccccttccctggatgaccccatactcaagtcacgtggctctccccactctcctccagaccccacccttccaggatcgccctcccctagccagctccaattctagagctctctcagggcccggcttccctccacgcctggtgccaacccctgctttctgctcttgtaccccccactgccccatggtctctccccgacaacccttctccactctgcagccagagggatttttagaaaccatgcagcaactcatgtcacgccttcacttaagacctctcagtggttcttactgctcttaaaaacatccaaacccactggcctggcattcaaggcccccgtgacctggtcagggccctccagctccggcctgagtcgcctgctctgctggtctggaatgagactccgggagaaagggctgcaggaggcagaactccagcgttcccctcaggtgcccctgggagggtggggcaatgactccctcccctgctgccttacgtgagctgagggcccctacagagatgcctgagggatccagcagtgcagcgcagtccctctggaggcggcggccagcctcaggagggggtccggggagcagcatccacaccatctacctctgcctggggctttgaacccagtccctgcggttttcctgtgagccagccaccgtggccccatttcacaggtaggaaaccgaggctctaggagttacatatgcaggttctctgtgtgggctggcgtctctcctggaatcctttagggaggggcagagtggagccggctcccagcccctcatgaaggccggcatagtcagcactggtctcagccggagcccaccaaggccagctctccctgggagagctgcactccattgtgtggctgggtatgtttctggcactggtaaatgtgcgcggccatgtgctcattcaggtgtggcaggcttctcctgcccaatggctcgccgtggcttccctgtcccccatgtctccagtgcttagcgagtcatgcctgagtgaatgcaggccctcctgcagagtcagctgggaggtgaaggccaggtcctcacccaggcctgctgtgaggctcacaggggcctcacctgggtgagtgagtgaattcaggccctcgtgcagagtcagctgggaggtgaaggccaggtcctcacccaggcctgctgtgaggctcacaggggccacacctgggtgagtaagggaatcagccagggacatccgctcagcagcgaggctggctttgcctcgtggctgcctgagctatggtctgggcctgcccactgtggtatctgaagacccaaagaggcaagtgtgcatggcagccctcctgggaccctgggtctgtgctggcaggcagacatgtccttctttaccccacctgcctctctggcttgggcagccctgggggtccctgtgttgctgccggcacagcaggctggtggctgcatgtggacgtgtgcgtgtcctgggcctgtgcatggcgggagtgtgtgcatgtacgtgttgcctctgcatgtcttgcatgtaggagtacgtgcatgcagtgtgcgtgtgggggtgcatatgtttgtgcacgtctgaatgagtgtgtacacgtgtgtgcacatgagtgtgtctgcatgggagggtgtgcatttgagtgagcatgggccagcatgtgtttatgtatttctcgggaggggtttcctgcactctgtagaagaggggccttaagtggggttgaggtactcaggggagaggaggaccccagccccctcaatcttggcgccacgttagacacccccatcccctactggtggttaccccggaatgggaggatccaggtaggagctgcacactctgctgcgtatgtttcatattaaatatcagctgtccacagggtctgcggtgctgccattaatatggagaagttattaccgagcccggagctggctcctcgggcttgtccatgaatttcaattacactgcacgacgactccagggctgcagagtggggtgcacagcttccgctcagaggcacagggaaccctagtgtccaggaccaaggcctgggtgctgctgaagccaggcaggctctacgccatccccaccctgccttgtgcatttcacgggttaacccagggaaggcaggggcctattgtgggctggaggctgttgcgggtcacatggtccgctgtgctcctcgtgaccggcagggcggacaagcaccacgatcctgagaaccttagttcctccaatagcaaaagatgggttctgtccgcacgcacttcagtggcagtgaaagggtgggtgtgcagcaagcgcctaccccaggcccgggggtgagaaagcggtggccgtgtctgcatatcattagctctaaggtgccatcggttacaggacacaccattactttatacgccaccaagaaagaggagacactcccatttaaactgcaactctgtgccttgtggttccctggaggcgcgggccccactgccacagtgcttggtttctctgatgctgtctgcagcctaatgggtgggccatttctgctgcctggccgtcgcttgtcacggctcccgggaactgagttcggttggcttcgtccgcctccgggggtcttcctcttgtgaattacgaagtagcggtccttcctccagggataggtatttgcctcaccaatgcaaagctacatgcgcctttctgcgtgcaccctaactttttgacctcacagcgtgactcttcaaagacattttgagtgtccagggtgttgacagtgagggactgcgttggaagtgtcgtggcccaggaggcgggggccagggccggggcctgagacccgccgattgcatcctcagttcaggggttgggaaatggaaagatgcgtgttggagggaccagccctcaccagctctgtgcagaatgtccgggattcatctttaaacctgggtatttttcctttgaaagccctaatctgaaatttcaatgtattaaaagtatttccaagtgttaaagcctgtcatctttacacccgggtatttttcctttgaaaacccctaaacgacaaggtttggagagctttgggttggtgaacaggtgaggtgctgggagggtgagtgcccagagagggcgtggaggctctgcagcccttcccgttaccttgccctgcccatccctcccacgcggctgtttgaaagcagggattgggagcacatggaaagtagggtgtcttcacgtttcatgcaaggcttgtctaaggcttgctagtggccattctgattgggacagagcttctggacatatgatgaaaaggggcttgagagctgtgagcatattggtatgtatttacatctgtctattttatgggttatagtacaccatcgccagtcagttgcaaatgaaacctcaggttaagcagtaccgcagatacattctacttttccatctttctgttcttgtaccaatattaagctgtgtttattattagaactgtaaggctctaatagtcaaagtattaagtactttgaagctttgctgtccaatacagtagctataagccacacaaggctattgaagacttaaaatgtgtctggtctgaattgagaggtaccctgagtataaaatatacattggatttcagagacttcgtaccccccaaaaagaatgtggaatgtttaatagatcattttaaagtattgattacaggttgaaatggtaatattttgggcatactgggttaaataaaatatatttctgaaattaatttcacctgtgtcttttttttttaaaaacatggctacatataaagctcgagttctatttctgttggactgtgtggctttggaacatctggctggatacgtccccctttgctggtattctcttacaaaattttcttggctggtcacatatgtttattctttcaaatgaattttataattgttttgtcgggtagaaaaatccctcgtgaatttgattgatagtaaattaaacttagaaactaattaaaggaggaattgacataatttacagtattcatcaggaacatagtatattttttcagcttatttcattctgctttgatgttgtaccatgaagtattatatatacatatttttatacaggtcatccatttttaaaaatcaggattatttcaaggattttttttctttttgccattgctcattgaatactttccatctattggtacacaggaaggctactgatttttatagaactatcttttatcaagcagcttgattgaactcattaattctaatatatctttgtggagtcccttgggttttctaggtatacagttgcactctgtaaacactgataattttggatcctcatctccaatctgcaccgtctggaaccttcagagcgatgttaagtcacagccgtggctacacgcatcctcatctgtgcctggctttaacggcaacgcccccggtatttctctgcttaatacagcgcttgctgtggattaagatggatttcatgtgaaggcaatatcctctgaattctcgttttctaagatcccatttttatcagtaaaggagctgaaatcaagataaaatgtgtcttaactcttaacgctcccttctctcacctccaaaagccagaggtgttgcgattccggggtgtttgtgttctcagcctcggcctcagctgtccactttgctgggccaggaatgaaacccagtccccatttacgcaccatgggaagccctcgtagggaggggcagccttcctgcagaaggtgggggagccagcacctcccggccacgcgggtgacttctggaagaacaggaccctgttcttggaaagccctttgggccatgtgtgggggcatttccactttcatctgtgggttctttcttccctcccagtggcgtctccctccctctgtccagtttctctggagcaatccctccattctcctcctgtgtcttaacagcggactttgcccgctgctctgaggtggtggcactgtctgcagagtctcctgctcttccagtcccactgttatctgttatcccatgtgcttctagaaggtgtttttccaagcaaagacatttccctccttagaagaaatctgtaggcggggcacagtggctcacgcctgtgtaacttgaggaggctgaggcgggcagatcacttgaggtcaggtgtttgagaccagcctggccaatatggtgaaaccccatctccattaaaaatacaaaaattagctgggcatggtggcacacgcctgtagtcccagctacttgggaggctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgctgcttgcgctctgtcctccttgcgtcttcctccttcctgcttcctcctgccctcttcctccttcccgtcctctccctcccttccccctcctctccctccagcttctcctccccttccctcctctctcttcccccttcttttctcattcctctttttcccactcccctcccttctcttctccctcatctcccctttttcccttttctctccattctccctttatgtcctctcccctccctgccccttctgtcctctccctgttcccacctttctttcccagagtctttcatcagccaggactcctggggacccttcctggctgggggcccttcgtcgtcagctgcactctgcacctgtaccttcctggtacattctgggaaccaacaacgagccatcccaatgtgctgggaggaaatcagggcacagcgatggggatgacccaccccaggtcccacagagcccagagccagctcctttcactgcagctggagcaccagatgaaatctgtacctcctcagaggtacagataactccccacctgtacaagcagggtgaattgctgaaaaggggaattcatgtctcctctccttggcctgctactgagttcttggtgcattttctagcaaacaaggtcaaggctgagtccctgccctgccagagcatcctccacctcagatagggcggcttggcctttgggctgtctttcctgttggggtgcccaggctgtcacgggctgtgtcctcactggggagggtggcccgatgagcagggctgctgggaaggttgtgcaggtggtgtgctgggcaaggtggccaatgaggccagcctttgctccgtctgggagtgaatggagtggaggttggagggtgcccagcgctgggtggagatcacgggcactgggggaggggaaatgtgtgccaggtgtctgcctccacagtcaggttgccagagttgctgcgttcttctctttgcagagcttctgcattctcgggactagggacattaaaaaccaaagccggggcagttgcagggaggctgctggacattgcaggtggccctgattggggcagtctcagctgtggtgactacgctgtggcctttggggccagggatggctggtccaggactgggcatggtatggggtgggtagatgtaggccgtctctgtcttggtgtcagcctgtcctgatagactctgggggctcagagtcctcacagccttcccccaacctgcctgcaggtgcccacctggctccccaaggcctgcaggagtccgctggggctgggctggcctgggacccttggtgggagtcaggcaatcgtgttattgttgaaacttgtttcctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggcctgaaacttgtttctttaatggctggtggttacggcccccaactttcctcctctgaagctgattggttctccctggggctagtcattaaccctctgctagcttgggtgggtttatatttgcagagcttccttttttattctgccgggctggtgttttgtttcttcggtcagctctgtcagcctctctagttgctttcttctggttactcagcctgtagaaaagtatcagcctttcaaagaaatactccattatatgttttgcttttttcctgacttgatttttaaatatataactcctttaattcaagtgaaatgtgtttcttatactgtataaggtgttggttttaagtgttcatttttttctaaattgccatgctgttgtctcaacaccattcgtttgctaattcactctttcttcttgactttggaatgtatattccatcatctgtgaagttcatggaggatatggggtttatttctggcctttctgggttttgttttgtttttttttttttttttgagacggagtctcactctgttgcccaggctggagcgcagtggcactatctcggctcactgcaagctctgcctcctgggttcaagcgattctcctgcttcagcctcaagagtagctgggactacaggcgcccgccaccacacccggctaattttttgtatttttagtagagacggggtttcaccgtgttagccaggatggtctccatctcctgacctcgtgatccgccctccttggcctcccaaagtgctgggattgcaggcatgagccactgtgcctggccttttctgtttttcttttgcaccagtccaggggtctttaattgctgttggttgacaatatgttctgacatctgatagggcaagtatcaccatcgtgaggttttaaaaaaatgcctaaagtagtgtcccctttgcagaaggccctcagcaaatctttgctgaacaaatgaacgacatcttcatgatgtttaattttctcacggaaataagaagattgattcagatgtttaaaaacatagcccagtaggtttattactaagagacttagaatgttattgccattgtcaatagggtcttttccattatattttacaccagattgttatctgggaacacttttaatttataatacagtaggtgattatttactcagaatacctgggacctgcttctttcagactaatgatattctcagaatttagacatctttattcccagggagaaaacagagttaaaaatgacacattagtgcaaatcatacatgcatgtgcagagctgccacgaaccacttgatacccatggttgacctggcaagcccaagccccagcattgctgtcctcaaggcgcgcccttcctggcaacagcccctgcttcagatcctttgctcccaatgacctgcatcttcccatgtcttagcaaagcagtctctctgttactagaatggcacaaatatgaaccacagataatcacaaaaagtccttctgaaataaatctcttgccgggtgcggtggctcacgcctgcaatcccagcactttgggaggccgaggcgggtggatcacgaggtcaggaaatcgagaccatcctggctaacacggtgaaaccccgtctctactaaaaatacaaaaaattagccgggcgtggtggtgcgcgcctgtagtcccagctactcgggaggctgaggcaggagaatggcgtgaacccgggaggcggagcctgcagtgagctcagatcgcttgcaccactgcactccagcctgggcgacagagcgagactctgtctcaaaaaacaaaacaaaacaaacctaaatctctcgcttggatgtttcccatgtttgcgttcccagatatatgagtttctctatttattttgcatctagactttttatgaacttccttgttattatttggttcctttttttggatgtttttgggggtgaggattctctacgtgtgcagttactttctgcagttcataatattgtctcttctttttcaacatgttttcgttttatgtctttagtaattttgtgtgggagctacaaccatgccttcagagcatctagccccgcttctaagggaattgagaaccaggtgctgcttcttctgtgaatgctggtggtggtagacccaaagtggacaaaccttggcctgaatggatctcccaggcccatttccccacggtggcacggctttcctttccctgctctcttgcatcaagtagagcttcgaacgcaggatgtgcccatgttgtggttttatggggatgagtggcggcggttgaccttccctttcagtcaaggaggctctctcagtccctcgtggtctgttaggtgtcccctgtggttggggagcagtgcaccgggcatgcacagggttgtttgcaggctggcaggaaaactgcggtctttgaaagatgccctgagtttctacgggggatgtggttcagtgagacactttcaggagaaggctggcgagtagattcggtggtacaacctggagactctatgaatgtggactgaggagccctgttttgagtccctgccttacccttcacaatgagataattttctgcacttcagggttcccattgtgcagggcggagtttgcacactggtgggccacgggccatgtccacccacagatgagttttgtttggcttttccagtgtttgaaaatttctcacaaagctcaagatttccagtttctcttgagaaccaggaaatctgccgggcctatgtgctggagggctagagctgagcaaggatggaaccctctagaagggtcccacagttccaggtgccttgggagtctctgctgctccctatcattaccctggcgggcttcacgcgcattcactccctgtgtaggcacctgagagtttctcttattttgagatgagtgctgcatgggctttggaacggtcatttcttcctcccctctctctccctctccctctccctctccttcccatgacttcagtttttggccatcagcccctgcaaggtcccgtgcgctggagtcagacgcgatctcgctccaacacgtgggcttggttttctgctccctccctccctgggcgagcgagcctcctgtttctcatctgtgaaaggtaaaagctgatgacggtaactactctggtgggttatgatgaggattaaatgaagcgagggccagcactgagcagcgaagggcctgttactacaagatcatattttcctgatggcgctgctaggagggaccacagtgtgaaagcgcttggacacacggagccaggtgcagattttgtctcttttgagagctctgtgggcggggcttgggcgggcatgggagtggggggcggggccgggggcggggcacaggccggggtaggatgctctccctgccccaggcatcaccggcctgggatgtgttgccagtggaggccgttactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaagatgcggaaaagatttccagtctggaatgggagaagagtctcgtggcgggcaggccccaagaagggaaatggaggtcagtgtggcgaggggatgtgcaggacggagaggcagcctttgttgggggagcgctctgatcccttcctccgcacccctcagctgggaggacttggccgcctggccgttctcctttgggagtgaatccggagggtgtggcccagaggcggctggcctcgctcctgtcctcccatccacacctgtgcagctggtgcctgtgcccctgtccctcccacaggccatccccaggtccacactcctgtgactgcaagtgacagaaaaccggggcagaagcggctggggccaaagggggaatgcggggctcagggcggcagcccaggcctcccgcacggtttcagctcagccgccctccccgtgggtcctgcctgggcagtgcaccagccgcccggcagagagaggcccaggttccccgagggtttctgggagagcccagtggtgagttctcactggctcaggttgggtcacatgcttcaggcaaatcactatggccaggacagcggagcaggacttcggctggccaggcctcgtcacaggactgctgtggctccagggctggcgtctgtcctctgaccctctgggagtgggtcggggagaggatgggccccagaggaaagccaggctgatgtgtcaggaggagctatgggtccccattgccttctgtctccaggacatctgccctgtcttctccctgcccccgtttctcccactcccttccagctgcccatgataagcacgcggtctcccttccgtgccccacccgaaatgctccccatggctcctccactttgagggtaaagcacaggcccccagaaccagcattcaaggcccctcctgaccatcatcatttcctgcttgctctacccaccatgtccaccttcccgttcatcctgtgggcctgggacaggagctccgaaagatcacacacacccatcaactgtcaactctgcccacgttggaaacagtgcctgtggcaggtgcaggaggggaccatttgtcttggctgaagttgaatctgaaaatgacctaaggacttgaaggaaccagggcctagtgtgtgtcggggtgtgatcgggtggctgaagaagctgagactccttgggcctcatgggctttgcattagcagagcagacagtggggggtccctgaggacctctgggcttttgcctgaatgctgggaaccccataggcctggccaacttctcatcacccctcttccagcaaaccttcctgtcttctgtcctggtagttagcacagctgttccatgtcgtgaaccctcctgccagcctggtgaggcccatggacccctgatcaaaataatgtgtttagtgtacactacaaaatacaaaggaaataaatctgattgaaataaagctatcggccaggcatggtgcctcacgcctataatcccagcactttgggaggccaaggcaggaggatggcctgagctcaggagtttgagaccaccctgggcaacatggtgaaaccctgcctctactaaaatacaaggaactagccgggcgtggtggcgggcatctgtagttccaactattcaggaggctgaggcacgagaattgtttgaaccctggaggtggaggttgcagtgagctgagatcgcaccactgcactccagttggggctatagagtgagactctgtctcaaaaaaaaaaaaaaagagaaaaataaagctatcaacatacacatgcttttaaaatttttaatcattattataccttacacatttttgataataatgttattgagacataattcacatactatgtattttaccaacttataacgtaaaattcaatgaatggctttagtatgttcacagaatggtgcaaccatcaccacaattttagatcatgttcaagactctgaaaagaaaccccagaccctttagtaacccccaattaccccgtcctcccaggcctaggcaaccactgacctaccttctgcctgtatagatttgcctgttctgggcatttcattagtataaatgaatcacacaatatttgccctttgtgtctggcttctttcactcagcataatgttttcaaggttcatctaggttgcagcatgcatcagagcttcattactttggatggaaagatatgattccattgcatggatgtaccacagttttttaaatccactcatgggttgatggattgggttgtttccaccctttagctcttgtgaataatgctgccaggaacattcatgtaaaacttttttgtgtgcttttaattgatgcattaaataataagacctaggagtgcatcttacagcctctataatttaagttgtgctgagtgtaaacaccatttggtctggtctgcagcagcggtgctgacagttgccgaagcctgtgatttctgccctgatgggcgcaggtgctgttaagtctggggttgctgcctctctccagagttgaagggaatggcagctttcagttcccagttagtaaagatgaagttgaagtgttctcttttcccagtttatggagcccaggttaagaactctccagggagctcccacagggcagtgacaggacccaacggcccctggcaagtgctgtggcctgtggcaggaccaggtgtccagatcaagctggcggctgttctgcctgccctcagccatgctgacacctgccacgaagcctggtgtctgcttctttctcctccccgaagtattctctctgtccttagcttgggagtcctacagctggagggtggggggcccaggccctcctggactgctgcccctggggccccattgtctttccttctgccaggccatttcccttcgcagctatttagaagggaaggcagccaaaggcctgtcagaagggggaccacggatggattttccatcagatgtgcagacctgctccctgacactggctggctcggtgcctgcctctggagggcaccaggcctctgtcacttcctgtgcagcccctgccagccatgagacaggtgagggctccttggttttgtggagactgtcagtcttggctctggagtggcctcagtcctaggcagctcaagttctgcctcccgccagtcctgtctgcaggcaggatccagtcctcacgcacccatgctgggcacggccctgcttccacaccgtgctcaggaggagagcgtccactcccaggagaggccttgccaggcacctctccttagggacacctgcagttaggggtctggcgccagcttgtgtgtgagagatcaactccccctggtactgtcaggccccgagtgagggagccgcagcccagagaggcctctttctgtccagtttgcatcgccacatttgggtttctgtcccgcctggcctgggccccacctgcctgcggagctgccgaggccctcgtctagtgccctcccagaggggcctccagtcctggttcttatattacagaggcagccagaggcttccctgactctgtggctggcgcagccttgacaagtcatctggaattggctcacggcctcctcgcgtctcccggtgtctgatgtggcaatgaagctctatttcagggcctgcgggaggacccagcgtggctcagggtttgtcctcaagggagggcgtggatcagagcctgtagtgcggacctgggtgggggagggagaactggaccctgcactccctcctgtgtgaccatgggcgggttatttcacttctctgcactttcagagtctccaccttgagatggccccgtgaggactgattcaaagaaggcacgggccgtgggcgcatcctctgctcctctccccacctgcgctgggtcccatcagattttggcattcccagcaccggcagtcctggggtgactcacgatggctggcaactttttgtcctgtctttaagttaaaaactgtcgtatgtgccttcatataaaacagaatgcagaaataagccaaaaggagaaaatggaaatccctgcagtgccattagctttcaacatttttgtgtgtctcccacgtccatgcacatatgtgtaaacatacttaatgacaaaagggtcgtattgtaccttccctttgtgatctgcctctgcccatgccacacataatggaaatatttctggatcatccagtgttctgccggaacatctttcaatagaggcagcataatctactcaggaaacatggagaggccgggatctccaggcacttgggtctgtgggcctgggggctgagggagaggctgaggaaaagcactccccagcttttgacttgcacagatgggtggtagagaggaagggtagcttggagagagggtttgtcactggggctgtctcttggaaggagtctggcagctggaaatgcaggtcctaggtgcaggggcaaggtctgggtagaattcgggttgggagcgctctgtatggagggctgtggattccacatcctggggtgggtgggcgggcaccaaaggaagagggaggcagaaggggaaggaagtgctccttggccccccaccatgtgcagacaagtggaggaggcagtggggtcttaggagcggggctgcccacctgctaaaggatgagagaggttcaagaggagggggttcagggaattgggatggcagggggcatcaggcccagcagccaagagggggctttgcagggtcgctggggagttggtggaagctagactgaccaggtgaggggccagtgagaggcaagggagtggagggaagctggtgcgcatggcacacatgctgcggtggggcagacatcagctgcggagggtgtgcagtcttagatgtgagtgcagtgtttacgtgtgcgcttgtgtagatgtgtgtgtggccctgcctcgagcacagaggattttaggtggcttgagtttgctcagggaccgaggatgaggatccgggagatggagagtttgaagctatagaagagagagtgtattagtcaggtgttattcctcaagtgttggaaatccaagtaaaagtggcttcagaaaaaagaaaaaaaaacttattggttaatctgcaaaaagaaaaatatctagaactatctagcttcaggtgtggctggatccaggtgcccaaataaattttcagttgttttttttcccacatccccaacccttggctttgctctcctctatgtcgatttcactctcaggcctgctcttctctgaggcagaaaaatggatgcaggcagctgctgcattacctcctcacagggcaacaacccgggggaaacagcttttcctttccaacaattccagcaatagttcctggatttaacttcatggaataccttgtggcaagtcctcatccctgagctatgttcatgtagtcagatgacaacgtattctacctggcctaggctgggtcatgtgccctccttgcccactggtgacgcagggatgagagctggttcctgagtgacacaggggctgtgctatcagaaggagaagggtgggccaggaacagtggctcatgcctgtaatcccagcactttgggaggctgaggtggacggatcacaaggtcaggagattgagaccatcctggctaaaatggtgaaacctcgtctctactaaaaatacaaaaaaaaaaaaaaaaattagccaggcgtagtggtggacacctgtagtctcagctactcaggaggctgaggcaggaaaatggtgtgaacccaggaggtggagctcgcagtgagtcaagatcgtgccactgcactccagcctgagtgacagagcgagactccgtctcaaaaaaaacccaaaaaaatggaggagggtggactccaggcaggcttagggttcccaaggaagtggctggggccaggattgggagacctggaaggctggaggagggagctgctgcccaggagcacagcaggagagagaaggacacgaggcagacatggagcgggagggaatttcctccgtggcctcccttccctcaccaggcagggcagggacagtgaggctgctgaccagcctctacagctctcctgggagtcggctggctctgcaaggcaaacagaaggctggggaggttgactgatcaccggctgctccgggagccgtcaggctgggcagcaggagtggcctgaatgcagagaagcaagccttgagatcaggcagggcagtcttcctacattaggagtctgggaccaggcattctgtgggccaggccggagatgtggcaggctgggtgtgaacgtgctgaccagtggggacctgggtttgggtgctggggagccaggcgtaatgactgcgggggctggtgaaggctgagtccagtctgcacgcatgcttcctgtggtttctgggtgaaaagagggtcacagctttttgcctcaacagaggggagaggcttctattctactggttgagtgtggatggggagggctgggaggggtaggatgaggtggtagagacatacaataagcaaaaggccaaataaacaccttctcaggtagtggcaggaactgggaaagtaagcaagcaggcagtgaggctgggagcagcaggagggtgtgagtgagtgcatgtgtgtggctgatgtgtgagcacgtcagtgatgcatgtgtgcaaatgtgaggcatgtgtgagtgcatgagtgtcatgcatgtgtgcacatgtgcgggcgtgtgcatgtataatgcatgtgcttgatgcatgcatgtgtgcactgcatgcctgtacatatgatacctgcatatgatacacatgtatgaccgatgcacatgtgtatgtgtgggtaatgtctgccatgcacatgcatggggcatttttctggtgcatgtgtgtacttgtgtgtagtgcacatgtgtggacatgtgtatgtgatgcatgtgtcacaggagatgcacatatgagtgatgtgtgtgtgcatgcgtctgcatggtgcctgtgtgacgcctgcgtgtgagtgcacacgtggtgcatgtgatgcgtatggacatttgtatgtgggtgcatgcatgctgcatgtgggagtgcatgagtgcacatgcatgtgtgtgggggcctgtgtgttgagggaatagctgttgggaaccctcagtcataacagggctgtgtgaaatcttcagctggaggaagacaggagagaaatagcgtgcagctgtgttcctaatggcacacacgccccttgcccagagtgcatggtggaagagggctttctggcccagggaccagctctctttgtggcccaggcctgctgcttttgggctggggtctgaccttcctggaagacccttcggggccccgcctctcagaggccaggccccaacgtctcaacgctcaaacagcgacatcagtgtttcccccaggggagtcatcctggggaggctcagctccatcctgagccgagggggccttggcattgccccacctgccctggtctgagaaggagctgtcctctgcctctctgtggtctcatggggacaaatgccagccactggacagtggcccttgtcgtcttctaactgtcaagattccaaaaagacggaggcgaggggtgtgcgggagcaccctctgcgtgtgcttggcttcttccccaccagccttcttgtgagagggctagaagcagctgtcccactttgcagtgggccctgtccctcctggcagggcagctgtggccgtccctggctgtccccgccccgcccggcatctccttctctccccatcccctgtctagctggccccgcctctcctccctgtcttgctttagtctcatgcctttttaatgagggctcagcctcctgtgtgctgaggctcagcggcagcgcatttaattaatactctcgcatcgcagttcttcagagtaaatgctgccattttattcctcactaattggaaggggctagttaagctctgagataaatgaccctttctgctgggagtgtctcagctcagagtctccatgagagtggctggagccttggatgggaagggcaggagggctggcctgctgtgttcctcctggtccaaggggggcctctttgctaatggccagggtagagacgtggccagggtgaagcctgcctgacctttggggaggacgtgcaggtggaggctctgctgaccagcagggcttcagattcatcactgcccgttcctcatgtcccggctccaccccagccctggatgagccccagggaccccagggaaccttcagtctgggtttccagaacctttccctggcccagtctacacctgcctccctccctcactgtggaccagccccacctctaccctccatcctgtacgtctgctccactctccccaactggcgatgagtctggccagggagtctcagctggtgctggcacgctaacctcccctagacgcgtgctgaaatgtacacgtgtgtgtgtgggtgatgtatgcgatgcacatgtgggggcgtttgtgtggggcatgtgtccctcagcacacatatgctctgtgcccgctggccatccgggggacatagattacaccaacactgcagtgctgctggccacccatggtctgggcagcaggaagaggtgcaggagtccccacacagtgtcgctgggatggcctctgggtccgtgcttatagaagtctcatgagtgcaccctccgcccacctgctcgcatctctctccctccacgaggaactgtgctgtggcctcctgggtcttcaagctcctttcctgttgtgttggtgacaggaatcggggtcagaagggcagcgtccgagcaggcttggatgagatgtgtgatattgtgttaccatatcagcgactctgctagctgagtccatcttcagggacaaggatagctgtagccagacctacgcatggatttatgaggaactaccaagaaaccactgggaggaaagacgccaaagtgctgaggaaaaggatgctcagaggtggccctgctgccagctggcagagtgacaggagggctggaggctgtggggacccaggccacgtggggttggggctctgggctttgtccttgtgttcctgtaattgtctgttgctgagaattagctggaatttctttctttccttcttttgttctttccctatcctttccttcctttcctctcttctttccatcctttctcaccactgtgtattctttttaaaaaattaaatatatttcctttttttgagacagggtcttgctctctcccgggctagaaggcagtggtgcaatcgtagctccctgcaaccttgacctcctggttcatgggatcctcctgcctcagcctccaaagtagctgaaagtacaggtgtgcaccaccatgcctggctaattttttaaatttattttttgtagagatggggtctcactatgttgcccaggctgatcttgaacttctggacttaagcggttcttggcctcccaaagtgctggaattataggtgtacaccactgcgtcccgtccccacttcatgttcgacagcagttctccgtgcctgctctgccctgggccttgctggactggggttgaagaggcagccttctgttctcttggagctcacaggttcctggagggacacagcaggaaggtctcaaatgccatccctgggagtggggagggtgttctgtggggctggggagccctagggggcctaggcaggagcctgggatgcccacatgcaatgaccccctgagctgtggccgactccccagccctgctcctgagggccctgctgctctcagcatctcccagggtgtcacccttctgggttgctagatctctgctgctctggtgtggcctctgtccctgccgacccctctgagggacacagctgtcctctgctgcggtggctctggcctcggaatggggcagcctcttccctccaggcaagagcctttgaattctttgccagcaggacttcctgggctcttgtctcccgtctgctgcccggtgcccacgccccagtctgggacttggatgtctgcctgctgcctccctgtttacactgatctgatctgctctttccctctgggagcttttgaactttctctttgtctttgatgttcttaggtttcattatcgtgggtctagctatggagctttttcttatatatgtattgataaggcctctaggaacccatccatgctggaatctttcatgtaattttgttttttgaaatattccttctctcacctccccgactctcttctgggacttgcccacgtctcgcagcttttctccctgccctctgtctcttgctcctttcttagcacacagcgagagctctgtccagatcccccagttctgcggtggctgtggctgttcagttcctctgttctgctcttcggtgcagccaccaagccctctctccagtggcgtttgtgctcagcagctcctgggggcggccagttcctgtggccatctggggctgtgctttgtctctggaaggatcgttgtttcagttttcctctgcgtgccatgggcggtcctgggtacggcctctctagaacatagtacctgcgccactcagatcccagctcgtgtccccggaggtggagactgtggctggtggtgctaggagggctcatgccagcttctagctctggcttctcctcgtgagcgggacaagggagatgggaggaaagtccccagagatggcttccctcccacccaagctctgtttcctgacctgggatcctggctcccaatggtgggaaacaaaccccctttggggacacccccacttcactggcaggagtgcagtcagccctgggatcccgacatgaccttcccaaagcactgtggcctcagtgctttccagaagccaactgtggcctcagtgctttccagaagccaactgtggcctcagtgctttccagaagccaagggtatttaatcttgtccatggcgacgtggacgcgtgtcttgggaggagccctctggggtggggcagaggctgtgttaggtgggagggtctgaggcagggacccaggaggaacagaagagagagagtgagtgaggcctgctccatgcaggggcagggggaggaggaggccggggtggggccttggggattgtggggggggtgggtgtaggaatccagtaccacttccaggttccttccaggcttgaataactgggagaagggggcgtagctggctgtgattaggctctgggaggggagtcgcttaatgtcaggaaagagagttacttctaggtaggccctgggcttgaggctcccgggccatgctaagggacattcctatgtcccttgcagctcttggttgggcctggcacaaaaaagtgtgtgcccaagactcctgtctgtaggtggaggtctgctggagtagaggttgggggcactggcgggggacaggagccccacctgggtgcaggaaggctacaagggcttggtggaagagcgtggaagcccccagaatcaggggcttgtaattctggcccgtcaccctgtgggacaagcacatgggcctctgcatgctgtctcacctcatctgtaaaagggagacagtccagtgaggatgtgggcccgtgagagagagacacggcccggggggctgcagaggcaggagcgctgtgggtgggagggctgcttcctgggctctgagtacagcacggtgcatttactactcttgtctcaaaaagcagggaaaactgagtattccggccacgccacgccacgccacggggtggggaggagcctggccttgccgctccctgcactctcctctgcgctcacttagctcagagctggcggccgcccagctcccagtgagacgtggcagccaggaggctgaggcccagccaagccccagatggctggcgagaggtgcttcccccgagctgagcaagacaaggacagggccgacccggtgggaggggcaggatgggaccaggagcccgggaaatgccagtcctggccctggccctggccggtctgtgtgctcccaggctgcgcccaatccgaagcctccgtgtggatgcagagcctgaagctggaggtctgggcataggcaggggtgtggggtgtgtgaggaacccccccgccccaccatcaggttctgcctgggaactcctggtcctggagctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcatgagtgtgaatgcgtgtgcgtcccctctgctgacacccctgctctggccaggccctcctctgtctcggtgtgatgtgtgtgtgcatgagtgtgaatgcgtgtgcgtcccctctgctgacacccctgctctggccaggccctcctctgtctcggtgtgtgtgtgtgcatgagtgtgaatgcgtgtgcgtcccctcttcacaggccactcctgaggagggagccccggtaaggctttaggctgctggctggttctggggttgccatgaagtcctgaaatgctattctattgctgtttcttgatgtatcgggtttcgatgttgtccattgacttcctgccctggaagaggagggtttagctcactgacaacactgctgcccctcccagccccattcttctaccataattctctcaccacttttagtccatatcagagttccccattgtattggtttctgaggctgcctgcaaattactacaagcttgctggtttgaaacattagaattgtatcctctcacggttctggaggctgaaatcagtttcaacagggcaaaacgcaggtggcggcagggccgcgctccctccggagcctctaggggaggatgcgtcctgggctcttccaggtcctcgtggcagccagcagtgcttggcttgtggcctcttcgctctgggcttcagggccgacatcctccatctccctctgctctgcctgtacgtggccttctcctctgcctggctcatcttgctctgccttcctctgataaagagaagtgtgattgcatttagggcctgtcttagtccatgcaggctgctatagccaaataccataaacggagcggcttaaaagcatcggaagcttatttctcacggttctggaagctgtgcatatggttgtggtgagggtctgctccctggttcaagaaggcatcttgttgcatcctcacatgctgaaagggtgagggagctctctggggtccctctgatcggggcacaaatcccattcgtgtggatggaatctggtgacataatcacctcccaaaggccccacttcctaatatatcaccttgggggagtagctttcaacatcggaatttggggggaatataaacattctgtctatccctgggcccacccggaaaatccagcagtcactccatctcaggatccttggactcaccgcatctacaaagttcttttttgccatggaaggtaacatttatgggttccagggattgggacccggacgtgtcttcgggggccatttttcagctgaccactgccatggtcgtctgactgttatatttgcacctctgcagcttctaacattagcctggggcagagggtctagagtatgcccttagcggcacagggttcccatgccccttctccctcctccccactgctgtcatttctaccttcccttcagcaaggcagagtgttgttaaatgaaaaatgattcaatgatacttattaaagcgcggtaaggcggactttattcaggaccatggagatagacacaggaaccgctagagtgggctcttgcagtcggggagagagactgggctcaactccgaatacagcacgggcgagtggggggtgatagccaaggagcagggtaggggccaggggatggggaattactaagagcaacatcaggggtcggggattctagctaaactcacctaacatgattctagctgaagacaggctggggtgaccagacatcaccagaggggtgatggggaggacgagcctgaccagatatcaagggtgatcagatatggagagatggggcattcgtgacttagcagagttcttgataaactggatcttacaaggaagtgggcgaaggagaaggttcaggagctggactaaagtttggtcaagcaggagagtccctgtcagtgtccactgttcaggtcctttgttgtcattgaggctttgctggcaggtggatgtccctgtgattcttggcatgctgctcaccactgtctgaccctggcccattgctgtgcctctgagccaggcggcgcctgcccatgggctagagagagcagagtggaggggcatgaccctgcacaggacagagctggacgaggcccttccagagaagtggccagccagaggccagctccacctgggccaggagcgccaggccctgggggagagggatggggacgtggccttcctgttcagagggcgggggaggctcggcctcagagtgaacatctgctgaacatacgcatcctccccttatataatgctgtctggaaaaatggtttcctgttgttgttgagataggagtcaacgggccctgcactcggtgggttggggggtggggggctggggagtggagagggtggtctttggctccaacctggggtggaaaggggcggaggtccagaggacccagccggcaagtgggttggggcaggcaggggcaggtggggttgggcaccctgctgagctgctgtcctgggccatgcctccctgacccctgcagtttggccatggtctggggtggtggccctttcactgtccccaggaggactaaggccctgatgcctctgcgtccccagggcagggcagtagggcctctacacccacctttgagggaccctgggagggtctagagcagtgtgtcccagacttcaatgtcatcagaccacctgggaacttgccaaaatgcaggttttagttcagctggtctggatggggcctggattcagcatctctaacaagctcccgggggcccccaggctgctccaggccacattttgcatagccaggctctgcaccaccatccctcaccccagccgggattctagcaccggtgggtggcccagagacgccaatcagattcttctgtggacttgaacctctccttgttcctggaaatcctgagatatttaatgaccaggggagccctctggggctctctaggccatactgtaccctgcaaggcagcctatgggggggcttcggaaaggcttgtagatgcctcctgatcctccagcttggagctggggggctgagcccccaaagacaacaagaccagttctctgtctttcttcactgtgtttctgccttgtggtatgagcaaggcatgcctagatccctgcccgctgggagctgcagcctggtgggggaggagggccgtccacaggcccccacagcagacagcagagcatctcagcgcctgagcgctgtggggacatgggacgtgcagggagccctgggcaggcgtagtccggggtggtctctcctggagggtcctgggtgacaggaaggagcagtcaaggcatcaacctgggcagatccacaggacattcaggggcacccttgtctgtccccagggccgcaggctactcccaaggcctccctgacttgaaccccagaagccagagggcaggggtggggcagggaggacaggagggacatgcagtgggggcctgctgggtccagggtcctgccctgccctgaggcaaacccagggtgttttgccctcagagctcctcccctatgcattttaaatagaagaaactgaggcacggagaggtgacccacccggtcaagtggcagggccagagcctttttttttttttttttttttttttttggagactgagtcttgctgtgttgcccaggctggagtacaatggcatgatctcggctcactgcaactccgcctcccaggttcaagcgattctcctgccttagcctcctgagtagctggggttaccggtgcgtgccaccatgcgtggctattttttttgtatttttagtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttggggggacatcctgtgacctgggtcccgaagaggtggcctttctccagctctatccaccaatggccccaggcctgtggccactgaaggcagaagcagtgggactgggtctgccccagtgggtgcctggctgaagtctccctgcacaacccttgggaggcatgctggctcctaactggcctctacccggggaacacagagttttcaactgaattggtgtttgcgcctctctgctgagctggcccatctctccatgtagcttcctgtggatggcgcagctgcagaactccagtccacagtcaggaggcacggggctgccagggcagcggaagagacccaagggcaggaacgcccgcctcagccctcttcgtatctttccctggacccagggcctcaccatggcctggcctgtcctcctagaagaatggctgaatgaatgggcagctgagggggatgctaaaggcagggaacagtaccccgagggcttcagtggctgtctggctcccagctggcctagctgcatcccagggcccctggggtgggaaggaagaggaggcagaggggccaggaacctgcaggagggtggggttccatggcagcccgcgccctgcttccactcaggacgccagccagattcatctgctgggacaccaccttaggaaggaggcacttctctgagaggccttgggaatttcccccaatccacatacacatgggcatcatgttgggagaaactgttttgcaaatacaattaaaaaggatcctcccaaagttttgcctagaaaaaaaaaatgaggctgtctattatgggggcctgcaggcatggtcatcgcattgcaggagctcctgtgggctctggtgcccctgcacccttgctcgtgaacagtggcggctgcccgttcctgtcctcagcctgcccaggggctgcgcggctccccttccagctggcgtgcgtgacctttccagctggcatttcgagtgctctctctgggcaccgctgagctccacggatccccaaggcggtcatttgtcagatggtcctggtgactcccgacatcccatcagcgtctcctgctgctaagacaattgtgtcagacaactctcagcgcctgtcttcccacctccaccgagcagcctgaatgctttactaactggggagaaatcagagcaccggatcctccacttaaacccctgttttctccttgttgtcgctccagaaggcggcaaacttggcccactctgcaccacagggaccttggcaaggaaaccttacaccatcctgaagtaggggaagggagcctcgggagggccggcgacctcccgtactcaactccatgcctgtgagatgccaggcactggtctggtgacgtggacccagcaaggacaactttgctctcgtaagatccctggtcagggggcagagagtgacccaataaagaacccacgtgtcgatgattgggaaatggtgttacaaaaaaataggacaggatggcagtgtggagtgtgatggagaagggacacccttcaccaaggtccttgtgaggaggcatcggagctaggacctggacttctggaagaaggccattccaggtggaggcagcagcaggtgcaaaggccctgaggcaggtgctgagttgaagtgtgccaaggacacagaggagatctccacggctggcacttgagtgaaggagaaatcagcggggaccggggcagtcatgtggtgggaagccgctggagggctttgggcaggcagtgacaggtctgagtcgtgtttcagagattctgtggggcagccgtgaggagcatagagaatgaggtcacaggcttgggacgcccgggctcccagcctggcatacgtgatggtgctattagtggatggtgcagcatgacccgggaagcccctgcgtggtggtgccccccggaccgggctgttgaatgctcatgggcagagctgcttctgtgtcatggagctgtcctggagtgctgagcagtggccacccagggttggccgggtgctcgagccctgagagggccggtggacctcctgtgggccccaggtcttgccgtccctgaaggctgaggcttgcagggtgcgatgctctcacagcactgctggggcagatggcggagcacagcagggcaggggcgcgtgggccggggcagctctgcagtgcgggccccctgtgtctgtctcatgctagcagggcgagggtctgggccgggcttaggctggctggccactgacttccccgagagattcttcttactcggctgcccctctactacgtgctggcctcacctccaaggactcaggcccagggttgatcctgccagggccacaacagatgtgggactggccctggtggccaattccccacccagcagaagactgccctgccctctcatccctcaggctgtgctcctgtcaggcctggtcctggaataagagccatgtcctcagagcctgtgggagcacttggtgctatgagactcgatctcatggagttgcttccttcctgggtgtcctttccctggttgagttcatctgcctggctctctgctggcaccgggcttggcactggagatcaaagcttcatgaggctggagcaggagggcccccgcttcccctaggctttaggggccagtcacccttcctggacatccaccttccccaggaacacgggttttggggaagctctctggggccctttcctgccctggcctgagggtctgtgctgggtgctgggtgtgtacagaggtgctgtctaggactcaacccaaggttgagtaggagtcgtgaaaatgctccttattttaggggaaaacagtttctcaggatgcggtattgtgttagctttagtttttttgtagatattcttaccaggttgagcacgtttctttctctgttagttgagagtttttaatttttagtcatgaatgaatcatatcatatggttttctctatcacttgatataagcatattttttttccttcttcagtctgttaatatgctgggttacactgacttttggatattgtgccagactctgcaaatccaggacaaacatgacttgtctgttgtgcactctgctgtttatacatggctggactagacttgccagtgttttgctgaggatttttgtgtctatgttcattgagggatattggtttataggttcatgagggatattggtttgtagggtttttttttttattgaactgtctttgtctggttttaatatcagggtaatgttgacctcataaaatgaatgggagaattggtgccattttttcctgagaggttagtagaattttccagtaaaaccgtctagacctggaaatttcttttttgcaggattttaaactatgaattctttttctttaatagttacagaactttttatgctatctactttgtcttgggtaagttttggtagcttatagtttttgaggaaatcatgcatttcttcaacactgatggatttatatgcatagaattgtttatactattccattatcttttttatggctgtgatgtcattagtgatatcctttttaaaaatattctgatactggtaattcatatttttttctgtttctcttcttcagtctcactagagatttatcagttgactgatctttacaaagaaccaaatttggtttcattgatcttctctattattttcatattttcagtttcattgatttttactcttatcatttcctcccttctacttgctttgggcttattttgctttttctatttgagcatgttttggtattcaattttaatttacctattgtgtttggttgtatatctttgtatagtgtttactggttgctccagggattataataaacctatgtaactcttcagagtctttttcaaatcaatattttaccacttcaagttgaatgttgagaccctgccatcatataggtccctctgtcctcccctgaatgttgttgtcttttatacacctacatacatggaaaactacatcagacagcattatcattcctctttaaaatacgcaagagcctaatctgttatattttttcaggtatttctgttgctcttcctttattcctgatgttcaaaatttctttctagcatcattttccccctgtctgaagaacttccttcagcaaccatcttagggtagatctgctggccacacattctataagttttgcttcatctgagaatgtctttatttctccttaattcttgaagtgtatttttgctggagatagaattctgggttgacagttctttttttttttttttcagcattttaacaatgttttgcacttcctttggacttcacagttttgataagaaatctgcagttatctgaaccatttttcccctataagtaatgcactgtttttctttgactgctttcaagacttttttttgtctatagttttcagagtgtgtttataacgtgtgggattgtgtttccttggatttctctcatttgaggtttgccgatctgttgaattggtaggtttatgcatttcacagaatttgagaagttttcagccattatttatccaaatatttgtttagtaatacattctttctcttctccttctgggacatgactgttagttagatctttcggtattttcccacagtctctaaggctcttggcattataaaatatttttactcgctgcagtttgaattgggtaacttctattgctctatcctcaagttcactgactcattcctctgtcatatccattctgctcttgagcctatccagtgagttcttaaagtttctgttattgtatttttcagttctaaaatttccgtttggtcctttttaaaaatatgtcttccgtttcttgctgagactatctttccattagttgccagagtttttgcccttactttatggagtatttttataatagctgctttaagatcattgtcagttaattccaacatatgtgctatctcagtcttgttatctgttggttgtatttgcctggaggagttgagattttcctggttcttggtatgccaagtaattttggactgtatcctggacactttgatattaccctatgagactttggatcttgtttaaatgctatggagaaggtcattatttttgtttgatcaggtaattaacccttgggttaattgggttccggctgcaagttccaatgtgcctgtggattgcggttcaatgtcaggtccattttcaaagcctgtgcagtcctattctgatcaatcccatgtaaacacaacccagtggcacgtctgggacctgggcattggtccacctcctaagtcagtccccagaacctatggcgtgttgtttagggtcagacccactcgtgcacggctcaagcacgagcccaggagtttctaaccaactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacgaagaaaagaaaaaggaaataggaaagaaaaatgaggtgttggcttggctctgagcattcggaaatgctttttctatccttgagctacaacaacagggcttgtctcgagctctgtctgtctgtacccagtgcccgcttctggagtttgacctgccttgtatctaggctgaggaataccagagaatgaagagtaaactctgcgggtttgctgaacctcacattctagtcttcttccccaatctgcatgctgttatttattttgcagggtcctcagctagctgctcatgaatccagtgcatttgggtggctgcaggcagtgggggatgcaggtgaggcgtgctcacaccatcctactggaacctgaaccttctcctagggacctctctatgtgttgagcggtttataatcagggagggacttctaccagcagaaatacagccataggcagatccctgctgaacaggaatttcatagagagagggagggagatcctgcccccagcaattctcacaacatgcccagagcaactgacaggggaatcaggtctcttccaccctccaggggctgcccactgcacagaggagaaaatccaatctcctccccacagcagaggaagctctgtgcagtctgcccccgcccaccactctgacctcctgtaccccacccaggcccaccactctgccctcctgtaccccacccaggcccaccactctgccctcctgtccctcgcccccgcccaccctttgctctccacactccactcacattggccttcttccctttcctcaaacatggcaggtctgttctgacctcgggtcctctgcatgtgctgttctctgtgctggagcccacttccccagatctctccatcgctgcctctttccaatcatttaggcctcagctccagtgtcatctcttccaggaagtcccccgcccccctcaacaatactctgtgctgttgtcctcacggctgcgtcactctctgtcgacttcctctttgcttgcttactgccatttgcccccccgggagatagcacccagggtctgcattcagccacaggtcgcaaatgtgaatgcacctttgtggccacatctatcggtgctgctggcaaggtggaggttgggaagccggacccactgggccacaagtcctcagggctccttcctggtccagaggacccccaggaggaggcagctctgcctccgcagagaatcttgctgcagtttgggttgtccggggccttatcactcccccgcttttttttttttttttttttttttttttgagacggtcttgctctgtcgcccagagcagctgggactacaggcgccccccaccacgcccggctaatgttttatatttttttagtagagacggggtttcactgtgttagccaggatggtctccatctcctgacctcatgatccgcccacctcagcctcccaaaatgctgggattacaggcatgagccaccgcacccggccatcacccccgtctattttcatacatgcagtggggtgagaggcagaagtcccggcttctgctcctgtgtggcttcctactcactctacactccccttcctgacgctggccagaggctggcggaagggctgtgctgggccaggactggcttgcagttcctctgcagggagtcccggagcctggggcctgagggctgccttggaagggcacccaggggcgaggtgtgcaggctgactgttcccaagcagctgggggcctgccctcgctcctctcccgggcacagcacgctgtgagcggggcatcccgcacgccctgctgccaccggctctccggctgcactccttcttcacacactggatgagaggacactgctggggcagcagggcacatggtgcaggggtcctgccctcatttgtgtcttttcccagaggatgggttgtctccaagttctgcgtcaaaactgaagttcagcatacttaagcccagtggttcacaaaggagatgcttgaaacccacttctctcccccagttactcaggtgctgcccagtggagagagatctgtgcacacagccttgtctccctgcggcatctgggcgccacagggcagccctcaagagatgcccctgtcccagtgcggggctggggaggagcccagccctgtgcgagcagatccggatccaccactcattagctgtctaatcctgaaagagtcatgtcatctcttggagcctgtttcccaatctgtaaaatgggcataatgatactgagctcacttcctttgccttcattatcttattttcaatcccttgacaactctgtaaagtaggtaatattgtgccattttagacacggaaaagcagaggtcgaaagaggccaaatagccacaagtgacagagtggggatttaagtctaaagatctcaagtttcggctgggctcaattctttccttcagcccaggatgttcagggatgacagccaggctgggcccctgagcaatgccctctgctgtctttttttttttttttttcctgggggacaggagcgagcagagcctccagaacctttgcccagatcacagtaggcggttcttgcagctgggaccagttcctcccacttggacagagtgaggagtccaggcttcactgaggccaggagggggctggccgccggctccagactggggaagcctgtgtttggggcttgtgctcagtgtgtggggacatcctccggcctctgtcctgcgggacctctccgacttttaattggctttcttctggctccgcgtagatgaagagtttttgccagagccagagccataacggtttatctgtctgctggcttgcgtttctcagactgttactgaattaagttgtatgtatgaagactcttaaataaaataatatcatcgtgtttattcggagcttggccttaaagtgcacttttgagtgtgcacatcattcttcttaaaccagggcctcctttataaggggatttatcttcactttgagaaacgtctgctaaagcctgctgtgccaaagtcctcatgcttactgctagagccacagaagtgaaggggggtctggcttgtcctcaggcagctcaaagtcagggggacggggacaaaagaccagccaaaaagtgttgcaaagacatcaatgggtgctataagaggatgctattcttttgtttctttagttttccattgtttacaattaaacattattcacaacaactgacaaaacatgattcacaataatttacattattcacaattaaaaattacttttgaacatacaaaacatatggtcattatcattgaataatgtagaaaagtattaaggagaaagcaaaaaccatgaaatcctacccttttgagatagtctctgtgagagacagaataatccttctcccaaagttgtccatgtcccagtcccgagaacctgggaataaatcaggtgacatagcaggggcagtgaaggttacagatggaagtcaggttgctaattagttgacttttaagataaggagattatcctggatggcacagtgtaatggcaaggattcttctttttttttttttttttttttgagacggagtctcactctgtcgcccaggctggagtgcagtggcataatctcaggctcactgcaagctccacctcctgggtccaagtgattctcctgcctcagcctccagagtagctgggactacaggcgcctgccaccacgcctggctaattttttgtatttttagtagagacggggtttcactgtgttagccaggatggtctccatctcctgaccttgtgatccgcccgcctcagcctcccaaagtgctgggattacaggtgtgagctggccatgacaaggattcataaaagtagaagatggaggcagaagttcagagtcagagaggggtcagtagatgctccggtgctggctttgaagatggaggagggggccacaagccaaggaatgtgggtagcctctaaaagctggaaaaaaacaaggaaacattctccttagagcttccagaaggaatgcagccctccccacaccttgattttagcccagtgagacccattgtggacttcagatctctagaactgtcagataataaatgtgtgtgtgtgtgtgtgtgtgtgtgtgtgtgtgtgtgtgtttgagttggagtcttgatctgttgcccaggctggagtgctgtggtgtgatcttggctcactgcaagctccgcctcctgggttcacaccattctcctgcctcagcctcccaagtagctgggactacaggtgcccgccaccacgcctggctaattttttgtatttttagtagagatggggtttcaccgtgttggccaggatggtctccatctcctgacctcgtgattcacccaccttggcctcccaaagtgctgggattacaggcgtgagccaccgcgcctggacaaatttgtgtttttaagccactacatttgcagtaatttgttacagctatacaaactaaccgtttttccatcttgttacatatatgtcacactcagaagtgagatcttgtcactcatgctatttgtatcaacatctttaggtttatggttgctctctcttctgccctcttgactggagcactggcttcatttattttcactctggtctataattaagaaggttgtgaacttgcttctggtggtggctttggtctcatccacaggttctgatgtgctgaattctcactgtcatcattttaaaaagatttatgattttgattccagtaacttaagagctatttagaggaatgttgaaaaaacttccgagtggttggattttaggttattaagctttgcgttgattcctagtataatccaaatgttttcagaccttagcatctctgggtttaaattgggtcttgtcagcatttatatctgcatcttgccattccagtgacaccccacccctaaccagcgcagatctcagtttcctacaagggcttgtgaatgcctccccctcaacccctctagcatttctaggcatctcccagttccgtagagcccgtccacacccctcctgccacgtgtgtattctgagcatcccaggctctgcaggtgtccctccgttcaggctgccataacaaaatatcacagactgggtgtttagaaacaacagaaatttatttctcacagttttggagtctcacatgtgagatcggggcgccagtgggtttggtgtctggtgagggctgcttcctcgctcatagctggggccttcttgctgtgtttgcacacagtggagggtgcacaagctccctgggcctctctgataagggcactaatcccattaacggggtccccaccctcatgacctcatcaccttccaaaggcccgcttcacaccatcaccttgggacaggaagagctcatctccatggaggcttggcagggccaggcctgccacagagttaggagtgaaggggacagcctgggttccccgagcctcggggaatttctgaaattgcctctgtctcctggtgtttgctcagcttctatgaatgtcaggtgggcttctgaagggagcacggaatctgcgttgcagggtcactgtggcacgaggggaccctggcctctggtgctgtggaaaccggagcagctgggggcggccagagagaggctgagcaggagggtgtggaggtccccggggccctggggaggagggacagaggccatgggcattggtgcgtgggagggagcagcagaggccagcctgctgagaagggctgtgagggaagggaggtcctgtggctggaggggaagcagagtcttcttgttcaggattgaagagacccggttctgttgttgggctgagagaggactttagagaggaggaggccgaagacgcagcaggggaggcgagaagggacttgtggagagccctgagggagctggtggtgggcagtgggttgtctcggctcagagcaagagctctccgtcctctgggattatagtggagggcgttgggggcactctgccagtgacttcatcagtaggggtggggagttggcattatgccccatgatgcaagggcccaagtcaccctggagagggaagccggggtcttgagggagggtcctgggagacatggggcctcagcgtattggggaagggaacagtcaagagaaaggggcaggctgtggggagggccttctggctggacagtactagcagggagtggggcagaagggggtccccataccaacttcacctcttggttcttggtgccgagaagcagcaatctcaggtttctgcattgccaggcaggtggggtgggaggctacggctgacaggcttgggggattcaggccaggcaggcaggggaggccgggatcaatttttgtaaatgctcccccatgcttgtaaagaatactcatttgctttcggttgtaagtcgtcagatccatccagaaatcaatccggcccatttcccgagtcaatgagtctgtgcccctctgctgtggtctaggagacctgtcacccactgggagtggccgttcgcatttccctttgacagggctgttgagccacttgtgtttctaaccatggcagatgctgcggcccttggtttgtaaagcttggtgactgtgtgctttcaccaagccttgtcaatacaacaggagtttccagtcatttagtacttgctctgagttctattttgatgatactacagacaccctgctttctgggtttgcagttttctctgtctctcttttagcatgtttcaggcatgtgttacagacggcatgccttgtttgttccatctcagtctggttgatctctaactgcaatgttaaacccattgatggttgtgttagtgataccagtggcccgtccttttttcggcctgcacctttgcatctttatgcttgacttgtcccctgtccaccctgggagcaggcaggcagctggtcttcccaggcaccaccctcctgacccacagcacgcagcagcctctctctgcccgccgcctctccctcctgccctctgcccaggccgcccctggggaccttacccactgagcccatctccacctgccttgcggtccttccttatccgagtcggatgccactggtcctctttgctgtacttgctccctgcctgtaccactgtctcccgcctcctgctttccttgctgaattgctgggtccagccccatccctcctcccttactttcctgcctccgagcaggggccccagcctcgctgaaggatctacttcgacattcctgactgctggcctctgcaggcagcatccccccttgggaccttcccgctccctgctcacccacctccttgctcacccacctccccctcctccgagcacagacaggccccggcattgcccctgcccgtcccttgagctccggctgctcccgggtcccatcattgtcagcattctcagaagcacagcccctgccgccacctcctccatggctctctggcatcacccaaagcgtctgctgaggtcccacggaccacagaggtgtggatcctgtggtcattctcctgtccccacggctcaggcctcccccatcctcctgcttcaccatcactgcatcgtccgaggcaccgccagctcctcggtttgctcttcccctgggctctgcaccttggcacgtgctgtgtggctgagcaggaccctcagtctcctggaccacagccagaaaggcatttcctcctgcagtggggcgtcctgggttggaggagccttccctcctcatggcagcctccttccacagccccacctgtctccacgcctcccttgctcccagcacaggccccactagtggtttcagcggaatatggaagggcttttgaggacgtgtgtggaaggtggccttggtggctgctcctgaatcccttccagagcctccagctcctcccaccccgactctcacttgcgggactgccccagccgccatggacggggctcctctgccctgctcagaatgttctggaccagcctgggactttgtgtcctgagtctgtggtggttgcagggaactggctcacccgtgtgcttcagggtggaaattgggctggagtgtggaagtcccatcccaaaccctagagatgggaccagcacctggactatgagagtgagggctgcctggtcgggctacagggcatgtcggatcagtcaggggcctgggacacataagggatcaacagaaaggagttgacaaaggcacaactcacagagctgcgggcaggacgagggagcttgcagggcggggaggctgggggccaccacagcgggagaaataaaaccttctgtctctctccccagccctggcttcctgtcggtgccccccttcacccagggagagccaggaggagccagtccatcaggtctgcctactgggctgtaggacagggcagaaggtgaaggggtggggagcccaacagagacccgccagcccagaacatcagcctggaaggaagggacgcagggacctggttcttctctgtgtcttttcaaagccaggtttcctttctaatccagaatctatttattcagccaggcctggtgccagatgctctcaggctctgaggatgacagacaaacccagcagcctccagtagggtgctcaaggcctggttttgaagtggaaacaatgatccatgcggccagtgggaacccgccaagttccccacaggcccgttcgcctagaggcagtagttgagagcgacaggagggcctccatgccaggagtctgcacagtgactcttccttccttctttagactgcctcagaggctgtcagcatttggggtggaaaagagttgtcctgttgagtgtatacatgacctaagtctactggagactcaatgagggaattgaaggatttttcagggaaaatgttgacatttcctgctgaccctagaaagcaagcccctccgcttggccagcaggaagtttctctggcatcaggggcaggccaccttggaagctgggcacacggggcaggggccaccctgcggatgtgggtgcagccctgcggggaagctgcagtgggggcgggggcagggcttggggtggcccttccactccccaagtctgtgggtgcccaatctccagaccaccattccggacctccacaagctgcctccttgggccacgtgggtgggtcagacttgcatgggtgctcagcatccctgggtcgggttgatcctggcaccccctagggtgggtctgctgggcagccctcggagcctggacagagcttctagccatgcacccatcttccctgttcatgggattgagtcaccaaaggaagggcattcattaaaaataattggctggctggacgtgtttctgggctgtcagctctgactgtaggctgcgtgccttcatcaacatctttctcccggttcccagtcatattttttctttttgaaagtgtctttttctgttacccaggctggagtgcagtggcagcatcttagctcactgcagcttggaccttcagggtttaggtgattctcccacctcagcctcccaagtagctgggaccacaggcatgcaccaccacacccagctaatttttaaattatttgtagagatgaggcctcactatgctggtctggaactcctgggctcaagcagtcttcctgcctcggcctcccaaaagtgctgggattgcaggccccagttcccagtcattaagtggaatgtttgagatgcacaaataccttaaaacaaaaaaacaaaaaaacaaaaaaaccttggccaggtgcggtggctcacacctgtaatctcagcattttgggaagccagggcaggcggatcacagggtcaggagttcgagaccacctagccaatgtgatgaaaccccattctactaaaaaaatacaaaaaaaaaaaaaatttagctgggtgtggtggcgtgtgcctgtaatcacagctactcgggaggctgagacacgagaatcacttgaacccaggaggtggaggttgtggtgagcccagatcatgccactgcactccagcctaggcgacagagcaagattccatcttgagaaaaaaaacaaacaaacaaaaccctaccctggaatgccaactccggtgcttgtcttgggctgggatctatggggcactggcctgttctggcctagcaatgggaggctgatgtcccacgcttgtcctgggctgtggcccggaggcgttggcacactccagtccacatgggaaggccatgttccctatctgtctagctcagcgcacggctctgactcactgcagttagcagggaaaatactcttcacattgagatgtcagttttcacttcaagcctgatttctgatccataaacaaagcctgcaagaatcagaggctgctcatgtgggagtcagctaattaatctgactttcctcaaggaaggcacaggccgctgcctcttttgtgaagattagcactttttaaggacgtgtgagtctgtcaggacaaagcaacaccaataacgttccttattttcggggagcagaggaaagtggggtcagactgtcttccccgtggacaaggaggagcggcttcaggttagcacttacaccagtgctgtgagtgagaagctgtggctgtcaccaaggtgaggtcatggctgcaggaaagacgcttcccaccctctccccccaacaacagaggatgtcccaagcccaggggaccggccagcgtagctcctgacaacctctaggaaaacaggagggcttctctttggatggcaaaactgacctcaactcacttaagcagaagacaattcaaggcaggctattggggggctggggctggaggcctggaaatggggtaccttggagggccccagccaggacctcaggaagccgtctgggcagtggtctgcactccagggtggggtgggagcttggattggccctgcttacaatgggcttctctctcagatgtatcttgcaaggagagagagtcaccttgggcaagctgactcccacccacccaggccccttcctgacagtccttctaggctgttcccaaaggcatggctggctgtccctaggatacatggggccctgggcatatatttcctgcaggactcctgtctatatagacaatttgattaaaaaatttataacaagattcatgagcccacatggggaatagcaagatgtatcaaggaagatttaggggacggggaggagaagcacgaacacatttgctcactgtctgctcagtgcttgcagagaccctcgttactgctcaggctcaggagctatctcttcctgttctttatggtcgagtgtgctgtcccagctaatttcatatttatatctcccacagctggggggtaatagcaaagctgttaccgctcacaatgtgtggctctttggaacctgtttgtgtggagatgctgtatatcttcttgccccgcattccccagccccatgtatttagtgctggttgtggcatttctcctgactccgccgcttctctctgcccccgggaatgccggcttccgttgttcccttgaaggtggttaccgtgcttcattaatgatgaccaccaatgtggatcttgcccagagtgtgcaagaaaatgtgagccatacgtcctcatctggtcgtgttaaatttaatgtttgggccaggtgtggtggctcacatctgtaatcccagcattttgggagaccaaggcagtaggattacttgagcccaggagttcaacatcagccctggcaacatagcaagacctcatttctacaaatttttttttttcttttaattagctagctgttgtggcacacgtctgtggtcccagctacttgggaggctgagttgggaggatcacttgagcccagggggtccaggctgcagtgagctgtgtttgagccactgtactgcagtgggtgacacagtaagatcctgtctctaaataaataaataaataaataaatatcgtttggacctttatagcgaagggaagaaccacacatcttgcagcctcatcttccccatcagtcctgaggctgttacttctgcactcccagaattcaacctcgtttaatggtgggcacactcccgccttccacactctgccaccagcaggcagaatgacaagagaagagggatcccagttgtgacaggcattccatccctctgcagaccagcctgggaggagagcatgatgtccagcacggcttggaggcaagagaggacacgggaagggtcgtggcattgcagggcaacagcttccctctgaaagcactccaagcaggtggatgcagccagccctggaagactgcccggaaatgacacggaacctttgagggtgtgggccaccgccctgggcaccagtgacagaggcacagagtgaaggatgtctgctgccactgcccacccctgaacaccagagcccggaggtggccccacagccgatgcaggagcccacaagtgccactcaggcttgaggcttgggcagctgtatcccagagccccgcactcattctgtctgatgtgagtgggaatcctcaaaacccacgtgtcagcatcatgctggtggctcagtcccattcacacctgtgaaggaagtcccctcctggccagtgagggtggctcgctcatcaagccactcactgagacctgaagcaacctcatagtcaacagccctagagctcctggggcatccgtggccccatgcacagggcagagggttggagagtgccctgaagggaacggcagggcccacagggcggctcaggcataggccctctgcacaagagcattgctccggctacacggttctccctggtgttcctggaacacgccaggcttgcttccttctcagggcctctgtacttgctccccgatccctggaacctaccaccttctacaggacctgctccctggacactggggatgcagtgggcgcctccactccagggaaaggcagccaatgtgaagaatggaccggccagagagcactgagggaggctggggcccagttttatttttatgtgtttaaagttttaattttgaaataactttagatctatgctgtcttggaaaaattgcaagaaaagttgcaaaaatagcatagatttcctctgtgcccttcacccagcttcctccgtatgcaacgtagaacaaggactgaaaccaggaactttgtaggttgatactaagcgttggtacttagtgtcttagttttagtctattttgtgttgctataatggaatacctgagactgggtaatttataaagaaaagaagcttatttagctcatggttctgcaggctgggaagttcaagagcatggccctggcttctggtgaggcctttttgtgctgtgtcataacgtggtggagagggtcaaagggaaagcccatgtgtgcaaagaagggaaacccagggagtgtcctgcttttataacaacccaggctcgggaactaatcaagcctctccagagcaagaattcccttgctaccttgagaacagtatcaagccactcacgagggatcggcctccatgattcagatacctcaccccaggccccaccttccaacactgccacactggggaccaaatgtcaagatgagttttggtgggaacaaaccagtcacattctaaccgtagcactccagactgcactgaattttgtcagtcttccgactcatgtccgttgtctggttcaggctccccctcaggatcccacgtggcatttagttgttgtgtctctcccgtttcctcccatctgaggtttcatgacctggatgtttttgaagaggactggtcagctgttttgtagacggtgcatccccatgggtttttctggtgtgccttgtactggcttgagcttacgtgtttctggcaggactgtcacagaagcactgtgccctccgtagggcaccacgctgggactgtcacattgggatgtccagttgtctcctattgtcagtgatgcccttcttcatttggctaaggtgttacctactgggattccactggatgccccgggagctctagggctgtgactgtgaggttttttcaggtctcagatgagtggcttgatgagcaaaccactctttcactcttttttcccattgcgatgattaaatctcccgtgggtagctgctgtgacgtgatgtgagcattctgtttcttgttatccttttgctcactaattgtagcctccacggataagtcgtacctgccgcagtcctgactgtgctgttgccgatggggtttactaccatgattttctatctcatcatttcttttacatttttagttgaattaccctgtgagaaagagctgcccttcccctcccacttatttattattcagttatttgtttctaccaatactgatctgtggatatttattttattcaatgggttctaacctattactatcatttattattgtgttcaaattgccccagatttgaccaccgaaagcaccttccagctgcctcctccatcgttccgctgtgcttgggtgtgatttcacacggggcggtgggacaggccgtctctgagcagggagtgtgggtgtgagcagagccctgcaggaggggcgcagtcctgtggcagtcagaaccagctggggggctgcagcctgctctcggggaaggcctggtatgcacaaggtcagcacctggcctggagctgccacctgctcacctgtctggtttctggtgggggccctgagatcccgggcttggcactgccggagggcggggctgtgctgcggtatggatgccgtgccgtgctgtgctgtgcaggcagggttactggacataagcctggtgtggcctttcataccctggggtgccactgtctcccagtgtgacacctggtggccttgtcccttgtgaggaccaggatctgtggggcacttgatcccatgagttcagtctccccgaatctgtagtggcatccagggagggcaggtgcgcctgagcctgcctgcattctggatacggcgcctttggtcattgctggcctcgctgctccggctctccagtgggccaaccacccacagaggggcctagggccctggcggctgctgtcctggctctagaataaatacacatcccagagtcaccagtgtgggctcaccagtgctggggccctgcccccgcccctcccccggagccaccctgggtgggtggggacacgggctgggcagtgtctgaaggcctgcagagcagcctggccacagcccagacaacctggccctcagagccctggctcttcccataaataaaccagacaggatccttcgtcagatggtatggcctgatttttgttttgggaactctggacagaaggggaagcagacagcctcgggcctggcagggctgcccgcccgggagtggcagctgggcaggcgggcagaggacggtcggcggtcagcgtgccctggatagcacagtgggccccagagatcacagcaggaaaagaagcccaattcaaaggaagcaggagtgaggcagtgcacaggctctgtgtgtgcatgaggccggaggggtcctgagaggggcctgtggcccagggacccggggagatgacagcctgtgatggaaagtgaaagggggggtcctctggctgggaaaactgcctgatctgggcagctttgcacaagcagacatggaggacatgccccactgagtctcaccatcaactctcaactgcagccccctctgggggaaccgaggctttgagagaggaaaggctgatccttgttgcacagtggagtggggggactggcgttgggcgggctgcgtcccagcctgtgctctccccatgggagttcctgtctgcccctgcttctaagggggacgtccgtcgggtagtgtgtcttccccacactgctgggagccagccaggcagctgggcccttggtgggcactggtttccctctgagcacctggcccctcctggaggagcacccgctgtgggaaggagcagaccctgcctcctgggtcctcgagactggggacctgctctccgggctgagctgccacagaaagggtattggatgctgttcaaaacacgccacacatctagaattgcataccccgtcttccaacagctgcgtagactcagccttgggatcgcccagaaaattctggggtgcagtgggcatggggagtgcccccacacgggagccttagccagcctctctgcaggaatgtgagacaccagcctcagctggctccagtcgtgggctctggagcagggctcctgctggaccgtgagagagtggcctgctgctggcggaggggtcctgaggcccgtccaccacccaccggctgtgcagcattcttgtctccctgcgcctgcactcactgccccgtgtccccatgtgagaatgcccagtttagaaggaagggtgagatgggcatcccatgtggccagccctgggcgggctcctacttccctggagtggcagctttcctccatgctggatttctggcccctggggagtgatcctggcattgaccttccggcctgtccagagtggctccccaaggaacagcccgcccagctctggccaccggaccctgccagcagcctgctccgattctgtgtggacttggcgcctggaggctgttatgggctgagtgacgccctccctagatcccccagttcctttgttgaggtcctaaactcccgtagatcaggatattggctgtatttggaggcagggtctttaaagagataattaactgaaaatgaagtcactgattcaacatgaatgactggtgtcctaagaagaagcgattaggacagaagtacacacagggggacggccatgtgaggacaggggaaagatgctgtcgacaagccaaggagagaggcctcgagagaaaccgcctctgcccacaccttaattttagagctctagcctccaggactgtgagagaataggttctgctattcaagccccggcctgtgctgccctgtgatggctgcccgagcaacctagggaaggcgccggccccgaccttttgtgggagggggtgctggcagtctacctgggcagcatctcctggtggatgtgggtgagcctgctgtgaatgctgggggacggtcctgggtccccaggccctcagttcttggagtgcagccttgcagggtttggttgctctccagggtgggtcccctggggaatctggtaaggaagcatatgttggcaactcccagacatgtgcccctgccaccccagccccctgagcagacagacccaccgtgccggctctgtctctgggagtgctggtgctcaggcgtgctggtctcccgggctggttggaggaagggaggggcggtgtgtgcagacctccaaggaggcagggaggctggcagggaacagctgtgcaaaggtgttaggttccagctggtgtgggcaggtgccagcccagggaagggcctgtcgacagggtcttttttttttttttttttttttgagacaagagtctctcactctgtagcccaagctggagtgcagcggtgcgatcttagctcattgcaacctccgccttctgggctcaagcgattctcatgcctcagcctcccgagtagctgggactacagacgcccaccaccatgtcccgctaatttgttgtattttggtagagacagggtttcaccatgttgcccaggatggtctcaaactcctgacctcaggtgatccgcctgcctcggcctcccaaagtgctaggattataggcgtgagccaccgtgcccggcctgttggcaggatcttgaatggggaagttggaccttattccatgagctctcctccaccacacgtctcaaggccacaatctgctgtggtccagctggtgagacatggaagctcagaaagaaaaatcttgctttttgatagtttggcaaatgttcctgcagcacgagtcatttttcttctttagtagagagcgccctgttatttatgtgaatgttaatttgtgactggggacgttccccgacgtgggcttcatgctgaacgagacctgggaaatgtcagccagagaatctggccgggacgagtgtcagttctcgtcacaaataggcaggcctgttgcagtcccagagtctgggtctgacccactgacctctgtgtcctggctgggtctggctggccagctctgtttcctggaggctaccccggcattggtgtgtgcaggagccatggagatgggggagctggctgcagagggctgagtgtgggacattctggacaggccaggtcccgagggagccactcaagcgttgcttgatttagcagaaggccgcctggctggcccctgcgctggccccgtgaggcattcttgtcggcatcttgtttattccattttcccccttatctttctctctgtgctctccccctttccgtctctcctgtcttcacatgaattgtctgttttgctatatgccctttgtaaaaatgtaaaacaaaaaaaatacagaaaatattaataaaaagtgaaactcacccccgatcgtaacactgctgaccctttgttacgcgtttcctaacagctgtcatgccatgatcatcatgatggtgatggtgctgccagtcggctgatttatcacgtgctgtgcccagtgctagagacgcggtatctcgcttagccctcacatcagccatggaaaccctgttattatctccattcaaccctgcagacactgtccacagagaggccactcagtcagaggtgaagtaaacatttgaatcgaggcagagtgactcggaggccacatgcttaattattagactgtgctgacgtttggcacagagatatacatgattttacgtaaggaggtcatgctgcagctgggcttgccgccttcttcggtcaccaatatgtcatgggtgtgtctgttccttaagtggtcaaaaaatctgagaaactcttttagcctagcataaatctgtaaattttgtaaaattattttgcagggcatagagtgttattgaaataatctgactggctgggaacggtggttcacacctgtaatcccagcactttgggaggccgaggtgggcggatcacctgaggtcaggagttcgagaccagcctggccaacatggcgaaaccccgtctctactaaaaatgcaaaaattagccaggcatggtgttgtgcacctgtaatcccagctacttgggaggctgaggcaggagaattgcttgaacctgggaggcagaggtctcagtgaactgagctcaggccactgtactccactccagcctgggtgacagaacaagacactgtctccaaaataataataataataatctgaccatttattgtttttgttgtctgtttttgtttgtttgtttgtttttgagatggagtctcactctgttgcccagaatggagtgcagtgatgcaatctcggctcactgcaacctcagcctcctgggttcaagcaattctcctgcctcagcctcccaagcagctgggaccacaggcgcgtaccaccaagcccggctaatttttgggtttttagtagagacggggtttcaccatattggccaggctggtcttgaactcctggccttgtgatccattcgcctcgtcctcccaaagtgctgggattatggacgtgagccactgcgcccggttggattttgggtttttttgagacagggtatctctctgtctcccaggctggagtctccaaaataataataataataataatctgaccatttattgttttgttttgtttgtttagttttaggttttggtttttttgagtcagggtctgtctctgtctcccaggctggagtgcagtgacatgatctcggctcactgtaactctgcctcctgggttcaagtgattctcccgcctcagcctcctgagtagctgggattacaggtgtgcaccaccacgtctggctaattttgtatttttaggacagatggggtttcaccatgttggccagcctggtctcaaattcctaactgcctcagcctcccagagttctgggatcacatcatgcccagcctacatttattgttatatatttgttcttacttctgtcatctaatttatgttttctgtttttctggatttttttttttttttttttttttgctgtttttctagtctaccatattttctatatggtctgccttcagtcatttggaaggtatacattagttttactagttgtgacttttctaattttgagtagaattcttcagcttgtatctactgattttagaaacttaccagtaactgttgatgctaactgaagattctgaagattaggaaacgagtgcaattaaactgtaattccttttttcttcctctactctttgtctgattgttgtgggcttgtttggcaattttttgcctgcccccatttattaaagttaaattatgaatagtttatatattacatagctttttttttccagaatatatgctaaatgtcttctgatttgtaaccctcattatccctgtagcatagatgcagagggcaattccgctatttcgacctgtgatttccccacttgccaggtgtctcagttttaaagtcaagtccaggctgcgtaaagtggcaggtggggggtgctggggagggatgccaagcagaactgagacagacgctctcgagggcattctctagcagcagggttgaagccatccctctgtgcaccctctcccagggcccagagttgctcacagtggctcacctggttagttgatagacttagggctcccatctcaagatgacatggttttaccgtgttagccaggatggtctcaatctcctgacctcgtgatccgcctgcctcagcctcccaaagtgctgggattacagggtgtgagccaccatgcctgaccaagcccttggtttctaatgcagagtttctttgtaggccaatgtttcctaaacattggcctaggaggtgaactaatgggtaccaaacatgactccagaatgcatttaattctatcaaatcccagctagctttgtggcagaaattgacaagctgatcctaaaattcatacagaaatacaagggatccagactaaccaaaatgctattgaggagaagaacagaggaagggctcatgctttgtaattctaagacttactacaaagctgtagtaatcaagactgtgtggtgttggcagaaggatagacatatagattggtagaatagaactgagagtttggaaatacatcctcatattgattcttgacaaaggtccaagacaagtcagtgggggaaagaatggtcttttcaacaaatggtgttggcacacctggatatccacatatggaaaaatgaagttggaccccttcctcacaccatacacaaatattaactgtaaatggatggatcatagatctacatgtaagagctaaaactatagaactcttaaataatgtaggagtaaatctttgttactttggattaggcaaagtcttagatatgacaccagaagcacaagtggacaaaagaaaaaaataggtgaactggacttcaagaaagtccttcatgacttcagtggacactaataagaaagttgaaaagacagcccacagaacaagagaaaatattcataaattgtatatctaataagggatttgtgtctagaatatataaagagctcttacaggtcaataaaaagaaaatggtcttattaaaaatagggaaagtatctgaatggatgtttctccaaagttaaataaatgacctataagctcatgaaaagatgcttagcatcattagttgtcagggaaatgcaagccgaagcatgatgggacaccacttcacacctgctggatagctagagtcaaagagcctaagaataatgagtattggtggggatgaggggaaattgaaccctcacacactgctgggggcactgagaatggtccagcccctgtagaggacagtctggcacagttactgtatgacccagtaattccactttgagaggaatgaaaacacatgtccacacaaaaacttgtccacagatgttcatagcagcattatgcataggagccaaaaaccaacaacccacatgtccatcaactggcaaatggataaataaaatgtggtatatacatgtgatggggtattatttgacaataaaagaggaatgaaatactgctatatgctacaccatggatgaaccttgaaaacatactaagtgaaggaagccagtcacaaaaggccacatagcatgtgattccacgtatatgaaatgtccagaataggccaattcatagagacagaatgtagattagtggttgcccagggctgggttggggaggagaggttggggaaaacatggggagtgactgccaatgtgtacggggtttctttttggggtgatgaaaatgttctaaaatcaatagtggttatggttgaattgttcactttcagcatatagtttagatggctgagatgtatggaatggtaatcacagcaccataaagctgttatatattaaaaagcattgaactggccgggcgccatggcttatgcctgtaatcccagcactttgtgaggccgaggcaggtggatcacctgaggtcaggagtttgagaccagcctggccaacatggtgaaaccccatctctactagaaatacaaaaattagctggatgtggtggtgtgtaccagtaatcccagttacttgggaggctgaggcaggagaatcgcttaaaaatgggaggcagagtttgcagtgagctgaggttgtgccactgcactccagcctgggtgacagagcgagactctgtctcaaaaaaagaagaaaaaaagcattgaactttataatgaaaaatgattcccttttcagttgcattttaaactctctggttgagtcgaggggagtctcagtttggtgctgacagatctttaccagctctctgctacttactgacctctataacaagagagaagggcagtggtgtaggctttgaggtgcaaatagaagcccggagagagaggaagacactgggggtgcgcccagggacagagggctgctgggaccccatggaaggccttgcgtgccatgggacggccttggcctttattttacaggagtgggtttctggtttttggtttggttctttctccttggtcctagtagagttttagaaggatgatcggtacctgccaacgtgtgcggggtttctttttggggtgatgaataaacaggataagcagtaattcataggttacgtagtccagctcctcagtttgcagatgagggaactgggggcctgcaagggggcaggactggccatgaccgcattggaaaccagggcccctggctcagcgtccagtgcttactctccctgcctgcctcgccccccaccctgcccttcaaagtggagtctagctttccttagagcctcgctgggcatgtgactgtcggggctccttggtcctgttggaaattggctccggccagcttaggccaaaaaagagactttctggagtaaaggtctgtagggcctgaaaccaggtccagggaaggttagagtggccaagcaaagtcatcaggttctgtggagctcagaggcaactctgttgtggtcactgtgctcagcagaaccctggaaggcccagctccagccatagctccaagacagagccctagacaaggggtcgctctccaagaggaaggacgggagtggctggcacctggcgaggatcccatgagacagaggaggagctggtggagatgcgggtgaggacagctgtttcctaaccccatggacagctcctgcccgctggcgtcccttttggaaaagtggaaaagtcagtgtgtgaaatcctctgggatgctgaactgtaaaggagcccccagtggtgaggaccgagtggctcaaatcccactcgatacttcccactcctgggactgtccagtggtgaggacggagtggctcaaatcccactcaatgacacttcccactcctgggactgttcagtagtgaggggtccagcccccttccctgaaagctcccaaggttgttagagacctccctggggagctgggagaggcaagagagtgcccgagcaggctctgagaggaggcgccctgggaactgcaggcactgtgcagctctccctgtgagaccgtcattccaccaggcagctgtcacagcaggggaggctgcctggccattgccccgttgtccagcagatctcccaggttcattaccaaaaggaagatggggagaaagaatcttggagttagaatactttcaggaatgggaatcttagcagatgccagcatctgggggactcttggcaaggtgcgtgctgtgtgtgtatttcggagggaggtgagtttgagggcaacagggacttgcagccttgtcccttggcaaagtctgggtccctctgtgcatggacctgtgtgcttcctatgctttgtgccttctatgcttgattgttgccactgcaaccttggcacacacctgacagtgtttatgctggaggttgacagggttgagtgacagaccaggtcccagtcatacacaggtggggggctgctgatggctgcagctgtggcttccatgggaaggggcagtgggaaccagccagcctgggtgctctgcagaaggaaacaggatgcatgcttgtgtttcctgtgaacccctaacttccaggctgtctgtggttgaatacttaaaaattcagagtaatagaggagagctgttaagcctttggatctttataaatttttaacatctagttgccatttctagtaactactttaccatcaatccaactgcaaaggagcaggttctatagaaggaagaggcagggcaggcgttgtgtaactcaccaggatctgaatgccggcaacttgacttgatgacccgggtactaccaggctctgggcccctgcggtggcacctgaaggtcagggacagagccctccccatgatcctctctctgtcccccaggggagaacctggctgggtttgccagacatccacagacttcaagagcagagcgggactcacacttagagccaggtcggggtaccaacctttctgtaagaccccaggctggacagctgtggggttggacagacaggccaccagcaggctcccaactgagtgcttttcagcctagtgtgcttctggagtttctttaatatttattgagtggggagaggaaactgattctaattaataaaaattacatgtaaaaacagatacacttgacactggcagcaggaaaatcaaagtcccggaaaaaaatgcagcaaaacatagctcacattttgtgctttgctctcctgtcaattttcttctgtgtgttttagacagatcattcctgggatgcatatactgaagtgtttgaaaatcagggaataaaatgatctccacttcttccgtgaagtgccccccgccccgagcattattctggccagcggtcttggcaggacgtcagctgatggtcctgggggggtcagcctttggtctcgggggggtcagcctttggtctcgcggggggtcagcctttggtctcgggggcggtcagcctttggtctcgggggcggtcagcctttggtctcgggggggtcagcctttggtctcgggggggtcagcctttggtctcgggggggtgtcagcctttggtctcacgggggggtcagcctttggtctcagggggggtcagcctttggtctcggggggggttcagcctttggtctcggggggggtcagcctttggtctcgcgggggggtcagcctttggtctcgggggcggtcagcctttggtctcggggggtgtcagcctttggtctcgggggggttcagcctttggtctcgcgggggggtcagcctttggtctcgggggtgtcagcctttggtctctggggggtgtcagcctttggtctcgggggggtcagcctttggtctctggggggtgtcagcctttggtctcgggtggggggtcagcctttggtctcgcgggggggtcagcctttggtctcgggggggtcagcctttggtctctggggggtgtcagcctttggtctcgggtggggggtcagcctttggtctcgggggggggggtcagcctttggtctcgggggcggtcagcctttggtctcgcggggggtcagcctttggtctcggggggggggtcagcctttggtctcgggggggtcagccctttggtctcggggcaggtgccaccatgttcatcgtccagcatgcgttgtgcgcatcgcacggtggtcaacagagacgggcggggctgtgaggagcatgttgaacgtctgtgttggagaatgccaccgcttggaggcttctggctgtgtgaggaagcctgagcccaggccctgcttcagatggaccccagtgtgctcctgtgccctccgaggagtcgcctgcaggggtgcccttccaggaggcaaggcccagggcagcatcagatggagctagtgctgttggctcagcccagtgattgtcctcagggaggcagccagggaggggagcctgacccctgctggtcagggagaccccaaactgtcccccgggttactccggccagagagtactgcccttccccaggctgagcctggcctcattgtcacactaggtccctccagaataaccccagggcctcaggcctgtggcatcgatggctcccgacctgggctgcaagttcccccagaagatggagctgccataaggggtcctcatgccccagtgtcctgccctaattggctcaatcggcccagtctggcccagggacctgtctgggagatgccctttccgtgtaggtgtgagttctgatccctagaacctgtgtgtccccagcagcctgtctgcccatctaggcctcggtttcctcatttggaaagcaagctggctggatgaaatcacttgggtggaggcgtggcctggttctcagtgtctcccaggctgcatgtgctcctgtgtgagtgtgcacgggaaatgaccggcctcatgtacagacgagtcactggacgcttggggagcttgacaccttgcctgaggtcacctggccagatagaaagggtgccaggaagtcagaacttcacgctccaggacagcttgcccgctgccgccccccagggttaattcctgcacttcatccaatgagtttcagtcataagatggatttgaggcaccagccttctccacaccacgcaccgggaccatcagtgctggaccctcccaactcctgcactggtaaacacactgcccctgtgccagtggacaggcctggctgtgttcttcccgcctgcctgctcggtgcctcccttgggggacgtggcctgcagctttggggtcatcggttcgctcattccacaggcatctgctgagtcttcgccaggcctggttgagccctgagacccagggatgagtcagaagcgtggggcctgcagggttcccaccccctcttccgctctcctcccacagccctgctgacctccttctccgacctcggtcttgccctggtaactctggttaccactgcctcctaggcctcttccccagaagcccaggatgcctgagcccagagggtcctgcgccccttgcccttcttctcatgcccctcggagaatggcacccactttgccggccacccaccaggaccctgaattacttttctgcggctgctgtaaggaaccacttaaaacagcaggaattcgttctctcacagttctgaggccggacgtccgaagtcggtataacctgacccaaatccaggcatcggcagggctgcgctccctctggagactctgggggaggacactttctggcctctgccagctcctgggggctgccagcattccttggcttgaggccacatcgctccaatctccaaagctggcatctggcatcctccctgtctgcccatggcctcgtcctctgcgcatctgcctaatccccctccactccccggcataaggaagtgggcaaggactgcattcagggcccagccagccccagagctgacctgatcacacccgcagagtctctttccaccatgtccactaccctcacagctgccagggatgggggcctgggtaactttgggggccggttcttcagccacagacctggaagcccaccaggtgcttcctcctccctcccatctcagccggctctaccctaccacgtcctgtccatttcgctcctcacctccttcatacctgccactcgtccttgtctctcatgctcccgtctggaccattacccctctcccaggtgcctgtaacaccttctccccaggaccccagacccatttttgttccgcagcccattccccctgccgcagccaccatgcttctgaactggaatcagatcaaggctccccccagaagccctgggctgcctacaatctccctcaccagccccctgagtgatgggccaccgggcaccgtgcccttgatgctcctgtccacccacctggtcagctcttcccaccagctgtgctccgtccacctccccggccatggcatgtgcggtttcccccatatggagcactggtcctctctctgactctttgcctggccagcacaaagggattgggtgggtttgggtagatgtcacctcctgccggaggcatccttcattctggagccaggcctgatgctgggctctgtgttcctccaggccctgcacctccaccagcccctgcctggcacatcagcttcccgagggcccaggctgagtgcgccgggaggcatctccagcctccctcgctacacttgaggctaggggcagccgcccagcaggccctggggggcactgactgcatctcggtctgcagaggctcccagccagcaacaggatggggctcaccgagcacctggggtcagggagaaggaggggcagcccgtgcgccaccgtgcccccccacaaccaagatgatgatatggcagaggccatcatgaggttactttggggggggtgtggtttccgcacatccagatggcaggtgccgggggctgcccaccagagggcacactcctaactggacaggggaccccggccagcgccagctaagctggagtgtcgatgggtgctggaaatgccagcttttctgattttcaagagagtctggaaatctggtcgtttatgtgaactctcctgtttcttaagtttggcaacaaattcaagcttttaaaatcccctgcatgggtcataagcttgtgatctgaaggaaacactctgaaggctggacacagtgtgcacttccagtgtgagaccttggtttatggataatggaccagaagataaaagtgtaggagctggagttgtcatgggatgggtggacctgatggtgccagcaggctggatggcagggtatggcaggggagggcagggtatggcaggggagggcaggctggatggcaggggagggcaggagacgtgaggggggctgaatcaggccttgaagggggaacacaggtttaccagatggccgagctggggatggggtggtggggtgggagaatggggattcctgagttggcagcatggggttcaggggctgggtggctcggcagggtgcacccagcccagtgagaagcatggggtggtgcaagccgcggtctgggagggtggggcaggccaagagcctgaatgccagcatatagagcagcctgagtcccaacggaaatgaggacccagcgaggagtttgtagtcagggagggtgctggctggcctagggggtcaggggcagcagttcagctgcctgtagagtctgggctggtggctgacacagagagcaggagagacagttggggggcagtagggactggagccagttgcaggggcatgtgttccatccaagacccgctgtggtcagggcctgcgtttccaaggaaagctgggattccatgttcaagacatgaaatctcatcattctgagtgttagcttcagagctttaaaaatattgtttggcccagatggaacatgtgtgtgggcagattcaatccccggctggctgttttgacctttgtcttggactctgggctcctgggagtgggggcagcacttggcccatattgatgcactttggtggatgccctcctggggacacgcacaggcccacagctgcccttgaatgtctccctgcttctctggacggttttgactttataaacacagtaacttttctgaaagcagacagggttggtgtataggggtggagatgacccagacagaggcccctttcctagacagggtgggcggcggggggcggcctctgggaccacatgttcataccctccggccagcccagggttcaagctgagcaccagctggggtgctgggcagggtcttcaggtgggaggtactccctgagggggtctcctcgctgttccccttccttggtcttttgtgtgctggaaatctgatcctgttgtctttgtcccgcaggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggtgaggctactgcaggtgggcaggctgtgtggagagccctctgaggccctggtccccaggggagcatcccagagactcaggcagctctccacagaccagcttggctgctgaggctgagccccggtctcagtggctcagaaatgggccagctgcctggctgacggcagggcgtagcagggctgctggggctggggcctctgttctgggtgcatgtgggtgacaagcagcccagacacctctgccttcatgtctggggcctccatggtggactatgaaggctgtccaagggcccatcttctgttgcctaaaggcaagcaagtgtcgtggagcggggcgggggcccccggccaggcctgagtccagtgcctgcgtctctgagtctgtgcctgtgaagaggcctccagagccccagacagcgcctctcctgctctgtgctgccatggtccctgggagggtgcctgtggtaggtcccaaccctcacctggctgctcagggagaaaggccctgcatgctctttctggatccctggaggcatgtgccctacaaggactctggaggtgctcccagcagcctcagcagtctctgcacagactcatgggcgtctgtctttttcaactcagaacccacgtgtgccctgggcccagaaacgtgaaaggagctgccaggcggccatggtgacagtccatgactgtcgcctcagatctggcctcactgtgccagcccacacctcccagcatcccccagtctctggtcctggattgtggtgaagccagggttggtgtctgatgtggttctgcaggcccatagttctcagggtcccccgtgtggtcagggactcctggcctgtgcttggctcttgctgggagagtgggaagctgcgagctcagccctcagcctctggtcaggacccctgggtgaggagagtctggagtctggggcccaggatcgggcacacctgcacgttcacagcgagtgctccaggggcctgggctgggccagcccccgtgctgtgatttactaaggtactcccgtcactccatagcagccccgcctcatttactgtaggtctgtctgacttcctagcttgacagaaaaattgggtacagcctggcaggcatacttctaatttcatgaaacggcatcagatacctttgcaaaggaattgttccatcaggaagcccaatgtactctggagccaatcagtgcaaccggtggccccttgttccttggtgacaaatcagcgtctgctatgctgcagacagccgggccactgggtactgcctgcccagccttttccagctgtggtctcagcctcgacttatccccacccttggactattttgcagggaaggaaggaggagtaatctaggagggccagcgtggaaggggctgagcgagtgctccagacccgggggcagggccccagctttgctccttgctagctagctgctgtcgggcaagcccagtggcattagcaacccctgtgtccccgagagctcaggggctggtcacttgtgctgtgggcttggtgcttctggctggcctctcctggaagattcagggtggttctgggggcctctgctcaggcgaggtgagctggccacgtgcccttggccatgtctctgatcccagattccatatggtgcttgtcttcctgaacatggcagcccttcccccacagcctggccggccttgccttattttctgggcttctgctggtgtttggcatcttctgctgaatcctccctccacccccacccccaatccacatatctttaatgagaacttgaaattcagaacacaggaaaggaatttcaatctcagaataagcccagaaaccattggccttagaagacgctgggtgaggccagctgccaggtcaggggtgaggctgggctggaaggtgggggtttggtaatgggctgtcggggaggaggtgagcctgtccagccttagctccaggcctggggcccaggctgtggatgtgagcgtgggcctggggctataggtctggatcccagaacttggggctggggccaagtcccctttgcttgatgttcctgtctggtgtcagcagaccctgcatgaggggctcgggccttcagtgagctagctcccacgccatgcacctaatcgttcccacgtggccctgggctgagatcgacacactgactggaagggcaccaggcccagtgagtgccggagctgggtggagggcccacggtgacctcaggcgtccagctttccatctgcctgggccttttcagggcccagagtggcaactgggagatacataaaagctgtgtcctgtggccaggcatagtgaggggcacagcctgcctggcacacaactccaggacctgggtgcgggtgtgtgtgtatgtgtgtgtgtgtataggggaccctttcttccagtgaattctgagggaaccctgatatatcagtgtggccctggcagaagctggcaggaggtgctggctggcagtttcttcctgcctccccaaaagcaacgtctggaagtgggtgtgaagcaccctgctatttatgttctgccggggaaggtgacacacctgccctgggtgtcccagtggggggtgggcatctgtctgggtggcaggatatccctgcagcgtcaggggtgcctccttttcaggatgtcctgttttccccgagaagcccacgggctgctcagggtgatctcggggactcatggagcctcagggaatcattttcactaatagtctctgtcatccaagatcagttgctggattgcagattgcctgggggaaacggatagaaaatgacggttttaaagcatttcacagacaggccagggatgagtgtgtgcactgggcagcttaggcaacacccgggagaggatgttattaggaggggcaaggggtgagggagcggggagggtccttttctctcctccctggccatgctggccttggcagaagggtcctgctcagtgctgctggcctgggaacctggccaggaccggaggccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgtaagtccaataaacctctttcttttgtaagttgcccagtctcgggtatgtctttatcagcattgtgaaaacggactaatacaaatgcctctctcacagctctgtgggccagaagtctgaaatgaatctcactgagccaagatcaagggtggacagggctgtgctccctccagaggctccaggggagaatctgtttctggcccatccccgctcctgggggctgccagcctcccttggcttgtggctgcatcatgccaatctctgcccccgggtcatgtcgccccctcctcttctgacgtgtccctgtgcttccctcttgcaaggatgccttgattacatttaggactcacccgagtaatccaggacaggcttctcatctcaagagccttactgcaagcacatctgcaaagccctttcttcccatagaaggtacccgtctcaggttgcagggatcaggatccagcatctttgggggcaccatgcagccagctacaggatgtgaatggccctcacgtacaaggctggccatgcagtgcacagcacacccgggaggcgcccgtctgggtcacgcggaggagcagcactgtaggcttcacttaggcctccccagggcatatagcccagaggcacagcccaggcaggccctggtcctgctgcctccctcactggaccctccaccctgtcgtgtgggagctcttccctgcatgtctaagtgccagtctcagcctggcagtcctcccccaccgcccgcgttaagggacctggagcggctgactccaagaccacgtgcacagagaagccaaccctgtgctgacactgagggcctgtcttagcttcccagagactgaccttgggactctgtgaaggttgccacacagtgagaaagaccccgagtcacgtgttgagcatgtggtctctgtttcagacacacagtgccatttgcagaaagacaagagctgcaaactcagagcctgcagggcctggcaggcaatgccaacaaggacagcagtggaggaaaaaaagataattgcacccacccttggcctggctttcatttctctccttttgatggaaacgtggagaccaagaatacatctccactaaaaagaaacagcagtgggaatgcagccacacgtggtgtccagccctggccttgccatgggcacagggcgtctgggaggccctgcaaggagggacagaccctcctcaactcccttgacctcaatttggtagaagttgggtctggtgcagctgaacatcctatcaagaaaatccagacatcagactttttatgtgaactttcctgatgttaaaatgtggcttaaaatttctggaatgagaggatgaactgagaaggctccaggaatccagccacggcgctgagctcagtgagtcggcaacagctggcttggcagggcccaggccgacccgggtacgagagacagcccctatcaccatgcgaaaggaccaggcctcaggggtctggggagtcactcaggaagtgcctggttggagacacagagacaggtcctggcacaaggacgctggccaggtccagggctcagccagcaaatccagacaaagccctctttccacagaagcctccacatcagctctctgcctccagccctgggccctgcacacccagtgggagctgtcatgcctggggtcccctcccgtgctcactatatagaccaaacaaaacacggtcccccattggctacccatgctttctgtgatgcagaggtagaagcatcttctgccctcctctgtgggctgctctcctggggctcgccccggcctggccttgggacagaggaggggcaggtgcttcccatcctggggaactgctaccaggctgctgtgcacacaccctgctgggctgaaggaagagaagtcagacagcaacgtgccagtgaccttggctgcctccaccccagacaccgccggtgccaagcctctgcctgctgctgtcaggctgcagcatcctccctgacgggcagacgaggcacgccaccacgggagcctctcagcctcgctgcaccaaggaaggccctccaggagacagaggacaagcgccggcactgggcagctcctccatgtggctgagcgtggctgccacctgcagcccacagccagcccttccccaccaggccaggaagagcccctcctgacccacagtctccaccctgtgactttgccttgagttgggtaggagttttccaggccgcaggggatcctgggggaagagtgggcggcgggggtgggggcggacctcaggcatgacagttccccctgggtgtgcagagcccagggctggaggcagagagctgtggggcagcctccatggaagcagcagccttgaatgacccaaggtggggatggcgccctccagtctcacaaagagttgagtgtttcagcaagctcgtactggttgcagtgtgagggaggctggtgggggaggctggagcaatggcacaggagagagagaggagctctgttctgtcagaccacaggactggggagcaggcgagactcatccattcagtggcgagcagatagccagccccactgacacagcggatgtgaggcttggcccaggtgggggctggggggcccaggatggggcaggagggccgtgtgctttgttggggggtgccaatttgctgaatgccaggtcagagagcctttctgccctgtagctgtcgacgtccatctcagcttcctgtggctgctgtaccaggttacccacaccttaatggcttaaaacagcacacctgcattcctcacagttcgggagctcagaactctgaaataggattttaggggctaagatcaaggtgctggcagggctggttccttcgggaggccccagggcagaatccattcctggcccctcccagctcctgggggctgttggcgttccttggcttgtggcaacattgctgcagtctctgcctccctggtcacgtggcttctcctcttctatagccagctctccctcttagaaggacacttgtgataacatttagggcccgctgggaccatccaggttactttccccatctcaagacccctgatttaaacacatttgcaaagtctcttctgccatataaggtaatgctcacgagttttgggggattaggacatggacgtccgggggtcatgattcagctgacatgtctaagtgttgaaccttgggtcctaagggagaatggagagagggctttggctggatttgcagggtgagccctggacctggccagcgtcttgtgcccagacctgtctctgtgtctccaaccgggcacttcccaagtgactccccagacccctgaggccagggcctctggcgtggtgataggtgctctctctcataccctggtcagcctgggccctgccaagccactgttgccgactcactgagttcagcgcctcggcgctggatccctggagtcttctcagctcatcctctctttccaccctggagctgagcctgcagcccaggccccgggaaacccagggagaagcactgattgtgaaacccgaggcggctccgggaggcgtgcttcagggctgagcgcacccttggcagacgccgcggcgctcctgtcctcgtgcagaccgggcccttgggatggctgttggagatgccagcgcggtgatgtggcccacgcggaaggggtgggcgggggccggcgctgggaaagccgaggctgcacattctccgaggctggagttgcctggggtcagccggggagagcaggaggggccagctcccgggcctggctggctctctggctggagtctgctgctcagagcgctgccctgtgggtgcttcccaccccctgggctgtgaaggcagaagcgaggcttgcagccccagcgagggctgggccccccttattccacagtggagacgtgccagggtgtgctccccctccacggcgtctgggcctggcactccgcctgacagcccccacgtgcgcagcaactcccctgtgcctccgacataaatttagtccctgagtctcaggcttgcccttcccccgccacctctcccctcccgacatggtttctggttcaggggtggagccgaccaggtaaatgtggctggcaagggcctggatctttggtggagcaccgtgggcaggtgacaagcctgacccggaggatggtggccttggccctggcttggctgcagccccaactcgagtgcaggggacagttctggaagaccggccagtggttctgaggagctgcattagggctgctcccacagatgcttccagcactaggtgggtgagtggggtgggcagcgggcagtttggtgcagggttcagtgtgctcagccccacccggcatgctgctgttggtgcaggggtcagtgtgctcagccccgcccggcatgctgctgttggtgcaggggtcagcgctggtgcaggggtcagcgcgctcagctccgcccagcatgctgctgttggtgcaggggtcagtgtgctcagctccacccgacatgctgttgttctggctcactaaggggcccagagcagctcacccagcccctcaggatctcagaacctgggtgctgagatctccactgtacctgggtgcagtggcacaggggctgctggaattacgcagggcacagggcgcctgcccagtgctcactgcgacacttgctctccgtcccctttccctcctctgcctcgccatcttccacagacacagtgaattgatactttctttccttcccttggatctgtgttgggaatgtcctccaaagagcttttcgggttttgcacaaggtaacagtccctggcatgcagacagtacacggctcaggggtgaagctgtgatctgctcacgggggcatctggcgtttgatcagcaactgtgggctgggcatgccccctcttttcaggtccccagcatggcagaggcaggcttctgggagagaggcatgtgtccagggcatcttttcatgtctgtgacatctgtgccttggatgtaggagcctgctggctggggtgaagtttgggcaaggagcagtgggacctgcttgggacccaggtgaggcttccttcatgccctggctgccccatggatgacggtgaaagagacatgggcaccctgcataatggggacaaagggactgcatcccatagtgggtccctagacagaggcctcttggggatagagaggggtggggcgacaggtgagaggcgttgggtaccagcatcagggctgcagaggcagctgtagggacatctgaaggggacaggaagctcttccccagcagcagcgaggacaggcctggctcagaaactgcatttgggtccgaggtccaaactctgccagtttgtgccagccggaggcctctgaccacaggccccatctcctctcagaattctctgcaggttggcagacacttcagccagctccaagcctgaaatattttctataaaaatttccaattttctttgacccgtttctctttgaaattaatcctaggcagcgctgtgctctgggccctgaaggagctctgagcggggaaaggtcgcgcagtcagatgggcgtgctggcgtctgtcttctctctctcctgctctctggcttcatttttctctccttctgtctcaccttctttcgtgtgcctgtgcacacacacgtttgggacaagggctggattcttcggctgggatgtctctcagagctcttgacttggtccctttggctggggcttgccgtgaggtgtgggctgcgccacgagcacagctggtagagaacccggccaggagcgcagctcacgcctcccacgcctcccatcccaaactgtcggcacacccagagagagcctgcaggacaggacaggaggtgacctgggcactgggcctgtgtggagaggtggctggtgcgctggtctggttgggaaaaggccgggcacctgaatgccatgcgggttcattaatgctcaataataatgctgctccccaaatcatgggggaataatgctgctccccaaatcatgggggaataatgctgctccccaaatcatgggggaataatactgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatactgctccccaaatcatgggggaataatactgctccccaaatcatgggggaataatagcattagcagctctactgcttagggggagactgaggctcagagagggcaccttgcctgctgccacaagtgtattttcctgcattcactcgtcacgttcttgctatgtgtccaccatgtgtctgacaggactgggtgctggggctgtagcagcggaggaacccgatcgagtccctgttctctgggctcacagccccgcaggggagacctggtgagcagatgctcgcagacagtggagaatcctgtgaacaaagtaaaacggggtgaaagggcagcgtgagaaggcaggtaagggagggaggcgccccaggttggtgatgatgggaaagcccagccctgggaagggtgttccaggcagagggaacagcacatgcaggagccctgaggctggagttaccgcagcgtgaccaaggggcagaaggaagagctagtacctggaactgaggacgtaatgggggagtgggaggcgtgcagggccgggagggatgggtggcactcatcgctttgaagggacggtcacggtacggggtgagaattcattccctgtgcggtggaggcctttggagggttttcggtggacggtgtggaagcagggaggagtcccggtgacagatggcggtggaggcagtgggttcaggatgagtttgaggtggagcttccgggacgtggtgtgaaggaaggaatcaaggacacatcctgcccctgagaggtcacgtggctgggaggctggctggtggcctgaggctggccgggcaggtgtgctggtgggggtggccgggcaggtgtgctggtgggggtggcaggttaggtggtctgggccacgtgcaggagtcagaattggcacccatcactctgactccacagctgcccgcttccactgctctgcactgccctggcccagagggaggtgttttcccaggaaagaaggtgccaaggccaagacccatgtgttcccagactcacggggcgggggcaggagcccccaatgcagccccacaggcagccaggccctgggatgcactgccacctcctcttgctccgggaggcagaggctgtgctctgtggggcgggctgtcagggacagtgtgaggtttggggtcccatggacgtgtgtgcatccttgtttgtctagcaggaccggtccagcttccccttgcctgccactgtggggagggaccccagactggccgggatgaatggatgcaggaactgtggcctgcacgtacttaggagtgtgcagggcagggtgtgtggctgcctctaggcctttgcaggcagagccttcctgtccaccccaaggggccgcaggcagcgctaccagctgttccccacacaaaagctgcccgagacagctggaatgctccctgctcctggtgcaaactctcttgaaactcaggggtggggacatcctgggagctgacctcaggttctgttcctgcaaataggtatctgttgctgacccggcagatggcggcctgagccagcccagacgcgctcgagccctggccctgagcagccatcagggggcacctactgagtgactaaatgaattaggaaatcccagcgcttaacagactcaccactcggggcagagccagactggctcccacagcagctcctggtttctccaaatcctcaccagcacgggggctttagtgtttaatattttgctgctccggcagcaaagcggcgttgctttttgcgctaatttgcgcttctttggttactggcgaggatgagtgatcttccctgggtttgattactctgcatgtctcctattcctaagtcctttgcctgtttatctcctggggtcttatatattgggataagccctttatctctttttagatattgactttctgtcatgttcgatacaagcttttccccaggccatagttcctctttcctttccagttttgttagcgttagttgcacaaaagtctgtttttctgtagctgagtctgaatgatccttctcctgccccgttggagccaagtttgcgttcaaggacatgcccattcaccgagggcctgcgcgaaggtgggcactcttcatggtgtcatttaataggcacggtagtcctggaagcagagagaaaactaaggtgcagggctaccactgtccaagcagtagcgggaacagcagggagcaagaagaacgtgacgcgttcctggagcacttaccgttgaccgcgtctgccagcacgctgcaggtacatcatctcctaggattcttgtaatgagccccacggtgggttggtgcttttgctgtgcccacgttacagatgaggaaactgaggtgccgacggtcgcacagatagtaagctgtagaaacagtgggagccaggccttttgactcctgcatcaggagggaggagcaggcttagaacccagggctgctgacacccagtgcagtgccctcctgtccccgctcagagcctgggctggcaaaacccggtagcctgtgaccccatctgtttgttggacagagggccttccaagcaccaaggcctggaactccacttaacggctgcagaaactggggcccagcgagggtgagtgaggatgtgtctccaggtcacttagcacgttagcttcggggagaatcttttgcttacagtggaatttgcagcattttgaggaatgcctggcacacggttggtgcgtaaatatccgtgaaaagaaagaataagcatagtgcctaggaagcccggtcgcccaggagctcactccgggagcaacagttgctccctgcaggcattggagggcttggcactgacgcctcctgttgttgccacagtgtcagggctgcagactcaggttggcagctgtgggtggctactggtcccatgggcccatgggacattgggtggccctgggcctttgctagtcccacttcctcacacttgagcaggactgacttcgccggcttgtgacccatccggcagggccctatgcccactttaacactctgtcattcctgccttagaagtcgtaatcactttttgaacaagggactgtgcgtttccattttgcactgtgccctgcaaatcaagtggccagtgctgttcatcactctttcttctgtgactctgcttcctccctgtggtctcatggagctgtggtccaggccccgaggttgaggacacagggcactgcacagtggccaaaattgggggtgcccagtagacacgggctcccttccttccaggcccaagcaccagcactttctgacagttaactgtctgtcctttatttgggaatgtctgatgccagactgcagatggcgaggaagatggccctgtccatgctggaacgacagacccggtatcaggaatgtgcccctgtgactgccacaggcccgtttggtgcctgagggcagcaatgcgtgaatcccagcctctgccctggggatgccgtcgggctggagcactgctcccagcgtgccttggccactgttccctgcgcggttgtctctggacataaagcacctgtggaatcccagggctgctccccttcctctctcccttgattcatccaacagatctctacccggcacgcacagcaggaccgggcactgggccaggctctgggaccagacaggcacagccctgacctcatacagcccacagtgcactagtcagtccacaaatacctgcacaatgaaagacttgggaagtgccacagagtgagcccgcagtcactggacgttgggctgaggcctggagtgtgggttgcagttccccaggaggaaaaggggccagggcagcagatgcgaagtacctgaggggtgaggacggggcttgtttgggggtgtggcaggaggggcagggtgagggcctgaggggactggaggtcagatcacgatggcttctgtgggctccgtcgtggaggaggggctgtgccatgcagcaggtggcatggtctggtttccgaggagggtgagcacggaagaggcagggagccggcaggaggctgctgtcctgtgtgcagggagagactgcggcctggatcaggtggccatgggaatgagagcagcggccggatcagcccctcagcgccatcgtgcaggaagggtgttgggagtcctggtaggcagtccacaggttggtcagagggggatactccttgcctggcagaaccgtattcccattccaaatcaccgtgaggctgggaggacccagatcacagccccacccggctgcctgtgacagctccacccctgtctggacctcagacctgtcgaggtggcgctcgctagaatcatttcctctgtgggatccgggcctgggaaggtccctgtgtctggcccttttctcaaggacctttcccagatcattctggacacatatttgagtccagctgcagattcctagctgcgagcaatgctgcccaggcttgagccttttttggacgactgcagggactccgtggggtgtgccatgggggctgccttcagcctcctcatgctctgcctttgacaattcacgtggcaggagctggggccgaggctggggtggccaggcttggagggatggagtcaggagaacaaagggctgagatggctctgcaagtctggccaggcgacgtccagcagggcgaaaaggactaggtgctgcccaaaccacagcaggagcacctggtgggctgcggggaggagctcaggggtcaagttgacgaggagttcagtacacattgtctgggttggcggggggcggtctgggggtgtcaggctgggaataagaagcatgatggcctgctcaggtctgcccacccaaatcagagcccacagccatgggcagtcccagccccagcgtgtgcagagggctctggagggcagagctggataacactggccccaggaaggccagagcccccaggatgagagcatctgtcctctcaaccttgcctggagcctgggggtcaggcgttcgctgaggacagtggtctcgtatgggcacactgatgggggcctggcaggtgacgccagcagagatcactgggcccaggtagacacggggtcggccagcagcaggagggcctccaattttataagagaagctggaaattgattttacttacaatctcttcattttaaactgttggcagctaattcaaaatttgtgaaagccgtgtaagggttgagcagcccggggcagtggccgggatgggggtcaggaggcggcctcagtgctggggaccttcactggagcccacggcgctcaggaccgagcttcttggatgtggccagggctgcctcggagttgaaatgtacttcagaggaatttttattttcctttcgggaatgtcaagagaggcctttccagcggttccgtttctgtgaggcgaaacctgcggtcgtcctgttgttcttggaggcagcgatgaagcccatctgtagcgcatcagcgggagccagcagcggggagggtgcagggccccagcccaggcagacagagctgttggatgcggcactgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctgggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatccacatcttcatccatgtaggaaatgctggagtgaaccgagccgcacccaggagcttccctgagctgggcaccaggagcccagggtctgtcctgtctctggatgagtcctgctgccttggcctcagctgaggcctcaggcccaaagctccatggcaggcctgacactattttccttataataagcccccgtcctctttcctgttgggcacccgtgtccccaggggcgggtcacaagatgacaacttgggacctggcggcttactgttctgtgggctgagctggctgctgggccctgtgcgaaaggcacctgtgctcccacctgaaggagcctggggcctctgctctgagggcagaacaagaccctcccggtctccctgtgggaagaaggaccgtgtcagagacgctgtccacggtggaccaaggccaagctgcgggagaggctggggacagagaaggagactggtgggtacctgcccatgctcatgtgttgggggtgtaggcagaccccagggcctaccagagcagccagtggggagcagccagttcctaggcccagcagcatctgtgcaaaggggtccagtagggtcacagtgcccgaattgtgtcacacactccagggctgcccagccctgcctgctgctgcagagcccctgatccccgaggatgaagacaccaggaaggagcaagaagtggcccctgtgccatcagtgtctgtgccgtgccacccctgcttgggggcacattggttttccacatggtgtcctttgaatggaggtgaggcgggccccagccaggccataatcttgggagacggctctacctcagggctttgctgaccccattctgagtcaggccccagccaggtcttgggagatgggacagaaagtgaggggaccccaagattgaattgtaggaaggatctgaactcactggtggaggcagagagggaagatggggatgaggctgatggaaatgcagtctgctcacaggcacaaaggccacatcggcagccctagccctgagcccaccccacagttcctgacccccaatcctcaccctctagagatgacctgtggtcaagcatgaccgattctgccccaaaaatgtgtataaatggcaacagtgacaaatgacgctgctatggtcttgcctctgactttgttacccggttcacttgccatggatgtgaaggattcactttccagtatcagagtctttctgtctacccattcatccatctatccaatcattcatccatttatccatctgtcatccgtccatccattcatctatccaatcatttatccattcattcatccatcgtgtattcattcgtctacccactcattcatccatccatctatccatccatcattgatctccattcatctacttactcatccatctacccatcccccatctacccatccatccatccaattatttatccattcattcatccatcatccatccatccatccatcattcatcatccattcatctacacactcattcatccacccaatccatccatccattcatccagtcagtgtctgcaagcaccccaggccagcgccctgctgggcactgagtatgaacaatctggtctctgtccctgaagagtctggctgggggaaaaggcagactcccagatgaaccatgacaaatgctgctaataggctgcttggcagcccttcctcattgtgccctgttgtgtttctttcagccaaaatatatttctgtgcatctttgacgccatcaacagttgataggagagtcaggcagagggggctatgggcttcagggacagtgagagggagtgtgtgtgtgacctggtagcttagagaatattcttgtgggcttaatctgcacgcccccccgacttcacccatctgggcctcttctgacctcctacaagcatttgagttgcttcctctgaccttttaaaaatcaatggactataatacatatgagtatgaaagtgtgtaatccagtggtttttggcagtgttgtgcagccatcatcaccatctagttccaaaatgttttcatcaccccagtgggaaccctgcacccagagcagtcactccccattccccttcccagctcatagtgaccactaatctactccctgtgtctttggatttgcctattctgtatacttcatagaaacccaattgataatatgtggcctttggggtctggctggagtccttctaaggattgatctaaaagctccagggccccttgtcatgggagcatcatatgcccagcgacatgaatataaaataataatactgcataattccagaataggcagcagcgtgtgtgtatgaagctcgggactgtgagacaggagggagaagtggggactgtggttaaaacagtccagagtgcctcttcctaagggaggcccctcctagttcctgcagtgagatccgtgttgacactgaagtggccttgtgccctgctgccccgccctgggatggcatatattagagggggctccgatcacctctgaactgggaaatgtggagtagtgcaggacacagcagcaggaaccacagctcccagccccaccccagagagaaaggcccatgagcagctggtgcagggactggactggagccgatgatcagatttggagttggtgtggacatggcgtgtcacctctcaggagagggggcaggaagtgaggagcctgaggccaaagggtgagaagggtctgaactcactgctggaggggcatgtgtgtccccagggttgcagcctggctggggcagccagcacagtggtgacaggacaaattagagaaaaagggatgcctttttttttttttgagatggagtctcactttgttacccaggctggagtgcagtggctcgatctcggctcactgcagcctctgcctctcgggttccagtgattctcctgcctcagcctccctagcagctgggattacaggcatgtgccaccacaccccccgaatttttttgtattttttgtagagatggggtgtcaccctgttggtcaggctggtctcgaactcctggcctcaagggatccgcccaccttggcctcccaaagtgctgggattataggcctgagccactgcgcccggccgggatgtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaagtatggaaacagacctatcaggccgccaaaggcaagccgacattgctgtatcaatctcagactcaacagacctcaagacaggagacgctgctggggaaagacaggtcaccgtttaatgagaaaaggttcatttccccaagatgataaagcagttctaaaggtagagtcacttaataaaataacctcaacatatttgacgtgaactttgttagaaatagagaaattgacaaatttatcatcatttttgagagaatccaaccatttttttccaattggtgttggatcaagtagacaaaaaacccagcacagataaggaagttctaaataacacaaataataagcttgacattgatgaattttgcatctgacaagtagaggttatttctttttctcaagcacataggaaacacttgtaacaactggtcaattaagtgcaaatctcacagaaactaaaagaatagtgtcagcaggtcttgttccctgaccatcatgcctgtgagagagaaattaatagcccccaaagcaaaaatccccattatttggaaattaaaaaaaaatacttttaaataattcatgggtcaaagaagaaataatagtggaacttcaaaaatacaactcaatgataataaaagcactaaatatcaaaacgtggatggaaatttacattagaaaagaaaaaggtctaaaaattaaagagataaatttccagtgtgagtagttagaaaaaggcaacattgatccaaagaaaatagaaggaaaaagataatacaaaataagatcagaaatcagtgagacaaggccaggtgcagcaaagtgcctataatcccagcattttgggagtctgaggcggatggatcacctgagctcaggggttcgagaccagcccgggcaaaatggtgaaaccccatctctaccaaaaaaatctaaaaattagctacacgtggtggcatgcacctgtggaaccagctacttgggaggctgaggcaggagaattgcttgagcctgggaggtagaggttgcagtgagctgagagtgcaccactgcactccagcctgggtgacaaagtcagaccctatctcaaaaaaaaaaaaaaaagaaaagaaaaagaaaaaaaaatcagtgagacagaaaacctctgagttctgatcattgttgctgttaggaagattcggggtcagtgttgccagatcctcagtttttcaagataagtcaaaaataggtaattctgcagacaatctctgcattaaaaaaaaagtgtcagtaatctgaatttggcctgtgcacgtctttcctcccagagctgcttctgcacacagcacctcctctctgggccatcttctctgtggccagcttctcctcgatggccatttgtggacaagtctttgtgtgtacatatatgttcattactcttaggtatatgcctaggagaattgctggctcacatgataacacagtgtttcactttttgaggaaacaccaagactgttttccaaaatgtcctgcacgtagtgtccctcctggagggccggggctaggtcaccatacacagaacacgcagagacaccccagaaggccaattcttgtgtctagttagcagggacctgtctctgtggggtggggggctgctggtttctgactctcatctgcagacccctcaggcactggcctcgttgtttaattcataaattggggaggtgatggagggggtctgaggcctgcttttttggtggcagagtaatttctacattgggtccttgctgaagtaggtcaccatcaggcagaaatacgattcctgagactttttggagataacaagttcaaaccctgcctggctgggtttctagcagctctgcttccagtaccgtgtggatgtcattttcacttacgctgtctcacaagggcatgggtggaaagaactctgtttctaggtaagggatggaaggctcagagatggcacaattagaaagtggaggatctgggatttgaacccaggcccgcctgatgcagaattgggctctttctgctacactagcttcaggtgccggctgagccctgggagggaggagtgagcaaatgcatgaggctttgcctttgccgaggcaggacaagctgaagaggtctttctccttccctagagtgagcaggatctctggacttctctcctgtctagtgtttcagctggggctccactggcggaagcaatgtgcgggcaggatgcgtgatgcctgtgggtggacagtgccactgtcagaagacaagccgaggctgctatgggagggcgttagagggtgacattggcctcccatcagccaggtttcgaaagttaggagcagatgtacagggtttgtcacccaactacttgctccccttcttggttaccgcatgaccaacccagtggcctcccagggccttgcgctacacaacactggacagccagaaagcaggtaatgctgcgtcacccacagagggttgcctggggcctgggctgggctggaaatggctctgagaacagaggtaaggagtagatcattgtttaatctttcctttatggtgggtttattgagctgtaattcacatatgctgtagttcagcgtttcgggcgcataattccataatttttactatattcactcagctgtgcaaccatcaccacagtcaactttagatcattttcattgctcccaaaagaaaccctgtacccacgagccatcattccccattttccctcaagaagtgttacttcttcctttgcaatgtggatgccttttatttatttatttttttcttgctgaattgctctgactagaatgtccggtactatgttgaatacaggtggtgagagcaggcttccagtcttacagttgaccatgatgagtacttttggcttttcgtaaataccctttatcatgctgaggaatttcccttctagtccttgtttcttgagtattttttgatcacaaagggtgttgggttctgtctaatgctttctctgcatcaaccaagatgactgtgtggtttattttcctccattttatgaatgtagtgtattatatggattgatttttgtgtgttgaaccactcttgcattccacggataaatcccacttggtgattgtatataagccttttaatatgctgctgaatttggtttgctagaatatcattgaggatttttgcacctatatttataagagacattagtctgtagttttcttatgatgtttttgtctggtttcggtatcagggtaatgctggcctcatagaaagatggatattaattctttaagtgataggtagaattcccagtaaagccatctggtcctaggtttttctttattgggagtttttgatgactgattcaagctctttacttgttatagatctgtacaaattttccatttctccttgagtcaattttggtagtttctgtgttgctaggaatttgtccatttcttctaggttatttaatttgttcgtatacaattgtacataatattctcttataatcatttttatttctataaggtcggtagtaatgtccccacttttgtttgtgattttagtaattggagccttctctctttttatcttggtcagtttggctaaatgtttgtcagttttgttgatctttcaaagaaccagcttttggtttcattgagtcttcttattgtttttcaattctctattttgtctaccttcactataatcttgattatttccttttttctgctagctttgagtttctgttgcttttcttctggttccttcatgtgtaaagttaggttattgatttgagatctttattatttttaatgtaggaatttgaagctataaatattcttctgggcactgcttttgtatgtcctttaagttttgggtatgttgtgtttttattttcatttgtctcaagatttattatttattatatattctaatttatcttgtaacatattacctgacctaatggttctttaagagaatattgttaaatttctacatatttgtgaatttttaaagggtttcttctgtcattgatttctagttttattccactgtggttggagaagatgctttgtatggtttcagtctctttaaggttattgagacttgttttgtgacctaacatatgacctatcctggagaatgatcatcatacatgagaagaatacacattctgccgctgttgagtggggtgctctatgtatgtctgtcaggtctagttgatttacagtgttgttcatgtcctctattttcttactgatcatgtgccggttgttttatccatttttgaaagtggaatattgaagtcttcagctattattgtaaaatggtctatttccatcttcaattctgtcagtttttgcttcatagattttgggattctgttgttaggtgtgtttatgtttataattgttatatcttcttggtggattgactctttcatcaatatataatgctgttctttgttgtaaaatttttggacttgaagtctatcttgtctgatattagtatggccatcccaggtctcttctggtttctatttgcatagcatttctttatccatcttttcattttcaaactatttgtgtattttgaatctaaatttggtcccctgtggataagcatatagttggattatatcttgggattttttaatccattctcccattctctgaattttaattgcagcatttagtccatctgtatttaaataattactgataaggagggactgaattctgctatctgctatttgttttgtatatgtcatattctttattcctcaattcctcaaatatttccttcttttgtgtttaacacattgttttttagtgtactgttttgattcatgttttcatttattttgctgtatatttaaaagctatggtcttattggttatcctgggaattacagctattatcttaaacacataacaattttgtttgaattgatatcaacttagtgtcaatagtatacaaaatgctttgctcctatacagctctgtcttccccaccctttattataatattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtctaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccatcctttcttgttattttgcatgctttgtattttttgttggaaactggacattttgaatgtggagactctggaaatcagatgccccccacttcccggggcttgttgttttttatgtgttgttgcttgtttgtttagtgatttttctaaactatttttgtaaagtctgcattgttcattatatatggccaccaaagtctctgttttgttagcttagtggtcagctagtgatttgacagagactttcttaaaagccagggtaggaagaaatactctcctcgtctttgtagattggttctgtgtttgagcacacctttgatgcttagccagactgtttacaactctgtcttagccttcacttcctacttgtacagaccctaaatgtcagccagaggtgaaaacttttgagtcttcttagaccttttctgagcatgcatctcaccctagacatgtcagtggtagaatcctagattctctggtatgcacaagagctttccaaaaaccttatttcctcaaatatctccttccctaccctcttcctccccaagcctttagatatgtttattgtgcgtcttgccccaactattgtcctgtgccccaggtgtctgcagctaatacatttacctttaaatacttttgacaaacactgtctgggaaaccacttcagtcctggggaagctccgagacagttgaaacaaaggcaagccagcagatgggttaaaacccacaaccacaattctctggatataaggtccatatttctttcttttgagttttcaaactgggagtcattgagctccttggatgtgtaggttggtatcagcaacctacaccaggaatgtggtctgccatcttcatggccactgctgagttggagaataagataatggtaagcaagtaaattaaaacaccataacccactgtcaccaaaattcagtagctgctttcttcattaagcattccctggttgttgtaggtttctggttaaattctggagttccaaaaaagtcgattctgagatttactagcttatttcctgtttttgtggaggggcagaattttggagtcctctattctgtcactttggtgatgtcctctcccttgtcgtatgcatcttatcagaatctttagatttatattaacttaattcctgtgagctatagaaacattactcttatatagctctattcttccacccccatctttggttttttttgtttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcccacccccatctttgtactgttcttgctgtgcaacttgtgttggtttttgattgctgcggtaacaaattaccacaaatttagtggcttaaataatgcaatggtattattttgcagttttggaagtcagagtctgaaatgagtctcactgagtttaaatcagggttttggcagggttttgttccttctgggtcctcctccggggaggatctgtttccttgccctttccagtttctggaggccacctgcattccttggctcatgacttctgtccttcgtcttttatgccagcaacatcaggccaagtccttcccgtgcagccatccctccagtttctctcttctgcttcccccttccccctctatggacccttgtgattacactgggcccatctggctaatccaggataatttcaatattttaaagtcatctgatttacaatgttaattttcctttacatataaccttacagatagataggttctggggattagaatgtgaacatctttggagggccacagttctgcctaccacacagctatatatgctacaaacctaacaattgttgtaattattgctttatataatttcatgcttaaagaagctgaaaaaagagaggagagtacatatatatcaacagtttgccttcctgttgaccatttctggctctcttcatttgttgcggtggattcaagttcccatctggtgtcatttttttactccagtagctgtgtttctgttcacctgctttgtgctgttagtcaaatatattacatttatatattatatgggcccaataatacaattatatacatcttcttctatattattgctttttaagccagttaagggaagaaaagagaagaaatacccatttatattgtcttttaaagttgcgtgattacctttactggtactgtatgtgtgtgggtgtgaattcaagttaccaactgaggtcacttgctttcagcttgaagaacttcctttagtatgtctgataaaatgggtctactcataattctctgtttttacttatctgggactgtctatattgcaccttaattttgaaaaatagttctgctggagaaagattcttggttgacagcttttttacattggatatgccattctgctgccttctggcttccattattaggagaagtcggctggaaatcccactgggattcccacatatgtggcaagtcatttttcttttgctgctttcagaattttctctttgtctttggctttcggcatttttactatgatgtctctgggtgtggatctcttggcatttatcccgtttgaagtttgctgagtttctcggacacgtaggttaatgttttcaccaaatttagggagctttttgccactgtttcttccatcttttctgctcctttatactcacttgcctctttctgggactcccattgtgcatatgttcatgccctttatggtttccacatttttcttaagttccgtttacttttcttcattcttttttccctgtgtccttcaaattgcataatgtctattgatctgttttcaagattctttcttctgccagttccaatctactgttaagcctctcagttatggtgcttttcaactccagaatttccatttggttcttgtttataatttctctttattgatagtctttatttgatgagatattgtcatcatcactcctttacataagcatggtttccttttttcaaagacatatttccaatggctgctttgaaatctttgctgcaaaatctgacagctgttacatctgacatctgggctttcttaccagcagtgtctgttgccgcctttttttctgtgaatgagtcatttgtgtttctgttgtgtgaaactggacattttgggtcatgtggcagctctgcatactgattcccctcccccatctctgaggctgtttgcagttgtttgtgtatttatttgtttcctgatttggttagactgttttcacaaagtctgtattcttcacagtgggaagcctcagctgttggagggcacagccttgagcgtgtgcagggtcatcccgggatgacagtgatttcagcagggctccctatgactgtccctttctctgatctgtctgttacactctctgcttcatttggtatcacacccagctactaggcttcactaattgagggatgattgctctattattttcaacaatgtcctgagacataaattgtcacatagtttgatccaattaaatttgggtagggatgattttgaggccagtctttgaaattcattctccccctggaagagatcctcataacgatctgttctcctgattttttttttttttttccagtaaataagctggtctgtggttcaggttgttgttctcatagagctgtcagcctcctcttaaattcttgccgccagaatcttcactgaagccaccactccaggtattgggcaggaggtagcctctgatcttcttggtttgcctccccctagcatggaatatttttctagcaagcaggctggacttagggtgattaggagcccagcactctcgccctgctgcacctgagacggagctcctgccctgagttagggctgggtggaggaaggtgctccggcctttcggtcacactcagcagggagttaccctctgtcactgggagttggagatgatgagaaacgctggtggcccatctatcctggtgaaatactgtattccttgactgggatctgagggaagagggagccctgtgttcttggccacacacccccagagtggaactccccataagctgaactggaaggactagaagcggggaagagagagcaagtgatggctcaggtgccaccgattcttgctgttcttactgggatttttcttcccaagatttggttgattttcttgaatagatgatgttgcttagtttgttgtgtgctcttaggataatttctagagactttaaattgttgttgatggtgacttttcaatacttttcaccagttatggttgttctgaggggaatgtgtccatggggctcctctcaccaccattccagaagtggaattctcatggcagatgattcctaatctttttttaaagggccacagcaataaggaaggtagaagacactggatatgtcagggtcattcaaggtataattagagatccaaatccaattaagccaagaaaaggaaatttgctggcacacgcgagcaagacagcaggcaccgctggcccacacgaggctgccaaggctcagcgtctctcctcctcctaggacttggctctcttctgcagagacttccttctcagattggctcttcacatacgcagccccaggcctacgctgtgagcttactgagccaggaagggaatatttttttctcccaatgttcagatctcatggaagacccatgattagtctcactccagtcatgtgttcaccccctggaccaatcactgtgctgagggcattgagtaccaggtgtgggctatgtgcccccccaccacagccactggggagtagcatgggcatgaattacccatccaccagagacacattgggtggggcaaggcccttcccgctggcggaaaggggctactggtgtgaaaaatcaacaagatggtcccccacttgccccttttaaaaaatgcgtagagataggtacacacactattttgcctatagtttattttaatgcactgtaaatctcttcgacatactcagaacttaaaaagaaacttcatgtgcattatctcttttgactacacttttcctgcaaaaatggtcacttcctgaaaaagtgaaataaattcaaattgcacaagtaaaagaaagaggaaacttgaattctgcccaaaggaaacttcttcaagaaggctgtgctcttttgattttaatacactgaaattacagaatggcctttgacatggcaattttcatgtcgttttgaacgtcaaattgattttgactctgtttggaaggcagtgaggcccaaagccctgactcatgaaagagcagaataacaacccgaactcgcctcgttttgctggacgtggaagcccggctgggttgatctgctgtctcctcgttttccaccagcgtgaggtcatctctggcagtgtgtgcctcacagaggctggctggggcagcaggtactggccactggtgcagggtcccattgcctgcgatgagggacacagctaacgttcccgaggagcttccaggcaccttgcactctgtccctggcaacacagtgacaaggctttgttcctccacccgaaacaaggcagtggcatggcctccggttctcgaaggttcactcctatcttccgctcacacttcagtttctttgtagtcttgaatcattgttctccagcatattctacagagggccttggtctacctcacccatgcagctaaacccatctattagggaaaccaacactcaagctcactcctgccattaaactctcctgagatttgagtttcctcctctttcacaaaaccggaaatcccttgtaagttaagccaagctcattaacgttgtcttctgcggcatccatagagttctgccaggagagttgaaccctgttcctcttccctttaccggacaaaacctctgggagaggtgggctcaagctctgaatctggtgacgtttatggtttccgcagcagtgtgtctattggcatcgcgtatcagggtcgagggtggcaaggcatggggtctgcagagtttctgccctcccccaaacagcaagatccacacgcactgacacgcgtcacgggaactcatttgacacaggatcaagtttgcaaaatttcccatgaggtcgaccatgaccacagctgtcaaggtttccaaaaaggactccccactggatttggccttggtcataccttaaaccttcttttgccagcggcccctatacctgcataatccgttgcagtgttgcattctgatgaccttctattttcccggttcccttttgctccgacctgtgctccagcaaacctgcaggccattgatgctgccgccttgtcacggtctctcacaccactgatccttccctccaccccttacccagcctccttctcttaaactgcaggttccctcattggagtcactcttgctttgtaacatctactgaacaatgccctagtcctggtaaaatgaaactttctacctacttcatgctggcacgggtacccctgaacaaagctcagccctgcttctgctcttgcttacgatgatgttcaccagcaaggtgccgctagcagccagactgctcccctcagtctgtttgcctccttccagatgacttttcatatcttccgtcctctgaacacctccaacatctgctccctatccgcattcacacctgacggcttccctcgtctgtcacctactctcccagctttttgctctctcagcagcaccccctaggtggagacgccatcttcgattcctctcctctcactgtgtcttaaccccacttggaccaggcctctgtgtgtgccactctgccagaggcaccctccccgaggtcatcatgctgctgcatctccctgccaatcctcagtcgccatccctagcacgtggcaggctagtccctcctgctcccttggtgtggcttaccggacacccactttcttggtctaatcacagcactcacagttcatccccgtttcctttgctgatccttcctcttcccgcaccctctggggttgatgcgcccagggctctgtcctggacgctccttggtctccctctgcacccctctgtgggcgatctcattcctcttgttgctttatgtaccatgaaatggctcccagatttgcgtctccagcccagatctctctcctgcacccaagactcatattccaactgcccctccaccttccatgctctctgtattgcccacgctcctgactccagcagaatctgcacctcatctgtctctgcactcttcaaatccaagttccaaggcatttctctacttgccaacctcaatttggaagtaccacctcagcacgcccctcactgaactcgcgctcaccctctccgcactccaccctcggccttccccagctctgtgcacggctgatccttccttccatttgcacagccaaagctctgcagttagggttgacccctctcttcctctcacactgatgagaaacctgttgagaaatctttttaggttttctttcaaaatccaccccgaccctgatcacttctcaccatctccacggttgtcacttgcgtcaagcctttgtcctcttctgatgactttgggagcccccagcagacctccctgcctccccacccccatgtgtcctcaacacagcagcagggattcttttctctaacagctttattgagatataattcacatactatacaggtcacccatttaaagtgtacgattcaatggtttttattatattcacaacatcttctccctccccaaagaccccacaccccttagctgtcgtccttcctcccccaccaccttccaggcaaccattcatccacttcctgcctctctagatctgcctactggggcatttcctgtaagaggaatcctgcactatggtggaagggtcctggggcggtccgtggtcagggatcctttgatgccttctgctggatcatgtctgtcttctgctggaaatcccacagtggctcctgcttcgttcagctcagaagtcagcacccagcacccgggccacctaccagaccccacacgacccagcgcctcgccctgggaccccgtggcctccattttccttctcactcacttgattcctgccatcctgggcctccttgcccttcttttcaaaaccccacatggggtcctccttccgcctggatgccctttctagacaccctcagctcaccctcccacctcattcgagtctttgcttgcatgttcccttccagtgggacctaccctggcgctctaaggctttgtagacagctccccccgcaccacctgccctggcactcgcagaccctgtgccctccagccccttcccgcagcactcactgccctccggcatactcagagcactggcaccctctgttccttctgctagcgtggccgctccacagagcagggagctgcggtgactcccacggtctcccaggagcagtccctgaggggagctggcccctacacagtagctgggggtgaatccgtggacacccagcaggtgaaaaccgggactcagctccctggagagacgtctgcggttccacctgctgcatgttccagagaactagagcagctccaagttccgctgtggcttccttcaagctcaggaggaatatctgtgagcccagagtggatggaactgcttgtttcttccaagccacagaacagcttggctgtttccagagtgcacagcctccccaaagtctctccaagaacatggcttcggtgtgtgtttattgtaggatgttcaaggcctccgtggggcggggcagggggaccccaagttctggttaagtaactgtcctttaacaccgccgttctcaggagccacagctacactgcggcgtgcgtgtcgggagcgatggctgcctgggactcttcagcttgtgggtttgctcttcctttctcaagcaccttgcagtacaagaagcactgggtttttgtgtcctggtgaatccagggatcaaggaaaaccagaggacacagatgctccaagatgcctccttcctttcaccattttccagacaaagcagacagggacacagagaggcccagagcccctcatcaggccccgtctcctttaattccgtcctcattaaaccctgctagactttccaacatgctgaccttgagaatcacacatcgcctcatctcccccagcctcccagagctgggcagcaccgcttaactgacgcgactggatccaggtgacgaagcctttcttgagagtagctgaagtgacactgtcttagtcagtagaggctgctaccacaaaaagcacccccaacaccaggtggcttacatagtgtttatttctttctcatggttctggaggctgggaagtccaagatcaaagtgctggcagattttgtgtctgctgagggcctaccttctggttcacacatggcaccttcttgcactttgtcttcatgcattgcaaggggcaagagagctctctggggcctcttttatgttatttctacatttttaatttaaaaaaatgtttagagacagagtctcactcatcacctaggctggagtgcagtggcacgatcctagctcactgtgtccttgaactcctgggatcaagcgatcctcctgcctcagcctctcacgtagctggggctagagatgtgagccaccacatgcaacatatttttttttatttttagtttttgtagtgatgagggcttgctgtgttaaccaagctggtcttgtacttctgtgctcaagctatcctcccgtctcaaccccccaaagtgctgagattactggtgtaagccactgcacctggccatggggcttctttgataagggcactaatcccattcatgaggccccaccctcatgacctaattaccccccaaaggccccacctcctaaaatcatccctctggggattaggtttcaacatatgaattttgggggtacaaatattcagtccatagcatacatcgaagggggaaattcttttttctgaaaccaggtcttgctttgtcacccaggctgaagtgcagcagcatggactcggcttactgcagcctcaacctctcagggtcagtcagtcctcccacctcagcctcccgagtagctgggactgcaggtgcaccccattacgtttggctaattttttttatgtgtatggagacagggttttaccatattgcccaggctgctcttgaattcttgacctcaagtgatcctaccgcctcagacttccaaagggctgggattacaggcatgagccgcagcaaagaaagtctttttaaacgattctttatcagaggcctctgacagctcattcttgttccccaccttaagcacctctggctttcattgatattgcttgcttgggtcttagggcctcagtcagggcctggaggttgggatttcctggtgaatttgatggttagtctcctggttcacccttacgggagtggctggaacaattggcgtccctcttccccaagcacctgaagacaagtcctgccctttgtgtgctcagagaggagggagggaaagtgatttctgggcccaaagtccaagacttggagggagggaagaccccaaacacagcacagagggacgatgcccatcattgctcccaaggcagctcttccccctgcctgggagcggagctgacctcatggcagagggctaggcagagtgtggttaatatctcacaaggcacaggacatctggaagctgagatgtgccaagaggctttgaggctgagcatatttcagggctgggatgggagggagattctcatctgtttagtggcagctagaccaggagggcacctgggaccaggaccaggctaggtggacatgagtggtcacaggaggctgaggctgcagggtgtctgggaaggcacttggccagatgcagagggcaacccatgccctgagggtgggggcactgttggagcaatcccagtgcagggagacccccaggatctagcaggagctctgtgcagggctcacatggttcatgggggcccagcaacagagaggaccctattggcaaccatcagcactggattctgcctttggtctgagcagaggtggtccaccccgcttcccctctccttcctctctgcccttcctctccagggcaaggcctggcctaccagcactttcgttggccctgctcagatgcttgggactaggtgggaacaaggccctctcctatgagagttcctggcagcaccaacccctaggacctgagacaaaggggccaggtgagtttctttaagggcccctcgctcattcgatttggggtccctctgatttccatgcagcctgggacttggtaggacttggacacacataggctggcacctggctccattggtgtgaaggcgtcagttctgtcccacacaccctgagcatttcatgctattctgaggcatgaggatgagctcgtattcttgctccttgtctattccttcatcccattgtgccaaaccttcatgagcctcctctcagccaaggcaggtgacccagagatgaatctgatgcatgattttacccctggagctcatggtctggttaggggacttggaaactggtgagcttatacttctgcatgatcagtggtttaaaagaaggaagcacagggtgcttgagtctaggagagagagtaacttgctctctttgcgggcctaacgagctgggagctgggttttgaagactgaataggagtctgccagaaagggcagggcaggcattctgggcagagtgagcagtgttttctcggacccatggctgtaagggcgttgcgggaacatgagcaggtccctgggagggttggcaggcaggtcaggcccatcaggaggccctagccagtgtgctcgcactcccgcacgggtctgctaggcttgggaagagggaggtacagaggattttaatgggggcaagctcaggtgaggactcgagctacagggagtgaagggcagggagcagcagcggatggggccaggtctgggaggaggctgctgcatccaggtagagggaggggctgagctcatcatggacggggagatggggaaggtgccaggatgcggtgactccttggatgtggagatgagatgggcacagcagcaatggctgatgggttggggtagggaaaggtgacaggtttgtttgggacttgttggcatgaaggtgccttgtgacaccccaggggcagttgcaggcagcagggggcggggtctggagcctggggaggtgcaggctggaggtgggtcggggggcacctgtcagcaggtccatggtcatggaggtcaaagcagcaggtgtggagcaggcagagaggagagcgagggtgaagccctgcacacggaagcccagtcctagtggatgagcagcgtccagggcacggtggactgggccccacttcctgtgggggtgcagcctccacttctctctgagatgcatggtgaggccttctccatgcagagctggagaagtcacctgaggactgcccacctgggtgaattcaggcagagcagcaggaatcccccacagagcaggggttaagcctcgagggctggtgatatctctggcatctgatggggagggcgcctgtggcaggagagggtctcttctggcagagagcttgcatgaagtccagctgccctgagccaggaagagttactgggaggacattaggaaacctgcagagtccacggggagtcgggctgtggaagggcctggcagtcggggtcctggacacaggagggtcttaaccattgtgaccaggtgtttagtgacaccactaccttttcctcttctggctcctgcggctcaaatcccacactctgtgagggagaggatgtttggcttggggagggctgtgtgcatgcagggttccaggaattccaggaaataacactgggctgctgctctgagaaaggggagaatggatgctgggccacccccagaccttggtgcctggtccttggggacctggagatggctgctcagcggcttgagggcttcagtgtagtcagtgtagtgtgtgtttctgtttttttgtttttgtttgttttgtttgtttgttcattttgttttgttttgaaacggagtctcactctatcactcaggctggagtgcaatggtacaatctcctctcaccgcaacctctccctccgggttcaagcgattctcctgcctccagcctcccgagtagctgggattacaggtgcctgccaacacgcctggctaatttttgtattttttagaggagacagggttttgccatgttggccaggctggtcttgaactcctgacctcgtgatccaccctcccccaccctcagcctttcaaagtgctgggattacaggcgtgagccaccatgcccgggctgtttttgtttttaatgtgacacattttaacaagcatagcatttaacaaagcagataatatgatacaacacatacacacaagatacactgtcacagtcatgggagatggcactgatgatgttcagtcagtatttaggcaggattggaaagaaaaatgtctctgctgtgttttgcacacttgtacacagacacagaagttttttattccaaaatgtggagttatctgcaactctgcaaattatacttgatatttacttttcttgatatatttgctgaaaaacgattctcccagtaaacagtggtgatttctcagaacagtagttatttgtcagcagcctttaactacggcaaacctttttcacttgagtttgaagggtgaacgccttcccgcctcccgacacagatgctcatggtcgtgcataatttcatgtgcttccattctccagacttgttggaaatgccatattttatgcttgtaattagtcagatgagccaaaggatttgaaatttaaacatttgaaccctaagagaatcttgaaactttaaccaaagaaacagaagaagaatgtatacaaacatgggaattgcagttcaacagccctttattaaaaaaaaaaaggtattgtgctggcagtggaatcaaagacaaaaatatgatcatcacagtctacaaggcactttaccgatctactcatcctcatcctgatacagacacgcgtgggaatcgtctgagtggcaggacctgcagccattgtcacccgactttacagatgaagcagctaagaaatgactcaataaacttatagtgatttgcttgacatgtcagagttaaaatgtaacagccccagaaggagtggcctagcacagcgttcaagagcacagactcttggtagccatgccagggttcatatcctggttctgacacttccgagcagtgtgaaattgggatagcctttctcagtttccccatctgcagaatgaagataagcatcacagctaactcacacagctgctgcgaagaatcagtgggcaactatagacgaggtgcttggaacagtgcctgagccaccttaagagcagtatggatgtttctgtctgtcagggatcccgtgtggcttccatggcgccgcacttgggcatagtcggagatttgataaaacattggtgcaatgtaacagccgcacacaggtgcactggcttagcaaactggagtttggattaatttaatcaaaaccaagtgtcgagagggcaccaaagtccaggataaacgtggaatatcttcctggagcatcgattttactttaaaaagatgcactctatttcataatgtaaaattgacactttttaaaagacagaatgcggaggcaactgtggagttctcatttttggcaaaagctgatacgggttctgccttcactctctgggatattggctaatttcctctttttttttctttttcttttttctttttttttttcctagagacagggtctcgctctgtggccccagctggagtgcagtggcacaatcatggctcactgcagcctctaactctggtactcaagtgatcctaccccctcggcctcctaaagtgctgagactgcaggggtgagccactgcctctgctgacttcactattcactgcaccgagaagactctcatgtgtatttataacaatttggataaaaattttggacattgatccatgtcagctgcgagacagggaacgacttgttatatgcaccaatttgtcctttaattacttgttaagctttgatttgtcctattatcagaattctcatcctcttctctgcaagtttatgctcgccatggtaggcgactgtagaggtcaccggccccttacagttcagcaagtgtggatttgtgcagacaccgggacgccatcagcacatcgaggcggtagacactcgtcttctcccacggtttccttctgtcccttcatttctgttgctgttgttgtttgcttttgtggaaagaacacttaacgtgagctcagacctctcagagaatttcgaagtgcacagtgccacatggtcagctacaggcacaacgttgtacagcagacctctagtacttactcgtccagcatcactaaaactttacacccattgaacagcaactccccatttcccgctcccccagctctggcagcctctatggtgtcatctgctttcatgcgtttgattacagatcctcatgtgagtggacgagtgccgtatttgtccttctgggcctggcttatttcagaatgcgtgtgcatgcggggagggggtctgcgtaccattacactgtcactgatgtggatgtgcaatacaggcctgggtccctctcatcttttggtagcccccccggctttttttttttgagactgagtttcgctctgtcgcccaggctggagtgcagtggcacgatctcggctcactgcaacctccgcctcccgggttcaagccattctcctgcctcagcctcctgagtagctgcaattacaggcgcccaccaccatgcccggctaatttttgtatttttagtagaaatggggtttcaccatgttggccagcctggtctcgaactcctgacctcaggcaatccgcctgcctcggcctcccaaagtgctgggattagaagcatgagccactgcgcaggccttgataaccctattgttttacaaaatgaaagagtgcctgacagtacatgaatggtggtatgttttaggtacatgcgtgaaatggaggaagtctgtatagacgcagacacaccgcagtgcagtggtgccagccaaatccacgctcccagaagtgagacccaaggtgacagtaactggacccaagtatccccaagtctcaccgtctctgtgtgcctgtgtgcacagccctcccgggcataacgtcaagcgtatgtatttgatgtgtgtttgaggctgggtcttgccctggcatcagcagaagcaggccctggagcgcataagtgaccaccagacctgcacaccctctgcacagctgagcatctcggcatcaatgccctgtgagtgcccagggccaggtaggcactcaggaagcctgcaggccctgggatgtccagaccgcactttctggtaatcccacattgcccatcctctgcctctgcgcatcccctccccccttgcccccgagggcaccctgcctgcccacctcacgcccagccctgcccagcctgccctgccctcctcccgccgggaccacctctgctaaatcacttaatccggtgatatgtttcctctggcaggccaagcccatccctcctgactctcagggatttgattatagtgttttctaacaaagtcaaaaacagatttccatgagaggcttatagctcagtaattctatggtgctttggtgcagtgtgccaaggcgcagggatgtacggggtcaggatgtcgagagaaaaggtcacaaaattaaattagaaccaaggagggtaagccttggcaagagaggcctgtccggccagctgacaggggcatgcgccctggagaaccccgagaaaggggagttgtgaaaatgagccatttcacgcctaattacgatttcccataaggtacttaggagggatgatgtgcgctggacttggacaattaacgtaattaaacattcatgctgcctgcggcccatttcctgcctggggatatctttggaagctgaagcatttcttttttcttggaggtgatttcaagaatggctgcagaggaagggcttcctgcggggctgggccttgggggatgtacctctgcaccccagtggggcaggacccctacaaagagtgtttcttggtggcagctgggggcctgggggccggggaaggctggatgccactgacctggaattacctctccgtcgggaatgggcagcggggtctcatgtttgtggagtgggcagcggggtctcgtgtttgtggaattacctctccgtcgggagtgggcagcggggtctcgtgtttgtggaattacctctccgtcgggagtgggcagcggggtctcgtgtttgtggagtgggcagcagggtctcgtgtttgtggaattacctctccgtcgggagtgggcagcggggtctcgtgtttgtgactctgcctgtgttttgatcacggccaagtcacttaagcccagattctctggcgtcccctcctttcctccgattctctgacagaagcctgtaaggacttccttggcttctctgggcctcaggttttctatgtgtcttacttgtggacactgatcaggacactgagggtctgacggagagagggtggcctgaccgaggtgcacagctggaggtgcctgaccgaggtgcacagctggaggtagctttgctgggaccagaacccagggcacttgctcacgtgctggctgtcacctctcaagcacaggccgggggaggagctcaggatccagccagactgactgagctgttctcaggtgaccgcacaccacagacttcagtgcagactggcagagcttcggctccctcctctgggaaggagcaccgggcttcctagctccagagttgtggatgctggatgaggaggccgtggtgaaggcaccgccccgggtctggagccccacaggagccttccccagatgctccgcaggcagtggatgtccgctggctttggttagtgttctgcctgccttaagggcaggcacagtcggcccagccgcgcatggtgggttctggggctgggggcacctccaggtctcagggcacctgccttgctgccgagagactgcatcaggcaggaggcaaggcagtggccggcataagagctgggccttgctgcggagtctccttccgcttcacacccacactggttttgggctatggcaggtggagcagggaggagccagggccccggaggtcttcaggctggggcaagtccacccccaattctgccctgctggctggagaggagaagaaaacaggctggtgcccagactgggttctggtggagtgagctgagtcaggaacagccctgtccgtgcacctggcccgttcctgtcacctctgtgggcctcaggttttctatgtgtcttacttgtgggctgtggccagcatcgttatgcctacttttcagatcaggacactgatctgtgtgcgccactgcggtgctctgcagctgattcatcctggaggccgcccacacctggggcctccggcccaccctctctctgtgctccagaccactcctgcctgagtgtctcatgggtgtctgtccttgtgtccccacagaaatctcagcccaacacgccccacacggccttctcctcctcccacgcggctcctcccgagggtcccttgcagggaaggcttcccagggtgaccggttgcccaggtcagaaacccggaatcctccctggccccactttctgcacccaagctgtgactccccctctcagtctttgtccacacgctgcctcccctgccttccaccctccttcctggctccctctccagccccaagccagggctgccctgccccctctagtctctctgcacttctgccctcctcccggcctcggccatctctcctctcctggccctccctccttggcacagcaggggcttccctcactcccaggccctctgcactgctggtcctgtgggccgtggtcaggaacacccttccccctctgcctgcctctcagccctccccatgagcgtcaggttccctctctgtgtctgggccctgcagtcctagagggcatctggggttgaggggatgctggtcctgctcactctgtggtcccagcccagcaggctcatcatcactcaaagggccccagctgggggccctgcagcccaccagatactgccgtgccagcacccagagccaggccaagcagatcggtgccagaccagttccaccccagatcacagctgggccttgactgtcagggtggcccccttcagctgccaagtgtagagtcgtcagggagcaggccaggctgggggctccctctgcccctgacccctgggggagctgctgggagagtcctggcctctcctgcatgtgcgtggcttgctttttggctggactaaggattgcagccatatgaaatgctcattgctgtcctcatccccctcccattggctgtcctggaagtcagctcctttctgcagggcagccactgcacacctttcttctgtgtcctttcaggatgtcctgtgcacacacaagtatatatatatacacatatgtgtacacacacatatataaatcctaggattagaatctctggctcaagggattttgtgtcctgtagatactgtgttttcgtttttctgactttttcctgcacactgtagactacaccgtgtgctaccctgcatttgcgattatcagggaacatgtcttggacgtcgtccacagcagcccctccagacctgcccattcctcctgctcaggcattccatcctgtgaatcacttgcttaaccagaccttgactgatggggacgttacttcttttcaccgtttcttataatgcagccgtggatatccttacacttatttccttggctacttgtatgaggacatttgtaggattaaatttgataactagaattgtggattcaaaaggtttgtgcattttcaactttgataaggatgaccacaaccctaggatggttggctggatccgtttctctcagcatgtacccctgatccgtacatttttatttggacaatctgatgcaggttgtttctttaattaagggtgaggtcgagcgtcttctcatacactgaaaagctgctcggtggctcatacccgtaataccaacactgtgggaggccagggtggatggatcacctgaggtcaggagtttgaaaccagcctggctaacatggtgaaatcctgtctctactaaacatacaaaaaaaaaaaaaattaaccaggtatgatagcaggcacctgtaatcccagctgcttggaaggctgaggcaggaaaactgcttgaatccgggaggcggtggttgcagtgagctgagatcacgccactgtactccagcctgggtgacagagactctgtctcaaaaaaaaaaaagaaagaaggaaagaagaaagagaagaaagaaagaaaggaaggaaggaaggaaagaaggaagggaaagaaagaaagagataaagaagaaaagaaaagctgctgtcttttcttttctgacaattgtcccctcatattgaaatgagagaagttctcttgtcctcctcgcagggcgtgctatgggggtgtggcttccttcttcagtgtccctctgctcaaacctctgggggagaatacagacgggcaggctgtggggctccgaccccacagcagtgtctaggggtgaatgtttgcagcccctgaagccccagtgggcgtgtgctgcatgtgctcttttactttagctgtctgtaggcggcttgtgttaaccagctcagttagaccctctaccttgtcgcaaggacagagggctttctgtatctcgggttcttccttgatgtcctggaagaatcagatcacacgtgggcttggagaatgagtgcgaggttttattgagtggaagtagctctcagcagatgggggaagccagaaggaggatggggtgcaaagggctttccctggagtcgggccgctaagcagcctgggctctcctctgactgccccggccaaactccgtgtcgttctgcttctgccggtcggtggcctgcagcgtgctggtgctcgttggtgcgttcctctcgacgtccagccgcctgtgtgttcctcccctcatgcgctcctctcgacgtccagccgcctgtgtctgcctgttagggtctcgggtttttataggcacaggatggggacatggtggaccagggtggtcttgggaaatgtgacatttgggcacaaaggcaagagtgcctgtcctcacataggtccgtgagggtggagcccttagccagggaccatgcacttccctgcttccatatcatttaaagggagcatgcccttctctacccagcacttttgtatcaataccgtttgtccatttcccttttggattgctggattgtttcttgttgatttgtaagagcgctttatgtattaaggaaattagtcctttgtctgaagcgcacatgatgtgggtgagcccttggctgtgtggggctgaattgagagtccatgagagggaggaggagcctggtgcgtgctgagtgttagttgccgtgtggataaccagggagtgttcctcaggcccctgcgtgaggattccaccataaaacacatccatcaggagctgtccttcaaggtgggaaagggatgtggagaaacaagtggggcgtgaactgcggcccgggaagcttcagccactgtgaggcagaggcaggtggactcactctggttggccagaacctactgtgctcaaaacctctccaggccagacggaggaggatacagggaaacggttgctcagggcgtggagccgaggtggcagacagacctgaggacacagctttggtctgggcgtggagctgaggtggcagacagacctggggacccagctttggttcatttcacaagcagcacagcacctacattattcttaaattgctttttgccagtatttagagatcagagacttcacatgcaaatccagatttctcacttccttacaaaaataagacccagcaacatggacctgcaccctcctagtcaccactggccaccttgggctggaggcagtgtgccctctcatccccctgcccacatggcttttctcatgggagcaaaatatttctcagtgaagagggaataagcaaaagacaagccaagagggccgcatgctccaaggaaaattgggagagtatatttctttctggaaatgcggaccgtttctctctgttcaacatgtgaacaaaatatgtctaggtcagagagatggggcatcgggaaacacgcccagcctagcagggacccacaggtcgagggtcagggaggcccgagtgagaattgctgtggtgtgaggcctgcggccggcagcgtgttgtcaggatggcgcctacggatgtcaggatgtgccgggagccatggcgacagctcccaagaaaaagaggagaagacggtggtagcgtgcacccaccgcatggctgcagtaagcgcacagcatccacctgccccgctgacctcacgccgccctcatgctctccctgtaaatgacggccaggaaggaaaccgatgtagactccacggccaactgctcccaccaaggagatacagacaatccgcccgcatccacgctgcgcctcgtcctaccctgtcctgtctccacctgctcagaagtagcataaggataactaagttttccatttatccaataggcgtttttggcccgtttatttattcattttgccaagccccatgtgggtacctggggacttagagaggggtcaagggccacctcagtcttccaggagttcactgtagagcctgtgtgtgcatgtgcacgtttgtgtgtgtgcatgtgtgtgcctgagtgtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtgtgtgtgtgcattcatgtgagtgtgcatgtgagtatgcgagtgcattcacacgtgagtgcatgcgtgtgcgagtgcattcgcgtgtgtgagtgcattcgtgtgagtgtgagtgcattcgtgtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcgtgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagctggttgggagcacaggccagagggccacccacccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccctggttggggaggaaaggccctgtgaggctgccttggggattaaattttcaggactcagcactcactctgatttctgatttcctcccttctcgaaatagggctgatcaaattaagccttgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggtttccctgccccctcaggaggcgcaggggcatgggagcgtcctggaggatgggacatcagggcatgggagcatcaagaggccccaggcctcaccacccttccacccccagcatgggggagggctggggtggtccccggggttgtcctcggtcactcctgctccttgagcaggtcctggtcagacatggactgtgcttggtgccacgactgaaagtggggggtctttgtgcccaagggtcatggtgggtgatggcagcaaggtcctcagctgggccagggccctggtactttcagctccctcttggctgctggaccaggtgcaatcaccaccatgggccattggaagctcgggatgcgggggacagagccagatgctggggtcacgcaggggtgcctgttgcctgggcccagggcttgttccctcatttgcgtaagagaggtcccgtgcccactccaccggctaccatgaagaagaaacaggaggtgtgtgaagtccctggtgcctgggcatctgaggaactcttcctcctaggaaggcagcttggtggcacagtgtggcccaccgtgcagggctgccccaggtcccacaatcagctaggaagagcctgtgcttggctgcagcaccccagcactgctgtgtgcctggactcctgacctagaggggtcaggaaggaggagggagcagaggcaggtgctgagtccctgcacgtggctcatggccgggtaggagagggcctcatttgcacagggtcgggcagcatctgagacctcccgcttgtgttggctgcaagctcttcccaggggaccaggacctcacccctgcagggcccacgcccaccctgcatgaacgcagggctcaacatcaaaggacgtgaaggccacaacaagggaaactgaggttggcaggtaaagaaatgccttggaacttggatttgaagagtgcagagatgggggaggcgcagatgctgctggagtcaggagcgtgggcagtacagagggcatagagcgtggaggggtaggttccagagaccctgaggagtgaggagggagctgcctttgagggagggggagaggcaggttctgctcctggcatggacctggctgcatgcgggccccactccctaggtggacgatgcagctggcagtgcagccggaggtgcacgtgcgggcagaggaggcagcaggccctggaccttctgagtgtgaggtacctgaggccttccggggagcaatgccaggcttccagatgatgtccaaatcaggggctctggagcatgtaccagactggtgacagggattttccgcctgtcatctgctgagccactggccaagcctccggccacatgggtcccgtggcactggctgtcagcaccccacttgccggcccccacctcctctgcgttcagaacacaacccctgggaattctcccttcctttgggacccgtggggatcttcgttttgttctgaagttcacagtgaatattttcaataaaagacctgccggcctctccatcggcccccaccacttggctgccgcgtgctgcggtgcccccgtgacattacccaggccagctccccttccctgggccaactgcccagcagagggaaggcttggagccctgggggctgtggtgagtcctggggaccctccctggcttaagcagatgctaggcaggggcagggcttgctggctcttgtcacccgccccagcctctgaaggccccgagacccccgtgaatccttggaggtgagtgggctgcagaggccgctggagagtggcacggggcaggtgcagaggagcctcggtagttcggcgggtgctggggggacgaaggggaagttgtgtttgggaacctctgtgggggctgtagacaggaggccccagccctggggtgaagagggggaagttgtgtttgggaacctctgtgagggctgtagacaggaagccccagccctgctgcaggacacctcagaggggctcgcacagctgctggtcactcagcatggccctgctggcttgggctcaacctcagcagcctcacacctctgctgggcaccatttcccaaggacacgtatctgggagccggaccagagcctggccccttttctggtcatagaccttaaatactgcagaccttctcctcgccccacactgggaggtgcaggcacagggcagaagagagtggcctggtctgatgcctcaatcgttcaagagagctgtggctgcaaagccaaaccatggtgtctctctcaggccagcacatttggctgtgtctgtgtttgtaagggcacacaggactctcgtggttgcaagagacagagagctaaatgaattgacctgaagaattaggatgtccaggggtgcatcaccttcagccatagctggatttggggacctgaacagtgtcagcagcacacggggctgccctcatctctcgcctctgctgctcctgggggaaggaggtacttagcagtcccagagtcacattttcccagcagagaggaaagcacgggagtcttcctgtgcacaccaacacacagcatcaggttccagtggcctaacaggaccccttgggcactcctggagctggggtgcagtgggattggctccccatgagccatatggggtgcaaataggggagggtggtttactagcagaaaaggtgtaatggccagacagggcaggccaccgtgctgtgcaaccccaggtggctctgtgagggtgtgcaggtgctgggcaggccaggaccttctgtgtccaccactgaggggtgtcctttgtcctctgctgtgcgggggtatgttctgaggactggcccggagaggccttctctcctttagtgcttcctttttctccctgaagcacggctgaggctgagcaggcctgggctggagcgtccatctgtccgcggggcagcccatcccgtgggagtttagagaactgtcaggactgcccctgagattcggcacagcggttcctgatgcgctcctgatggccaggccggccccaggagcccctccccaccctccgatccacctcaggtcataaaaatggcattggatgagctgtgtctgttgaagttgcaaaaattaattcaaagtcagtaataaagttataaagggctgggatgtaataatcctaatgagcatcttttaataaagtacaccagtggggctctgtgctgatggcccccgtggggctgagcctgccttctgcttcccagagcctccaaagagcctgcctgcttccaagcagggctttctgctgtgtcctgattacacttccacataaacatatttcatcttaatgattatctttaggggaatacacagccacagagcgactctctcttggttagtaagaaatggaggggatgaccttgttcccgttgacctcccctgggtggggctcctcatgttggaggagaggctgctggtgctccaggctttggtcctcctgagcctggtggtggcccctgcaggccctggcagtgcttgtgtgcaggaactgggctggcattctggcctggccatttgccaacatcatggccttagtctaattccctgagcctccctctcctcttctgggcagtgtggcagttctggctctgcagggcggtcattaggacttacgttttggggactcctaagcactggaaaaaggatgacttgttcccatccacatggttggcaggttgaggcagtagcacagcacctctgtctgtgtgcaggtgcctcagtgagtgtgccgtctgccctcaggccatcccctacctagtgagtgtgccgtctgccctcaggccatcccctacctagtgagtgtgcctgtctgccctcaggccatcccctagtgagtgtgcccatcccccccttgcgccatcccctagtgagtgtgcccatcccccctcacaccatcccctagcaagtgtgccatctgcccttgcattcagccagcagagtccagcagagtgggaaactgctcacaggggatggggcagctaaggagagggctgggaaagagccctaggcttggaacccaaagcccgcccaacagcaagatgataaaaaggtgcctcgctacattttcttctagcacttccatgacttccttttgatcatctcatccacttggaatctgtttttgcttaaggcatgaggtcaaaatttgaccttttcctccctctaaccagttgtcctaacatcattaaaacaaagaaagaaacaaaagccatttatctccccagcctgctctcttccttctgattttctcctgcagtgagcaaccatttcaggtgatcaaaccgtatcctttccttagtgtacatttttgcaacatgagtgttgctgtcttgcgtctgtgtatccataatttatgtaagtcgctctgaattgtgtctcattctgtttcttaccttttgcacttggcactctgtttttaagatccatccatctatgtagatatcaaacttctaaccttggtagcactttgtgggatgcccccaccacatttgcttctcctctcacccactgatgacccccgtgttgtttccagctcccctcactccacccaagcaatgctgcaaggggcagctccccattgcctccttacagacctgtgcaagtttgcccatctgcaagccagtccatggggccgaacaatggcccatgggccaagggtcagtccaaggagggcactgggctatccgatagacatcctgtatctttaggatatgagccgcatggtgctcttcctcatgatcccctcagtagtgccagactgccaggttgtcccctcctgctccacctccgccgtttcctagcaccgtttgctacctgtatcatttactaattttattcactgtattgctacttgagcaactatttataattacatgcaaatgaatatcaaagacgattaatattaaagcggagagctggcacacgctggcagtgtaaggagagggcggcactgcccccgctggatggaggctcccggaggtgagcagatcagtctccaggtcgtggtctgacttctgcttctccgggaactgacaaggcccctcctggggaagtcgtgagcaaggtctcgaggaagtctgggctcagcacagtcaggcacctggtagggcccaggtggggaccacgcgctggacctgcagcggaaatacggtcagagggagggggctgacctgtacgtcctgcttctaagctcgccacggcctgcctccagctctcggtggggggaaagctggaaacttctgtgaatgttgtgcgtcctcagcagaggaggggagcgcccctcatcggcacatggccaagccaagtactgccaagaacctaggccaggctctcctgggcattttgtccccgggctacagatggcctgatggaggtggggtcttggtgaagacagttcaccccgtgggtcacgctgctcagtatggctcagtcgctctccacatctggtgcagagccatcacctcagggtcacttctcgccaccctccatgggcctcccaggccatgtcttctgtgttgggctcccgttttctctatctgtgttgggcttccgttttctatatctgtgtcttactctttctttgttgccttttttgtttttgatggtgcacacctttcagtagcttcttgagaggagtgcttgtcacataaatcttttgagaactgacatgtctagaaatgtccttattccactttcatacttgatggggaatgtgtctggatgcagaattccagttggacaatcattttccttcagaattctgaaggctttcctccactgttttcctgcatcgaatgctgcttttgagaactctgagtcattctgattccaattctttgtctatgacctctcctgtaacctgattttcccccttcttattctccgggagactttgtagaatgtggctgtcttcatggccagcctgggattcagctttcttgatgtaccaagtctgttaccacttgcccatctgtttccagcctcccacagttcccttgttgtttcttcccctcctgctctgcctatccttggaggcttgtgactttaaattttttttaaatttctttactgaacttttaatgggattctagaaaggagccaaatcagatatctgtgttcaatccgccattttaacctggaaaccccacatattcttggatctgtttttggaagtttttttgttttgttttgtgtttttgagacggagtttcactcttgttgctcaggctggagtgcaatggcgtgatctcagcttaccacagcctccgcctccccggttcaagcgattctcctgcctcagcctcccgagtagctgggattacaggcatgcaccaccatgcccagctaattttgtatttttagtagagatagggtttctccatattggtcaggctggtctcaaactcccaacctcaggtgatccacccgcctcggcctcccaaagtactggaattacaggcgtgagccactgcacccagcctgtttttggaagttttattcagctccattgatctgtttctttcatgacattgacacaactacgttttcattaatattattttataatacactgcattaatttgaaaaaaatatgcctcctcattgtcattctttttcattatttttctgtctggtgtggtcttccggatgaatgttggaatcactttgttgggttttaacaattatttgatggagattatttggcggagaataattttaacaattattttaacaattattcgacggagattatttgacagagaataattttaacaattattcgacggagattatttgacggagaataattttaacaattattttaacaattatttgatggagattatgccaaatttcttgattcatttggaggaggaccaacttccagtccaggattatgtccatgtagcttcatttactgaggtcttcttttgtgtttttggagaccttagactatattatactactttttgtgtagtcgttgaacattcattagtttttgtttgttcttagatacttgggagttttgctgttatagctgataagctcttttttccactctgctttcttgcgggttattcctatgttcaagaagtcttgatctttgcattattttatgtgagatgaggagtatctgttccttgtggatttggttaaactcttctatggaagcatttctttgactgctctttcaatttcttctgaggttattggtttcttcaggttttctacttgagccatgagtggaatgtatattttctatttagtctaggcctattagaatggtgcttttaatttcagatgtttagggtttagggttttattgttatctctgattttgtctcagtaatggtgattgtgggcacggcttttgagttgtgtcctaatgtgtctcagtaatggtgactgtgggcacgatttttgagttgtgtcctaatgtgtctcagtaatggtgactgtgagcacgatttttgagttgtgtcctaatgtgtctcagtaatggtgactgtgggcacggcttttgagttgtgtcctaatgtgtctcagtaatggtgactgtgggcacggcttttgagtttttgagttgtgtcctaatgtggtaaaatgtggaacttctcccgtgtgtgcttgacaaggtcacgtgttctggctgttgggtttgaacgttaggttttcctattaattcaaatagtttctatccctacctaatgctgtatcagacttgtctggaataaatgtattacagtgctcctatcactgtggccttgtctctccttccttgcaccaggttgaagctttaggagcataaagtttcgtatcttttgtatttttttccatgagttgtttgttttatcagtttatctccttaaatgccttggttggcaattacatggtacgtttctttgccccacttgttttaactcctcctggtcatttggacttggttatgccatatgcaagtaatttgtagctggattttgttccatctcatgcttctccaactgccaccacacttttgctcctgttctcggctccccacccccagtgtggcccctccggccctgctgcacctgcctctccttctatcccagttcccaactccccagaggcccccagctcgcctctgctgggccctctgttcccagagcacctctctgccatggctccaggcccctcacagccctgcggttacctgtggggcactggggacactgaggcacaccagaccccatggtctccatcccccagggttctctatctgagagggaaagtcagttaatgcccaggcaaattcacaaatgagacaagacctgcctgcagtggagtgtcacaggaaggaagagcacggggtgctgtcgggagaaatcaggggagggctgatttcaatttgggatgaaataaggaaagttctcccttaggagctgacatttcagcagacacctgaaggaagagagcaatgagggggcggccatcccatggagaggggacagcagtcggccgtgtcactgaacagtgtggtcctcaggttttaagcatccctgccccggcccctgtccctgtcgtcccctagtggcacgcagtgtggctgtgcaggaggcagatgggggcagaacatgctcctgtctttcaagagctctgagtcccatgggaggcagcgggctcccttccttctgggtctttcagggggcctaaatttggccagcacagcggcagcagcaaaaagggcatcgcaggtgaagaggccagcccagaaaaggcataggactgagcttcgcacaggggacagcgaacacccagccacccttagcactgcaaagcccctgcctgacctcagagcccacacctgcccactgcacttgccctcagcccacacctgcccactgcacccgccctcaggcccacacctgcccactgcacccgccctcagggcccacacctgcccactgcacccgccctcagggcccacacctgcccactgcacccgccctcagggcccacacctgcccactgcacccgccctcagggcccacacctgcccactgaacccaccctcagggcccacgcctgcccactgcacctgccctcaggacccacgcctgctcactgcacctgccttcggagcccacacctgcccacaaagcccgtgcctgcccactgcacccgccctcagggcccacacgtgcccactgaacccaccctcagggcccacgcctgcccactgcacctgccttcagagcccacacctgcccacagagcctgtgcctgcccactgcacctgcccacagagcccacacctgcccactgtacccaccctcagagcccgcaccatcccacgatgctcccgaggttgcagactcagtcccaggttttctcttctctagtctaatcatacttgtttctacaattctcattctcgcaaatcacccctcagtgctggtgaagtacagaagggctccgggcatgtggacaacgttggactcagaggcctgggcgcgtgcccactcctcctctctggtggtgtggcttgtccaagtcatgtaattttcctgctccttggtttgtttccctgatgctgaaataggacgatatgctgatggtgacacgcctccaccttggcgaggggattggatggctgctgggggtatggagctgccactgtgaagggctgtgcacacacccctgcctggagactcggggtgtgcctaggatgctggcagttgcagcccttgcccacgtgccctgtgcactgtggcactgtggatgagcccgtggctactgtgacccacccgttcccctgatggaattccctggacagaactgctgcctcccctcattccatcctctccctgtttattgattgactcttcgatagagtctttttgttccattctagagactctaaaacaggatggctctggagtgcttcccacagtgtcattatttggccacgatgtgagcaaagagatctccagctgccatccaaaaggggccctgagcacagggaatgccaggaactcgaaagctctgtgttacctatttaaaagatgggatcctgccacagacacctcccttcagggtagctgcagcccacctgggtatgacttctggggcttggtcaatcagcacccccagggggcccagtgccttcttgtggggaaggctgcacacagaggaaaggaaggccaagggcagtgtcatcctcctgcctctgcaggagatgggtgcgctgatcactcatccaggcggggtgagtgccgagggatacagcagaggctgtgtgagctcccagtcaccacagctcagcagggctgggctacacagggagctcccaggggaggaggggagagcagcaaatagccctcttctgccttggagggaccaagtggaacaggggctgttagaccaggtaggcaaccagtgcaggtgggcaggcccaaggccaaggttgacttcaaagggatcactaggaagacgactcaggaccacgccaggcccactggccagagctccctatagcaaggctctatttggggaacaggtctgcaagggccagcatgtggtcagagtctcttcatggcctgggttaagcccaatgtgggaaaaactgaggtggcactcgtgattgacagggtcagggtcaatcttattgtggggaaaactgaggtggcactcgtgattgacaagctggggcttcagcctgactgccgggtcttgttgggacagaggaggacaggaggggggctgggccagagctcctgttgccccaggtctgagggcattgcagatccccctgctcttagggcttctccccttgtcctgtccagcctgagcaccactgaggcttccaggggccagacgcagggcgtggctgtcacctgccaggtggcccaggcccctgtcttcctctcctcacccactttgcctttgggccttgggccgtctctctaggcactggtcctgggtggagggatgctctagaacataatttccaaatttcaccccaaaattatcacgattaaaataatgatggcaacaataataattccatttcaggtgaaattcagattctaaatctttagaaacctttgctgtttttaatgggcttgcaacacacagtttagttaaaaactctgcctgctcggcagaagcagcctcaagacgtgccccagcccagctctgtcccgatgcggcacccatgccctcctacggggaatgtctggaggggtccctgcatggggactctggggttagggccaggaggacatactgtgataccttctggtgccagaatgacattgacagtggcaggcaggtggcctggtgagccaagccctgtgtgttttgtctccaggtgtggcccctcaattcacagacccgggctacccctggggtggccccatctcttaattcctcaagagaagctggatgttctagatttttaaaacatgaaatctcccagttttcaaatactatcaaccagatggcaccacgtgacctcaacgagtgcctctgtggtctggttttgccgagggcaccgcccgtgtgtgacccctagtttgacaagggcagagggtaacgcccggcctgttccccagggaggaagagttttcctatggaaattgccatcactctccttcccaaggtgattctgaaggtgagctgtctctgttcgttggaaatgcaaagaaataaatgtacaaaaatagagtggcgattcctcaacccccctgtcaggcttgagttgctggcgcttcctctgggaacggcatggatggccctgagtcatccaggcagctaagtggactgctcggctccccacagccctgcccgcaggcctgccggccccacccctgtccctggagtggccctggaaagtccttgctgtgtacatgcatgtgtgtgtgcctgtgtgtgtacatgtgtgtgcatgtgtgtgcttgtgtgtgtgtacatgtgtgtgcatgtgtgtgtgtgtgcatgtgtgtgtgcgccgaggggacacagaactgtggagctgggggtggcacaaggacccccgaaggtactggaaccccagcagctgctcagccctggccccacttactcctcttctctttcccagccctcaccctccgcctcgcacctccactgtctgtcttggtcttgcccacagccgggctgcaggtttgtgcctgaaacttcatgttcagtctgtcttgtctgagccaggctgcagggtgcaaggagagagcttctggccgagagtcggccatgctgggatgccatgggtctccccatctgtaaaacggaaatggccatgtccaccgagtggcctgctgtcagcactgggtgaggaagcgtgtgccgggatgagggcctggtaccaggctgcctcactgtccgagtggccgtgccgcctgcaggggccttgttctgcctccagggcctgtcctgggccaccctcacagggagggagtgcctgtccctgcctggaagaggcagcaggagagaggcgttgggggtgaaaagtgttgttctggaagactctttgtagagaggtggtgcagcagggacgctggtctccctcagctgcaggggcctcggggcctggccaccgccctgtgggtcagtgatgtcacgatgacctgcagccctgggtctgtcccgggccaggagtctctgaggacctgcctggggaatgccatggagaccctggggctgggacctggcttagacacagagaccagtgcaagggaaagggggcttccaggacactggggcttggggggcggtgggcagtgtggtctggggctgccatcgatgctgcaggtcagcctggccagccttgctgtggccttcagacgggcagtggagggctgggaactgaagcctggtccagggtggtctccaggcccgcaggacacagaacacagcagagacagcactgcacagaaggcagggacgatatccggggcagactccccaggatggcagccccaagtggccaggggcacaccctgggggcaggaggtcagtgcctgcccagggccgactgcagcggagctgccacagaggggttcatcttggtctctgcacaattcaatcaggccagaggcggtaccgttcacctggggagggggcccgggacctggcccagagatgtggggcctcgcttcagtggaggacttagcagaaagttctgggaggggcccaaggagacactggggaacatgcacagcccaggatgggcctcggtttccccagtcataacagctggcgatgacacctgggacaccagtcctttggcacctggcagcccttcgggggagaagaggtggaagggctctacccactccagcgtcgggcagtgcgggcaagggtggctctgcccactccagcgtcaggcagtgcgggctgaggttcccgacctctccatggctgaatgccagccctgggctccataaggcagacggtgatgctgggctgggtctctcacagtctcagcaggtctgatccatcgtgtggaggccactgtggcccctgctgtggctggggttgccaccaggggctggggaacgagcggtcctggaagtcacagaggtgcctgtctgggccctgctgtgtctgagacagcttggcaagtctctgccatcttcctctgcacctcgctttcctctgtaaaatggaataataccctcggttcagggtgctatgagttttaaatgagaggatggccaagctggcgcctggtaggtttgtgtccgggtgggtttgccctgccgctgaagacggtgtcctctccttgcaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtgagtggggtggctgagggggcagggtggggcggggagggtcaaccaggggctgggcaggccagagaggcccagctgggccaggtcccctgaggctctgccgatttccttgttagccggaggtgagtgacacagtctcagggaggcttgctgggtccccaggtgagacaagttgaccatccctgacctcagttctctcgtctgcacatcgtgggtgatggtaacttggtgaggctcttcacaggctaaggcgggtttgtgcaaactccagtcgtttgaatgacaatgtcattcaatgtcccgtcatttgaaaaatatgttttcttgatgtttgccacttttaaaactaaaatcatttaaaaaggcaaccttattttacctgaaaagctaatataatagtaagacataaagtgacgttattcagccccagctggatagccctgccttcttctcgctccaaacagaagccccttttctgtttaaagtagagattcacgtgcattagagcgagggccagacaccaacccagggcccctccttaaagctcgcagtgggaggaattggggagggaattcctttctccctgtgagtctgggctattgaaaggggtgtctatgtgccaccttcgtcttctgggcacctgcccatggtctgcctaacactaagagattaaagaaccacctccccctcattccatacccccaacaacctaagcaggaggtgccaggatgctgaaccgtgtgtgggtggaggctgtgcagacctttcctctctctgcctcatgtggtcagagccactgtggggatgaggggcgtccagtcttcaaaatgcaggctcccaggggagcagactggcttggctgagtcctgcagggaaaagaagggggtgagaaggaggaccagggcacggcctggaatgtgagatgctgccagtggggccctaggggcaggggggtatttgtgggaggaagccggggcttagggagggctggaggtggtgtggaagccgggcaggtgggaagttctagaaccccgtgctgcgtgtccacacctgtggatgaatgaggtcctctggggccgggctagaggcaggcagcagggtgtgcaggtctgctcaggatctgctgcccagctctgcttttcggaccaggggtgagcccctccaggagccaagctgacacatgggtcagagtccccagggccctggtgaaaagatacctcaggggcaggaggggatgtgagtgagctgaacactggacagagacaccaccttcatgctcactttcctcttgaccggtcttgggtgagtcagctagccctctggagcccagccttatccgtacagggggccgaagtccgctgcatcggcagaattcgttttatttgggagagcgttgtcacacttaccctcatcttatttttgaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagcccctactatgtgactgtgccgggcccatgctgggcacttgccatgctaaattatcttgggaagtcctcatgctaggtctgtgagactggcaggtataaaatcttggctgccttcacaatatgagttcttcccctagcattatgtcgccttccaacccagcggggaaaggactgggcttggaattacagtccgatggcgactccaggcctcgccttttccaggcgcgtcgttgggaacgctgctcccgtcctctgagccttagttttctcatctgtaaaatgggccagtgttttcatcgtgggggttgatgtgattacatgagataatgtcagtgaatgtgcttttcagtctctcagtagggtgaacacgttttcagtttccacataaaatgtggttttgttatcatgacagtggcactgtttagtgacagtccaggaggggtcacttctgatagcccaccaagggcgctgaccaaatgtggggcccgtggtgagtccttcatgaggctggcagaggcagatcaacctttctcctggtgcccagggtctctctgtcacaacagctggttggaggatgtctagaacgttctctcacttttgccgtccaactttattcaaaccctagtgatccagccgtaccccctattttgaataatgggaaggttcgtttctagaaaagcatgagaaatttaaaaattcttaaattgagatgagttttatcacaacagagaaaccgttttaggagacaagtctcagaagttgagaaagtatttgggccgtgtctgttgtcccctgttgcacagaagtgagcactgattcattcagcaaacgtgttgacagtgtgcttgtcatgggcacagtgggggtgtcctgcagaggcggcggggcgtggcagagagtcccggggcgtgggagaccggcggcggagggtcagcggggggtctctgcctctgatctgagccccagctcccactgcaagagcgcagcgtgggcgagggagataaggcgcggccgtgcctggagcatggcattgccctgacgatgaatgccctgcgtcctcactgagagcctctgcatgcccggagagtcctgaggacagatctaagctatgtcggaccctttggtggtcttggggaggaggggcattgagcaagtgggagcttctgagaaagggtgaccttccagagccctgctgtgcgacagagcttcccgcggtgctggggagatgctcgtctcgccctttctggggcagtagccaccggggctctggagcacttgaagtgtggctggtgtccttgaagaactgaatttttaatttaacttcttatttgttccaagagaattttaatttaaaaaattttaattgcggtgaaatatacagaacataagtcaccgtcttcaccatttttaagcgtgcgattcggtggcgtaagcacattcatgtggctgggccaccatcgccaccaccgtccacagaactcttcatcttgtaaaattgaaactgtgcccattgagtttcagccctttcctcccctccccccgactcctggcacccaccactccactttctgtttctgagaatttgactactctgggtacctcgcataagtggatcaaacaataattgtccttttgtgtctggcttatttcacttagcatgacatcctcggggccatccacattgcagcatgtgtaagaatgtccttccttttcagggaggaccagtatcccgtgtgtgggtggatcggccacattttgtttatccagccatccatgggcactccggtggccccctcatgggctactgtgaatagtgctgccgtgaacgtgggtgttccagactctgttttccgttctcttgactatatgcccataagtagaattgcgggacacagggtaattctttctttaattttttgaggagtttccacgctgtttcccacagtggctgtgccattttgccccccaccaacagtgtacagggattctagtctctccaaattgtcaccaactcttgtcttttttttcttttttacggtagccaccccgaagagtactttgtttggattaattttcacctggatggaagccgcagtgtggctggcagctgctgtgctgaacagggcagggttgggcctgtgcacagaggatctgcctaccgtgccctgtctctgaacttgggtgctatgggggcctcgaaccacaaccccaagtggccctctaaggcctggccagtggcttgtcacactcctcttgtaagtcccagctggtcacagggctccccgtggctggagcgaaagcaaaagcatggaaggacagacgtggcagcagccggctgggactgggctcccagtgaggtgtttgtctggagctgtagagcaggtggggctgggcaacggcacatccagagcccggggtctgggggccagccctgggcaatgagctgcccactgaactggatgcagagaatggtggcacagcctgtgccctgggaaaggccgtcgagccctgggaggaggagctggtgggggccctgatggtggggacccagggaatgcaggctctgaggaggaggtgaggtggtggcaggctgagtgcaggcacagctccaccctggcagccctgcactgcctcagtttccctcatcatttggggtgacttctgcctgcagagctccctttgggatctctttgtggcagagcctgggctgggatatggggtccaggggtggcacaggcagttcagcctcatcgatcacccctgtgctcccctccccagtctcccttgtagctggtgtggagctgcatggccagttttgcctagtggcctgtgtgaaaggaagtgacctgggtcacctgtggaccaaggctggtaagagcttggagtcccctccatctctgtctcccctgccacggaaaccttggaagccatgtgtcccagtaggtacagctgcaacataggctcgggccctcccgacccaccccgcgccatggtgtgagtaaggaaacacggtgtgcggtgtattgtgttcagctgctgagatggggtggattctcggcatagccatcctcctctgtctggtgcccctggctgccgttcatacgggggccggtgtttatggggcgtctattatatgtcaggcaaggggtgcagctgtgagcatgacaggacgtaaccctgctaccttgcattctgggaagggaggcacagacgatactgaagtgaaaaacaaacaggatcatttcaaataatgacaaatgcaatgaaagaaataaaatagttaggagatggagaaggaagaagggtaggggaaggcaggccactttctacagctcaggggctggtgcactggagatatcacgggagcagaggctcacgacaacggaaggatgtgggaagaggtaggatagggatcgcctgttccaggtttgggggagggggcaggcggcgccaaggccctgaggcaggaatggggccggctggaagaatggaggcagcctggcctgtcaagcagggggcacaggtaggggaagtcggggccggcaaggccggccgccgcagtcttccagaggtggaggggagccgcctgtggctccgggagcagtggaaatcactggaggggctgcttcctgtctatgttaaagacaagacgtgatattcccttttctatgggaaagatgaagctgcccttttcatctcagacttgccagaagggaagcggcttggaaatggagcacttcatgaggccacctgggcacagaaaggggctctttggtttaggcaaccacccacctgcccactccagcagcccctgctgggtccagttttcttatcttcctccttacatctagaaaagcatgttttttggtttattgaaatagtccatatttaacacagatgatttattttatttatttatttattgtgagacagagtctcactctgtcgcccaggctggagtacagtggtgtgatcttggctcactgcaacctcttcctcccgagttcaaacgattctcctgcctcagcctcctgagtagctgggattacaggcatgcaccaccacggccgtctaatttttttttttttttttttttgtatttttagtaaagacagtggtttcaccatgttggccaggctggtcttgaactcctgacctcaggtgaccacccaccttggccttccaaagtgctgggattacaggcgtgagccaccgtgccgggacattttttttgctatgtaaaattagcataaattcctgtaggtatgtgaatgtcttctcccagcagttaattgtctactacgttgttttaatgattgcataacatcgcaccatatgactgtcacacactttttacctaacttattatttatatgacatattcacatagcaaaacttatttctccattagaggtcagacatgccactaactgtatcacgttcatagagttgaatctatcgctcgtgcttacttatttccttaagctgagttgctgaaagcgaagtctctggccaacagatatgcccattttttaagctttctacactggaatgttctctgttatggtttcatctattcccgcttcattgagcaaatgactgtctccccacctcctcacaccactgagtccttttgagcagtggtaatttaattacaacggagataagtttttttgttgtaagttgttatttccttgatgttaatgagcctgcatttaaaaatatacgtgtatttgtaaacagagattattttatttttttgcttggcctattcatgcccttgattctgctgggatttgggggtgttttattcatctgaagagtctgtgtacttaagtagataaactttttgtctgtcacatgtgtgggaaatatttcccccagtcctgttgttgaccttttgttttattccgcctgggatagtttttgatgtcctacatttttgtgtgtgtgaccacagggaaagatcctgcagtctttcccttcccaggggaaaagcttctcccttgggtgatgtgtttgatgcctcctgccctccccagaagttaatcttctgagtttctgccctacttggcagctgtacttcccaagctccagttcctcaccaaccgctgactgttcttgggtttagccatagcagccctccacctgaatttctcccaaagtaagaggaaagataggcttagtgcagtggctcacacctgtaatcctaggactttgggaggccaaggcgggcggatcacttgaggtcaagagttcgagacgagcctggccaacatgacaaaacctcatctctactaaaaatacaaaaataagccgagtgtggtggcacgtgcctgtaatcccagctactcgggaggctgaggcaggagaatggcttgaacctgggaggcggaggttgcggtgagctgaggtgacgccactgcactccagtctgggcgacagagtgagattctctctcaaaaaaaaaaaaaaaaaaaaaaggaaagaaaggtgtggcggggagatagagaattcaaaggagccaatgtattacatgcaatgcattcttatttcccctcaatatctggctgctgcaaaactcgtcaggatattaccagtggggaacactggcctaaaggcagagccagtagtaactcccaggccccaacgcacaatgaaaatgtgggatcgcttgttcaaagagcagaggaaggtgccatacaaagggactattaagccacttcctttcttccttagtctctgtctctctgtctctcaactcgctgttctttttatttgctttttaatattgttctaagtgaacaaaaattggaaccttgaattattagcatgaatttcttattcatctttaaattgtgcgatggctattttaaatgcaaatattagagcatttagcttctatgtggggtcactgaaattaaacaaatgtgtattttgtggctgatccctgatgggtgcctcaggctgaccagaagtttatgacaggcacagccagactcagggaggctgggaggaagaagagaggatttcacagagtggaatcctgccgaggggaggctcctcaggtacggggtcctagcagagtgagtgcacccccagcaggaagggcacacccactggggtctgagagcttcctgccacccctggaagaacacattggctgtgccctggccagggcgtctggggaagtagagccaggcacgcccccttcctactggtgcactgctccagcccagagcgtatggccacggccaatcccatctctatgcaggtgtcactcacgggaggctcacctctgccgaaacacgggctctggccagccatccaccagacatgcccctttcctgccagccgtgggcgggatggccaccaccacgcctgccctgagatgccgtggggaatacatgcctgatcctgcccctgctgggggcagctgaaagcctgtcctggggagatgggaccatgctgcattgccccaggagccttcacttacaaaacacacatgcaagggtgagatgacgaagaacttcaagacagagctgcagagggtcaagccccaaggtcggggccttctgaggataggccctggtcatctatgaagtcagcctgtccctagggcgagcccagaaacctgagccctgcgctcagaccccatagcctgagggaacacctgctgccctgcatgtgccccctggatgccacctcagactcccgttctctgtggcctttccccagcctctgcttgggcatgtccacacacctctgaggcccaggcgaagccagccgtgctaagagggcactgggtgtgtgctgagcctgtggcaggcagggggcgggcccttgtccacagaggctctctgcagtgagttttgtttttttttttttttccttgagatagagtcttgctctgtcgcccgggctggagtgcaatggcatgatctcggctcactgcaaccgccacctctcaggttcaagcaattctcctgcctcagcctcccaagtacctgggactactggcacgtgccgccatgcctggctaatttttatatttttagtagagacggggtttcaccatgttggccaggctggtctagaactcttgacctcaggtgatccacccgcctcagcctcccaaagtgctgggatcacaggcatgagccactgctcccggcctacactggagtttgagcacacgcagctgtagccctcctggctgctggcaaccctgggatgagtctggtctcctgaggctcagcggcccttagcctggtcagagatgctgaggccccttggggatgcccacattcccccgtctaagggcagaggggtctcccttccaagcactgtgaggctaggaggatggagtgagagccgtgggcagatgtgtggcccatccagctttgctggccccccagccccgtcactggcagagtgacttctattccctctgccttcattctgctcctgctcctcccagctttctactctggctcagcctgcagcctccaccttgcgttgctgcctcccctgggcccagccgggaggataaggggctctcctctgcccaggcccgccccccgcccccgagggcattgggagaccactgtcatgtttgacctttcctgcttgggaaacatactccctgaagtactgggtgctgccaggctgggacacaggtgacattgctgaacatgcctgatactgaccctggggctttggtatttctcacattttcaaaaacttgctctgccagcgcctgggctagtctctgctcacaaaccagatgctgtggccatgtgtgtgggcctgggcacccctaaagagtgggcttgggcctgacaggcgaggctgccatgctaggaggcagctcagatgtgtgtggcacctcaagtttcgtccccaggtacagacagggactcttctgcaggctcaggtaaatgggaggcagggatgaatgccttggaagatcagagccgttgtggaagtaatatgtttatatatgcatttttttcttttttgagacagggtctcactcagtcacccaggctggagcgtagtgctgcaatcatagctcactgcagcctcaaacttcagcctcccaagcagctgggactacaggcacacaccaccatgcctgactcattttttaaagatttgttttagagacaggttcatgctatgctgcatggtggactcaatcacctgggcttaagtgatcctgctgtctcagcttcctgagtagctgggatcacaggcacgagccaccacgcctggctacagatacatttttaaaagtaaaatctatctgtgccaagacttcaagaaatataaagcttgggcccaaggctgaagcttcctttgtggcttcaagcatttcactaaagcgctaatttcaatcctactcttcccgagaagcctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagccacgcctattgatttatgaattgcctgtggccatttttgtgctacaacagtgggttgggtagttgcaacagaaaccatatggcccacaaagctgagaacattcactatgaggtgctaaaggaatttttgctaccaggctgtgcagaaatgtacttgcttagtgcctgccttgagctgtgatggccccaggcctccaaagtgagcatgtgcctttcactacatcagtgcacgtgggtgtacgtattagggaagtactgagcacagtgggctgctcagaccccagcccacccccacactagccttatcagctcaaaggaccggtgaggctacttcggggattctttttaaaggatagaatgaactgctcttaaccgctgtagaacggcagagcaggaggagcaggtttccgggcatgcagaatagtctctcccagctgtgttaactgcttatgttctgggagaatgcctgagcccccaaagcatctcttctgctgagggcagacacgctcctaggcctatggagaacgtggaatccaaggatcttctgcgccttcagtcgcggctataacctttgacccctcccagcacgagaacattctctgtacagtatgttctacgaccgttttttttgaatgaatgatttctctctatgccaggattcagatatttttcctcttttcatttctaatttaatccagaaattggcctggacttaccagagccttgccagggtttgcaaacaatccgaaggcatatgggctcaatttctcaccaactttcacgagtgctgagaccgcatggtggcggtggggaaggcagtggtcggacaggagtgttttcagctggtcgtggtggaaatctcgtaaactggccgcagagatgcaaaccagccaggcggaaggcgtcgccccaagtcatagttcacgagtcgctggctctggttcctgggaaagagaagaacatctctgaaactggacacgaaacacgggtcccttaagtggggggaggcaagcggggttcagggtctgctagtggtgctgtggccctgggggtgttgctggcactgtttctgttcctcacgcttgtcccgctggccttacagcctggccctgtgtgccaccaggagacacagccatgagggccagtggtgtgtgcgaggctgcacgcaaggctcagaagagggcagtgccctcacgtgctcacagtagccaggcccgaggggcccaggtggctgaaggctgttgggagtggtggggactcgggcgaccggagaggccacgcccccctgcagagctcctcgtggttccactcgcttgtgtttctgtaggaataagcagaccactgctgccagctcgctcttccatgagaagctggaaatctactttttttgggaaatctaattatttttcaatgtgggccacagattgaaattaagaagccacactgcacaggtgaagcagaacacggctgcaggacaagtctggtgtgtgggtggcctgagtgttctttccagcctagaaggaaggaggcgactgcctgtcctgctgcgccctgtgctggtcagtgccaactcccggggctgttgggagcaccactcgagttgaacaccaggaaagtgctcagtagagcacgggtgtgggaggagcatgctgggattgggagctgtcctcagtcatgttcggcactccctggactcctggcctccgcatccctgcactgggggagctcagagcacaggagtatggggagcgggatcaggacacgtgattacaccttggttcatcagggaagggtgcctggggcggctggtcagggaaggctcctcggacaagggccaccgcagttgcctctaatgaggactcctggtggtggcacagcgcgcgcaaaggcctggccgcatcgtgaatcgcagtgcgcagattgggccctgctggagcttgtggggcttggagagcgggagcgaggttgatttgtggtctacaaagatagactcctctctcttaggaggtttggggcttatgctttctatccttggaaacacccctccccacctgaggaggggaactcacatttgctggttttgcacgtgctggccctgtgcaaggaggcacacctgtgacctcactaccttgccccagtggccctgtgaggttcccttgcctgcatcaggtcactgagactgagagagacatggccagagcacggcagatggagtcacatacctgtgggaaggtggcccctgtgctggtcctcccctactgtctggcctgaagatcgagagctcccaaatcccctagcatgctccgcgggttctcatctcaggcctcactgacctccccacagcatttggagtcccctggccacacccgcctctccccgcaggccatccgctctgcctcttgctttgccttggcttctgcatagatctactgtgtcctcctgttctgaggcccacccgcctgcccactcactcccttagtgcacccggatagagcagccctaggtgctggggatgtcgtggtgagcacgggatccagaccgcagggagcacatgttccagcagggctggggaggccgacagaccagtgatggtgagcaggtggggaacactcgaacaggggtcttgtgggtggatctcacctctgcttcctcctgaaatgtgcagcaccctccccaccagtggacatctccccacctcctccctcctccctcctccgcagacctcctgatagctgatgtggaagcctcccagcatcctgtccttggcctcccgcggggaactgatggttgtcagaatgggagttagagtccctgtggacgaggagggccagccatccacacacccggatgacagcttgaggcagcctcggagcttgtcttgtgcaggctccagcaaggaggtgacagctgaaccacaagaacagaggcgatgatgtgccacgccgggctgtcgggctgacctggcgtgggctctcactccctgaggcccctcccaggctgcccctggagctgagttgcagtcaagcaatcctgggtcttcctccccagtccaggggtctccttggtggtgtgtctcagcagggttagggactcccacaaaggtgactttgtatcggacccagagagggtctgcccacctgatttttcactgagtacctggaaaaggcctggcacgtagtaggtgctcagtaaatctcttttgaatgaataagtgactaaatgaattcccataaagcgactgtgatctcagagactcccataaaaatgaactctatctgtgggtgtggaactcctcgtggctgggtgtccttatgccttcgcttctatgacagaggctgtgtctccatcgtccatgctgacgtctgaatggccaggtcccgggatacagtttctagttgcagcaggtttgccaaattgctcctcagagcctctgtactgactcccatgcccacttatgtgagcctctcaatctctctgtgcctcggcttcctcactggcacagcggggataacactcactcgcagggtgtgggaagggaaagatatcgcacgcggggaagtactcggcgtaggcggagaagatcagagccgaccagcgaggcgagcagttgttcactcggcccatgatgtctgggaagagccccagccagctcccgtcctggacaagcttttttctcatgggggccacctgcttgccttggcacagcgaggacagggccttggcagccaaaggagacggtcagctgtctccacctggtagtggagatagtcacagtggggtgatccttgagctggttttggtcacagagttggtgtctcccaagtggaaagtgggagggcatcattccacacagaggagccccttgtgcaaaagaggtgccagccctcggccaccctgggagcccgctggggtgggagaaggcgcgtgcggctgagcttggccttggtcctgaagcctggggaaacacgggagtactgagcacccaggttgcatcagcaagaatgcagaacagtccctgcctagtggagacggacagacagctaacaaacgaaggcgactggagatcacgatggtgccaggaagttaccaggatgggacagcacccgaggcagcatagggtgccccgtgggaatgttcacagagtgaggaaacttcagagcaagggaaacttccctgcagccagacaggaggaaggaaacctggctgcagcctgcaagacctcccacccgcgcctggcagggagcctggcctgggggctgcccatgctggcccttctgatcctgagcagaagtgatcacggacccttgtgcttccaataattcggcccctcttcctttggttctgggtttcctgtgtagcggtgggcaggatttcatctatctttccatctgccagagtctggcaagggagctaagccacataaacagactctggtggtgcagggggattgtgacctgctgcacagaagggcaaagccgtttcccgccaagcccaagaggcgctggaacatctgctctgggtgttggaaagcaccctgcatgactgcgctttcagggagggatacgctggcagcagacgacccttgccgtgagcttgtaatgcaggacccttcttgcagccttcaccttactcttgccctgcgctctgagtgccttgggggcccctgcccaggtcgaggggcacagtgcaaggtgatggcctgcagccctctgtcatgccttctcagtctctgaggggttcatacctgctctgccagggcctctcccttcttcctcatcatgcatggatgcctggggagtagggaggctggcctgagtcctcctcagctttgctctgaggtggtcgggtctgacgcctgggccacttaggcatgctggacccctgcccagtccaagccctatgccttgatgggtgtccactctacagcctctgccagccagtgccagctacccacgccctggccctcaccagcaggagctgctgcatcccacacacccccttctggagcgaggggcatccatgtgctgcctgaggcccattcattaacatgagatccctctccattctaaccacctgcttggccaccatgtgggttggcctccaccctcagcagagggtctcatctcagtgggaagtggagcccagaaccccggggactatctgcatctcaccctaaggcgggggcagcggtagggatagggctccggctccaagcctggtgtgggctcagcagcccgccccccaccccggcagctgcttgctgccccctcccccacaccgttcctgtcccctgatgccacagctctctcctcccatagcggcattttccttccctctttccttaggtcacactggtgacagagcagcggcagaatatgatgtgtgggggaataaaaatgcattgttctcaaattacatggtggtgctcaaacggacccaggtgaccgagctcagtcacgggatgggccgggccacacagcctctgagacgggcgtgtggggggatgccagggccgggggtggcacgagccctggccacttagggcccctctttgaaaggaaactcctcactgagccccccagggctctgtggccagggacagccgacaagctcagcagagttccagggaggcagggccgtcctgcagccactgctagcaagaatcagaatccctgacttttctcggcctttccctgtcagtggctcgcagtggccgagaggcccctgggggacactgggctctggcctgaggcctcggccgtgtccttctgcgtcctgcagcctcagcagcactggtccttccccgttctgcagcatttccctttctgatgaggcatccggtcagcgggtgggaaggtcagtccctaagtggtggcatggctgttgtttccccaaaggcgacgcagccagcggggagagctccagggctgggtcacactcgcggacgtgcctgggcacagcagcccctccagctctggaaaacacaggggcatgtgcaagctgttcactcagacctctcccaatggtgatggccaggaggagagccagggtgggtgtaagggcgaagcccaggtggaccattctgtgcatggggtcccagggaaacagcttgggctgttggaccctcctgtaatttgatgacagtttcattcagcctgtactaggtgctggggatttcacttttgtcacgcatgtccgtgtgaagagaccaccaccaggctttgtgtgagcaataaagcttttgaatcacctaggtgttgtttttacctaaatcagtctggcctggtgtatgacaacataaactcaaggatagagcccaaaaactcgccaaccaagcaaataattatgctgaacccccttgggcactctctaattggatgtcctgggtcctcccaattcttagtcctttaatacctgtttttctccttttattcggacgctgtgtcttccgtttagtttctcaattcataccaaactgcatccaggccatcaccaatcattctatacgacaaatgctccttctaacaaccccataatatcacctgttaccccaaaatcttccttcagcttaatctctcccactctaggtttccatgctgcccctaatcctgctcgaagcagccctgagaagcatcacccattatctctccatatcacccccaaaaattttcaccaccccaacacttcaccactatttcattttgtttttcttattaatataagaagacaggaatgtcaggcctctgagcccaagctaagccatcatatcccctgtgacctgcacatatacatccagatggcctgaaacaactgaagatccacaaaagaagtgaaaatagatagttcctgccttaactgatggcattccaccattgtgatctgttcctgccccaccctagctgatcaatcaattgaatttgtgaacaatacaccctctccgcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcctctactaaaaaaaaaaaaaaaaaaaaaaaaaaaaaccaggcgcactggcgggcgcctgtagccccagctactcgggaggctgaggcaagagaatggcatgaacctgggaggtggagctggcagtgagctgagatcatgccactgcactccaacctgggcaacagagagagactccgtctcaaaaaaaaaaaaaaattgctcctaactccaccgtctatcccaaacctataccaacgaatggtagtcccaccaccctttgctgactctctttttggactcagcccacctgcacccaggtgattaaaaagctttattgctcacacaaagcctgtttggtgatctcttcacatggacgcacgtgataattttcattgttgcttcaacctgaaacaaccctgagacacagggactattattatctccattttatagataaagaaactgaggcccagacaggttaagtaactggccccaagtcacgcagcaggattgtggcagagcccatgctggcacccatgaaatctgacctcagagtgggaatatcccccccacactctgctaaccccccaaattcaggagagggggaggggcagcctcttgccgtcgttagtacaaacccgggaaggtttgtaatgcgacctgtcttctcaacgtgcctgctggagtgccacactgaggggtgcagcacatctcttgagaccctgctgggctctgtgcattgatgagctggcctggaagtggaggagccccgtccccaccctgaggcatctgcagaggtatcagcagagtgtggacaggcacaggagacgtcgcctgaggagtgagggggtggccttgggcagagtgttcctgcgctgggtattgaaggaggggactctgaccacctcactttttgatgtatgaactgagcctagtaattctgatcctggccatttccgtttcatggtagtttgatattttgagcaagagtcacgtttcttctagcattccctctgaagcatctgctgaggagccgagggtgaagaagatctgcaatgggaacgttgattctcatgataagcccaggctctggcagccccgtttaggcaccatgcaatgcctaaactcttcctccacggaggccagcagacctctgtcccctgctcctggctgcactctcttctctgcctccatcctggtggtccaagcctggcctccgaaggggcacagagagaacagccttctcctcacttatttcagggggtcccagagaagccacagagcagcaggcccccctcccccaggcctctgacagacttttcaggcctggcttgctcctggacatggttttgccaggtgggccacaggctgcctctggtggcccaaagctcagctgagcgaaggacatgggaactttcctgaaggttggggtggctgctgttccagggcccctgcctgtctcctctgtggctggcgggccagtaggcctccccagtagggagcctgcaccggttcccccctttctgcacccctcccccaccttggcagaggacaaagtcacctctgcccagcagccgcaggccacctcccagggctcaccatcccctgggtggaactctgccaccagtgaggcaaactttacattgccatgcagagccgctccttcctcattgtctattccagaacagaaacttggctgcatctttgcataagcaaaaggcgcattacaatgtgtttccccaaacaagagagcccttggcctctctccgcacagagatggctgcggctttgaacatttccccccaaggtttaaagattccaggatcaatttctcagacagtactcaaggacattgtccctgggcttcccctccccctgcaacctgggaaaggagagctgcttctccccagcacacgcaggccttgggtagggtggatgcggaggaggcccccagggctgctggggggaggggaggggaggcccttagctgggggcctcccccatgagaggggtcacaggcctacgctgggtcatacattttgcccatttcctgttattccatatcttcaaagtgattcactccattcattcagcaaatgtttactgagcacctactatgggctagacactgctgggagcagttgcacggcaagtccaaagttcctgaggtggagacaggctgcctgtgcaaggagcagccgggctagccgctggagcacagggagcagggccagggcagcccgagaagactcagcagggccagaccctcctggcctggaggtcacgccaggaactgcggtctcatgccttggggtaggaagggtttaagcaaggaggtcactgcctctttcctttgagatatattttttaggatgagtcttttttttcaaatgctcctgagatatctaaagaattgaggggctgcacagggagagtgaggattccaggcctgaaccaaagcacaggcagcaggagagggcagccggctctggggaaggctggctgggctgtcaggagcaagggtgccatgtggggaggtatctgaagtgacgcatggagaagccagccagggccagcgtggagagggctccgaatgccaggcgaggggctgggccctgcttccgaaggcactggagagccgttgagggttttagacagtggaaggggaaggtgagatctattccgcttggtgatcgtagtgaagaatggtgtgtgtgggtgggggggtggggaggacacgagggggaccgttggggagccctaccgcctgtctcctgtctggcagagaaagtgggtggggccgggggaggagggggatgtgcaggaggcaggcatgtggaggtcgccttctgtcttcagttgctctttttgccacatcagtcgactctctgctctgcagaaatgttgccgctgtgtccttactgaggacgccagtgttttgtcgggaattacactgattactcccagtggttcccatgcccaggtgggccctgcaggcctctggccagggctgggcaggaaattttggcaattttgcagcctcctgaaaagcaggtagagccctgggatggtagagggggcaggacggggctcactcctcaggcccacggaggacaaggacactgtggagcacccctgcctctcacatgccccacaaaccctgcctgccccccatgtctgttcctgatgtatcatattaacctacggggactgagaggctggacagcagaaggagcccggccccggactgtgggttggactttgccatagcacacgcaggggcaggagaaccacccaggccagtggtcagtggtctctgggccacagtgccccatggggttcctgactgctgggaggggctgctgagacctggcctgggagggggccaagttgagggctccggagcaggatcccaagcccagcagccacccagaggagccaggaggccatcgcaagccccaccacggccttgctcaggcctgcctcccagagagtgggcatgcctggggaactatgtgctgtgctggtgtggaagggaggaagggacagaggtttcctggggagaggatcagggagagcgcaccacagttgaaggctaccagggagggagggctgagggggccttggctgcggcctggcctccttctccctggctacctgctgggagcatttgcaggcatgccctctctagctcctcagcagccagggagccccagttaatctccgaaccatctgaggcttccagaggccagggtcagggcacccagcgcaggaggtgggagctggctgctggcggacagcccacagtggagctccccagccaggggcccacgcctagcagcctgacaccccagggctcagctgcctcgaccccacctccaagcagaatgtgaggctgacggtctatcccagggagttccatgcccagcgacggggcttttggagtggttggtcacctcctgtcccaaatcagggagcaggattagatctgctcaatgttcagaaggacacaagattccttcttgagatgagagctgccaccttcggccccaggggtagggctaggagagtgggaagatcttgcgtcctgaggggcagggcctggccaggagccaggagagggccagccccgcatctcctccctccgccctgtgggagctgccggaatgcccttccagagccccagcctctccctgctcaggcggggcagatgacccctattccaatccacatcatccctcacatccgtcccttctctgcactcatccccaaagctgaaccccacattcccacatcttgaccccttccatctactttccgtaaggcacctggagtaagcttcttaaatgccccgccatcatccttcctccatgtcctcccactgctcttagagaggatttggaatccttctcctgacttcgtggtctggcctcagtgctcccctcccacctcctctgctggggcatcccttccacatcccctctgtgcttggaaggtgcctcgctgcttccaaccctgggaggtttgcatgggctgcctcctctgccaggagcgccatccctgctttgctgagctaccctgttctgtttctcaggtctcatgacatgccacgtccttccaggccccagtgggcagattcccactaatatatcctctggttccctgcctttccctcgaggccggtgatcctggagctggtctcgtagcatctgagtgtccctctccgcctcctggcaggagggctggctctgatctactcagagccacaattcatggtgaggcagtggttctgctgggtctgctgggtgccagcctcagcccagtggggaaggagagaccaggtcaggctcgcccaggccattctgggtcccagggtgtggtgggctgcacaagaggccagggtcagtttagtttgagaagtcccattgagagcctgtgaggggcccgtggctgtgctgagggtctgtgtggacggtgaggtcaacatttacacgcttaggctcaaacgtggggaaaaatgcaactttctttcattcttttttttttttttttttttttagacagagtcttgctctgtctcccaggctggagtgcaatgacgcgatctcggctcactgcaacctccgcctcctgggttcaagtgattctcctgcctcagcctcctgagcagctgggattacaagcgctcgccaccatgcctggctaattttgtatttttagtagagagagggtttcaccgtgttggccaggctggtcttgaacttctgacttcaggtgatccaccgccttggcctcccaaagtgctgggattgcaggcgtgagccactgcgcctggccagggctttctttcgttcctatatctggtgctgccctcatctcgggcactcagccccaggatagaaggaaggctgcagtctggcctgtgggaggtggctcagtctcttccccataaagcctttgtctcattccgcttgggctggtataacaaaatgccatagacccaggggtttaaatcacaggaattcatttcccacagttctgaagactgggaatttcaagatcatgttgccagctgggtcattccccagtgaggattctcttcctggtttgcagacagccgccttcttgctgggtcctcccacggcagagagagaggatgcaggctctctggtgtctgttcctataggacactaaccctatcatgagggtcccacccccatgaactcatctacccctaattacctcccaaaagccccatttgcaggcagaggcctggtggggggcagtagggatgagtcccctctgcagtagccttgcaagcaggcctgccctcctctcctgtaggccagtgcccccctgggcttgccctgaagcctggtggtgccccctagagccaggtaaacctgcaagccagtccccaactatcttgcccatgtgtctctggggtgcaggggaccctggcatctgctacacacagctgggagctgggccaccctctcaggcctgagcaggctgggccaccagttgggccctggaagccactcctactgctaggaacctgtcccctctcaggtcccaggcagcagccaggatcaagctcttttgcatttccttccttctcagatgtcaggactgttctgtatgacctgtgaggttggggttgaggatgaggagaagcctggcccctcatccctggcctttctcctctctcctattctgctcccttcagctgcagtgggaccttccctcggtcagactccatgagccaagctggccaagctttgtcgtgatagagaaagcaatactgtggacaattacagaaaccccttctctcttaagaaaaactggcttttaaggctactgtgccagcgtggactaaacaatctagtctgaccctcaaagctgggcaaggacttctgtggtttaggggtgcataccctacccccaggacctcacagggagctgcagggcactatggtttaccagcaatgaaaaaccgtttcattgtttgcacaagcaccattccattgcacctgcatgacggtttcatccccacaacagctttgtgatggggggactgcaatcctcattttacagaggaaacggagggcgatgaccaaatggcaaggcttcctggggacctgggtgccctcctcggagctccatcttgtcagccacaggggcgagatgggtcactgggggtctagaggataaccctcagcgcctacaggggttgctgacccaccctccccagacgcctacagcccggagccacggtgaccagccacgctcccgtgggtctgatgagttgtcccttgcctataggaaagagaggtgggagttgtggggagcccatttacaatcagatgtagatttgctgggcagcagttgccaagaggagctgcgtttgggctggatggtaccctcagcagggtccacatgtcatgaactctgccccacgatcggtgccatctttgttcccagcaccgatgccagcgggcctcgggatccttgtcttgcacgccctgtatgcctgtccacccatccatcatgatgtcattctccttgtgaaccctcgggtttcctgaggtgccttcccactgttttgaggtagcaatcactgttgctcagatgcaggctctacagattggagtgcagggagtgtgtgctggcctgacgtggcagcaggctccgggaagtatgtcttggccatgtccggagctgtcagcagcccctgggctcggtctgcacacagccagtccctgtttctccacttcttgatggtgccaatggcttcagcctttcagcgggtatccctgagtgcctgccaggtgctgcttagcctggctctgggcgtgcaagcagggaggatgcaggtggctgcccagcccacaggggcacacagagggctccagaaataacacaccttgtgcttgatgaggggcggctcaggcctgcggggggccttccagggggaagtgactgctgagctggcctcgaggaggagtggggtttggttaaccaacaaaggaggtgacaggaagggggctgcgctagggagggccctgggtgtgtgcggtgggaagctggagggtgggggctcagtgcgaaggaagcccctgacagcctcgagcccgggataacctgacctatgtttctggagggtcttgctggctgtgttctgtagaaggggagttcacccccctgtttttgtgccacgggtccctttgatatctgctgaagcccattggcacctgctcagaataatggttttaaatgtgaagaatgaaacacgtgtaagaatatgattgtgataaatacagagacggcgactgcaggagctccagccatcaaaacagaacagggagagcacattggggatgcagtaatatgagctttttattaacacgttaaaacattatacctggtggtgggcctagaaccgcccccatttccaagtagcgatgcaggtaggtaatccccacacccaccagctatagcttggagtgacttctgccagggccggtcccagccctgcctgtgccgcgggggtccatcacccacgttcactgttgaagggaaggttgtgtttcagctggaggctacagcaagcgtagggctgctttccctgcccacgttccatgttcaggccccaggtgaggaaaccctgggctggtgggtggggttgctcaggaaggggctacagtgatcccagcaggtggtggtggcagcctggagaggcagagggcagggggcaatgagggaggggtcacaaggtggctcctagttgatggtgacgcctgggtggaaagcatgggaagaagaaggagcaggtgggggtcatcccattggcagagccagagccagtcctagggcctgtggttcccgctgatgcctccctgtttctttcaggtcaatgaaatctaccatgacgagtccttgggtgcccacatcaacgtggtcctggtgcggatcatcctcctgagctatggaaaggtgagtgcactgtggccagccgggcctgcctccaccccctcggagtgaggggcctgggagtgaggcatgggcctccttggagagtgtgtgcgtttgccagaaccaccctgcctctccctggctcccctgaggttcctataagaaacaagatccctgctccctttcaccccttgttttaaaatgtggccattactattgttcactgaaaagagtctgttactcccagatcccaagaggaagagacataccaggccacgggggccacacagggaggcaccaggggtggtcaggaggcagagggaattgggtaaacagcagcctgagtccatgttgtttctgcaggaaggaccgatggggacagggtgagctggcttaaggttggccagtttgaataattccagtgggctctggggagtggagcggtcctgagttagttttctgggtaatgagggcagggggatagtggctcagagtgtgaagtctgataaaggaggtggctggggacatgggcgctggattggttggtttgtatctgaaaaatgtgctcatggatgagttgtttcctgtctctaaagattggttaccacttagcggggcagtccctccagagtcagcaaggctcggatgtcaaagcatcagaaacacgtggttaacacgaccctcccttggacttctgcccccgtattaaatctgtggcctcctctcctctggcctcggctgctgtcccagctgggctctcttgcccgtcccacttcctcttgcagccaaacctgggacgtcctttcctggcggtgtgcatgggtgtgtagccgccagggacagtgacctgggatggcaacacgggatgctgtgcagacagaggaagagaggagccccacggtacggcccgtgtagactgcaaagtgcctgtaccagccgtgtgggaagcactttgtatggatgaatgcccttaatctacagggcagatggaggggtgcacactgtgactctgcccatttcacagataagaacaccgaggcttaatgtgacttagtgacatgcccaggtaagcagccagggccatccagcacccgaggagtcaggcttcttacccagacagcagaattcgagcctgtggtctggctgtgcatagaaaatcaaatcataataggatcaaatacatcagataattatataaaagttgaactctgttcaaagagaatctcagtctcaaaaaataaaatcaaactgcatacaacttataaggcacacgatgtaaaaatgatgacgaaggactccggtggcagaagggatcccaggaatactaagtagatttggggccacttccctacacccaccaagcacctcattccacagtgaccgaaggcacccacagggcggatgccagttgcaggccttcgtgtaccccaagagaacacaaaacatcccaaaacaaatccttggaacaaaggggaaattggcaaaaacctaactatgagagtctctaatacacttttaaaagcctttcacagattagatgctaataaggcatagaatttttgaatgacacaatgagtaaagctaaattagtagttatatcactgtttcccttgccctacagaaaaaaagaaagatgaaccttcttttcgaggaatcatagaacacttaaaaattacagaagtgttttgggtcataaagaaaatattgtgaattttatacagctaaaacgattttgtccatgttcgctgatgaaatgcctaaaagtaggggtgggggcagcagaatttataaacctaaaaaaatccaattcatttgaaaacattaaaaaaaaaaaaaacctactaggggccaggcatggtcgctcacacctgtaatcctagcactttgggaggccaaggtgggtagatcacttgaggtcaggagtttgagaccagcctagctaacgtggtgaaaccctgtctctaccaaaaaaatacaaaaattagccgggtgtggtggcatgtgcctgtagtcccaactacttgggaggctgaggtgggcgaattgcttgaacccgggaggcagaggttgcagtgagctgagatcacaccactgcgctccagcctgggtaacagagcaaggaaagagaatattaggactgcagtacagactatttggaacactaataaaaacaagagcactactgtcaaatcttttggaatgtggttaaagctgtattcagaggcaaattcacagatgttttccaaaagcttcttccttgggtgatatgttcgacacacattagccctgccttcaactcagtacatttgaatgaatttcaacagcaacaaaaccaaaaacttaaggaaagcaaaaataaggaaatagttcagaaaaagcagaaatcaataaattagaaaatggaagaaacacatagaatcaatgaagaagagagctttggaaaaagcaaccctctgacctatttaatctagaaaaaaagagagaaggcacaaactaaaagatcagaaagagtatatgtaatgtgactacaaaaagatacttctcctggcagaaaggaaagcatgcagggccatctgcccactaggaagctgttgggaggctctctgcagccggccacttcggaggtccagggatgatcagtggaggagggatgtgcagggcatcctctgccagtgaatgctggctaggagggcagagagaggctcgctgagccctctatcccaggtttgtggcagggggctttggacagatgcagagcctgggggtgggccccagcccagcaatccggttccagctctccattcacaggcggggaggtggggggggatctttggactatcccatgtggctggctgcctgcctccagtggagttccctgttccggccttccccaagccgggtctttccagcctgtcccttcctggccaggatcctctggtgttttaggaattctcaagcctttggcatgagagatggacagagttatatcctcttttggaagtttccaaaaatgggaaactcctggtcctggggctagaaaggggagaaaagattatcccattgattggtctgggtgccaggtggcggcttgcattttcccccaggttgctcctacattgtttaaaaagaagaattttgtaattgactagggttaattgcttaccagtgctggcaaagctttggatcttatttggcctgaaaagtgtctgctctttcccagtcttgagtacttgatggaataaagcctcctttattaattactccttagcaggctctatgctaaattatcccgaccctaagccttttctttttctttttctttttttttccttaactgcctcaggtaggtagaaggagtatgtgatcacagtcagaacatttgcagaagagagtcaaaccctgaaggtgagaatttgaggatctctatgccagggacacggagatcctggggaaattgaggatttcctgggatgtgaatatttcaaagctgactccaaaaaatggagaatatgccataagtcccataaccatggagggaactcaagttcttcaccttttccaaagttttgccagtgcattcatactcatttgcaagcatttatcaggcaagactaatacaataccctgtaaactcatgtattctgaaatctacccaatgtgtctttcgtagtcaatgggacccttatacccaaagatgccaaaggtagcccgtcaggacaaagtacagacctgtctcacttctaaaaatagaagtaaaaatcccaaggcattaagagtttaattgaataatgtataaagagaaacttctaccgtgatcatctagggcttatcctaggaatgtggagattgtttaatatcaggaaatctattcatacagttcatcacatcagtttccaaatgacaaaactcatcctctaacaaatactgtttgaagggcttctgtgtgggaagtgctgtgctgggaatattcactggcatagtctctgtcctcaggggaccgcttccagaaggcagatctagacaaggaaacaattgtaccagggctcagggctggatggaggagacgcgggtcaggcagtctttccttacaaggtcaggaaaagcaacgggaggaagtgaccgttccacccacacctgaagatggtccagtgaagtcaccagcatagagatgctctgagttcataggctgggaggggagggagggcagctgaacccagagggacgagcacagggacaggaacagcagacccaatgccaaagacgtcggaaggagccgatcgcaaggagcagagcagacctgcgtctcccgccaaggggtttggcttgcccatgagggcagctttaagcagtgacacgatcccatgtgcatttctaagaagatcactggctcctgtgtgcagaaggggcaggtgggagcagtggcttaggagacagtcactgccatcaaatgggggatgctggcagctggactgggaccaggcctgggtccagggatacagacaggaggacagaggaggccacttcgagaggatgtggcactaggtgggtgaaggcggagagactctcagctgggtagatgatggtatcaacccctgagattggggagcacaggagggaagctgaagaggtcagctgagatgtgcagttagaggtacctggtgccatcccagcggaggaggccaagaagatgtggatgtgggtctggagccctgcggggtctggagctgggggtagcagaagcaactgcaggcatgaggagcttgctgcctagggggagcctgggagagaggcctcagggctccagtgttgaagcctctggcagggcaagggcgtgacggccccgtagcccctcacagggcactcctccttttccagatccccagaaaactagtaacagagggcaacaggacaaccaagattgtatttaaaggcggaaaaagaagcacatttccctaaaagtgttctgcacagcgaattcttaggatatgagtagatgttacagaggactatagaggggtcccaaggtcaaagaagtctggaaaatgctggtcaaacaaaggaaaatgggcattcctgggggtgaaatttcccggagactttcctgtggagctgtgcatggtgtacctccgagagtccgagcagtacaggtggtctctgaaaactttctccacggaagcttcttgctcagcagatccgcagcctgctgaacctgctctggggagcactgccctggagatagtcttggaaacaaacaaacaaaaaagacccataaactagttactgtggttctgaaaatcctagatacttgtatgtgacatgaaactagtattggaaaagagcagagacaaattctcattgtttgctgttaatcatgtgtcgggaaaacctaaaagaatccacggtacaacttgtagagttaggagaggagtctggtgatgtggccaaatatcagaccattgtttaaaaaatcagtagcttctgtgtgaaccaaaaacaacagccttggtagtggggaaaacagggagagaaaatttccattatggtagtaaccaaaaatgtagaatacctggaatagtcctgacaagacaatggacccattggaaggaaattgtacctgattaatgataggaagaaagtgatcacaaatgaagacacaaatgctgtcctcatgggaagctgggtataatcgagaggttggcctttcccagattcatagttggaaatgttatgaagtgattctaagcaccatctaggaacacgaacggtcaagaatggctgagacagctgcggaacccaagcaaggaagagacatcctccaaaggaacatgaacggtcaagcatggctgagacagctgcggaacccaagcaaggaagagacttcctccaaagcaacatggacggtcaagaatggctgagacagctgcggaacccaagcaaggaagagacttcctccaaaggaacatgaacagtcaagaatggctgagacagctgcggaacccaagcaaggaagagacttcctccaaaggaacatgaacggtcaagaatggctgagacagctgcggaacccaagcaaggaagagacttcctccaaaggaacatgaacggtcaagaatggctgagacagctgcggagcccaagcaaggaagagacttcctccaaaggaacatgaatggtcaagaatggctgagacagctgcggaacccaagcaaggaagagacttcctccaaaggaacatgaacggtcaagaatggccgagacagctgtgggacccaagcaagtaagagacttcctccaaacatcttgtaaagtgaagataattaaaatagtgccatatgtgcataaactttcatagacagttcagttgaataaaatagttgaaaatacccctcttacaaataacctaccgtgataaacacagaatgcttattgtgttataaataaatatataacataaatttaataaataggaaattaaattatcatatgacaaatataagccaatacaacattcaactatttaaatcacacaaatcaagaagaaaatattggttgtcaagagctttctaagcataaatccaattgaaggaattgtaaaggggaatatggatatatttggataagtataataccaaacttctgtcaaaaaacacaatgaaaaggcaaatgacaagcaggaaaaacatttgcaatgtgataaatatatcttaatatataaaacctcctctaaatcataaggaaacaaaattgtcaatggaaggaaacaaagaaaaaaatccaagtggctaagagaaagcccatatggaaaaatatctaactctactgttaaagaaataaataatacaccatttataaagcatcaaccctgttaagatgaagagggatttatggctgggtgaatgaagcaggcacactttgagtatgagtacagatattctaaggaaatgtagcaatatttatcactgcccttaaaaatgttctttttttctttctttttttttttttttttgagatggagtcttgctctgttgcccaggctggagtgcagtggcgcgacctcagctcactgcaacctctgccacctgggttcaagtgattctcctgcctcagcctcccaagtagctgggattacaggcacctgccaccacacccagctaattttttgtatttttagtagagatggggtttcaccaggttggccaggctggtcttgaactcctgacctcaggtgatccgcctcggcctcccaaagtgctggggttatggggcgcgagccaccgcatttggcctttaaaatgttcttgatgtttgcccccagacattcatttctgtgaccccagacattcatttctacaactctgttccaaagcagtgatcccagctgtgggccaagttttaggaacaagacaagggtcatggcattatctctcatgtgaacaacagcaaacaacctatattgtccaataatagtggtctagttaagtaatgataaacctatgtggtagagtattaggctgccacaaaattgcattttcgaaacatgtttaatggcattgggaaatggttacagtctaaagctgtttgttgtttgaaaagcaggatctcagttttccgtatgatctcaatttggtgtacaaatatatttaccaaaaagactggaaggaacacatcaaatgtgaacaggatttctctgtgggcagtaggctaattaattttcattttcttctttgtactttactgaattttttaaattcaatatgatgagcatggtttttattattattattattattattattattattattaagagatggggtctagctctgttgcccagactagagtggagtggtgtgatcataactcactgcagcctccatctcttgggctcaagggatcctctcatctcggcctcccaagtagcttggactacaggcacgcaccaccacactcgactaatttttttttctttttttttttgtagagacagggtctcactctgttgcccaggctggtcttgaactcccaggctcaaatgattctcctgcctctgcctcccatagcactgggattacaggtgtgagcagctgagcctggaccagcatgtttcttttataaacaaaacactgcattttaaatttgtgaaatttaaattttttaaatgattttttaaaaaatcatttaaaaatggtaggatccaaatgatgccgtttgactgaattcagcactctggagaaaggtctccggtggcatgccacagggctctgtcacgctcagtcctttatttctgatttcaatgaagacatcaaagagaattcatgctttcccttggcacgtcatctctgcagtgggctggggaggagtaatgaggtttctgtgttccaccctatgggcgctagctcacgcttcctgtggctggggcagggggtccacctgcagcgggtccacctgaaggaaatgggaaatcttggagtgaggacgcaggctgccataggtacgtggtctcccctgcatgagaagcccacgcccctgggttagcaggcaccaccctcctggccagggcctccttggcccctgcccctcatgcgccttgcctgcagaagttctgctttgctgggacccccacccctcatgcacctgcagaagctctgcttcactggggccatgctggggccccacttccacttttggcagagttgggaatggggcagtgggcaggggaccggttgtcaggtgcagcctgctcttcccagggacaacatggggacatgtgcaggccctgggggtgctgagatccatagccagcaaaccagggcagctcatgcctgtggtgggcaccgggcaacttctgcgacccaggtacaaagagaacagagaggacataggtgaactgaggctggccttgcttccgcctcctgctgggaaggggcttgagaactgatggtggtgagggattggaagacagaaccggaagctggacgcacgcttccagagctaactccagatggaaccagcttacccccggccccgagggctcagtggacccgcagctgaggaggcaggggagaggcagtgctgggttgtgaggggtgtgggacccaggacaccccagtgcctgttcccaggcccctcagcctagcttggaggacaacacacagccggtccctctgtcagaccccgggaattcagggatgattggcctcctggaatgttctggaacattccagcattctgggcctttttttctgctcctaactcatgcctgcccagagtggggctcagcaaagctcaccccatactctgcccacctttttctgcctggccctaccccgccttcctcctagaagcctcccagatcaagcacaggaggcagtgatgggggtaggggacgccagtgcccatggggtccgctccatcccggggatctcctgagttgatcagctgagtgtagactgccagaagagccgggcctgcccgctgctgtgcccttctctggggggttctgggctgtgagaggggaagtgagccgaggctatgagtcctcgttgctttaggttggacctactgcaaaagtgcaggaaatagtagagcagaggaggtggcactgctaggggctgggctgaaggcttggggtagagggcacagcggctaggaaaatgggttctggtcatgggccctggctgacttagcgaatgtgctgtgggccacagggcttgggagcagcgtctgtgggaccggaggagccatctgccatccccaggtggccaggggagaggccatcctgggagcagcagtacacagtgcacctcaatgccaaagacctggctgttttctttttcctatttcaaacccatcacagaccaatacttccgtaccatacgttataaatgaattactgggaaaagcaaatgtgacaaaaaccgaggtatccaaaaactctaggtctggatttttattattaaattctgtggacataaactcaacccgtccaattgctataaaagtttctagtttctgtacttatctcactgtggactggaacagtttgtgtccaccaggcacagacttcactttgcatagcactgggggaggccctgttttcaggtctctgaggtgtctgatgaacgtgggaggagatgtatccttgtgcccccaaagcatccggccagcccagagcctctggcttcccgagcagctgctgtttaatcccagggaggtgcatgaacgaggaggggagaggagccctgtgtccaggcagtagcagcagacaagacagcgacagagtggtgagcaccggcaaggaatacagcagggtggcaggcaataggggaccatggatggagcagccaggatggggacttcccagccaagatctgggggcaaaaggcctagctcctgtgtccaagggaacagaccccttttgctcacagagaagcacagccagggattctcgatggggctctggggacaaagtttggcacatggtggggatgaattctgatgagctgctcttcaaggaaccacaggcttcccgtcaaggaatgaggcccccgtctctagaagaattttagcatggcaaaaccaaggcgatggcagtcaggagggggctgagctgtcccccccacggtggggacagactctgggggatgtgagaccatgacccagacttgggcagaaagtggcccagatactcggttcctgttattcatcccaaattgtgacagaaatagaccagctccccacctgccgctcccccattgcctgtcccccaggcctcaccaggctccagtggggataaaattggtagcacttgtttgagtgacatgtttgtcttctagcttatgagaagcctctgagttatctcaagtttttcctaaaacaacatttttctccatttcttaaaaaaaagcagaagaaaagagatgatcttattttatacaatataccaccagccagggagcagagcatcggcaacacttgaggttgcatagcaactggcttttcaattgattttttgagaaggtaccaaagctactcaactgttctcattttaaatatttcctaggatgatgaaaatcaaagcaaatggaaatcagagacttggggagcatcagagaaggacataaagtgtcttgttataaaaaaccaggtcaagacaaagtgtggaatgcttgctggaatttttcagcattggaggtgaaaggtctgagaaattctgcatgtgagtctcttagtggaaagcacgagaagagaggtgctgggggtgggggcttggtgtgcccacccacccacctatagggtagaggatttagagtggcccagccatggtgcaggaaggccaggaagtgaaggtctggggaggatatatcaagggccctggggatctgggacaggggatgaggtgggaaacacaccccatgcctcaccccagggacagccccctgtcctcctgagcatctgggtcccaacccccaacctgataggggtgcaaggcatgatggcccacccacatcatcctccatccacctcctcacccagacctacctgggtccagagaactaggaggcactaaggctggacactgcccttgggaggtgccttagtctgtttgggctgcaataacagaaataccttagactgagtaatttataaccaatggaattgtgttactcactgttctgggggctgggaagtccaagagcaggacgccagcagaactgatgtgtcgtaaggacccattcctcctagagggcaccttctagctgtgccctcgcatgatggaagggtgaacaggctccctcaggcttcttttgtaagggtgctaatctcatttatggagactccaccctcatgacctaatgacctctcaaagaccacacttcctaataccataacattggttctcagctttcaacctttcaaatgtgggggacacaacattcagattctagcaggaggcccctcttctgcctccccacaggcctgcactggctcatgcctgggaaggctcaagttgagaatcctgttctggcagcttggctctctctgggaatagcttcccaggctttggggaagatggctggaaacaaaatgctggaacgatatgggagttctggcagagaaatgaggtgcacgcctcctgccccagctctcgtggttctctgtcgtgatgagatttgatctgtaagccctgcctggaacaagagacctccagccttgggggagcccactttgcactcagctggggggcacggtagaacatgtgctcacagagcagggatggtgggaccttgtccctgccattcattctggctttgtccatactcgtgggacctttggtgagcaatttaacatcatggggccttagtttcccccataagaggaggtctgtgaaaccccagcacacaacaggaatgacgacaatcataaaggcgttcgtgcaagtgactgtttgtagagcttcttctgggacaggcaccgtctgaagccctttatgtgactttatgccctcacccccatagcaaccctgtggagtagacgctgtgatcatccccatttgacagtgaggaccctggctccagggggcgagcggcctgcccggggccacacgctggtggagccactctgctctgggaggaggggctggactctgtgatcccggctggtcaggagcaccagcttcaggctccttgtcctggtcccctgagggtcagttgctcccaaccaagagtgactttgccacccctccccccacccgggggacatttggcagtgtctggagagacttttggttgtcacgactagggggagggttccactgggttctggcaaggagtgcccaggggtgtgctcaacatcctgccatgaacagggtgcccgcctcacccaacaggaattatctggccccaaatatctggagtgctgaggttgagaaatgtggtctgctcaccagaacccaacctccctgctgtcctatcctgcacctgtttaggaggctggtctgaggcaggagggcccctctgggatggggacggttgagaagctttgctgaagccgcatccccttgggggcatgagccagccccagcgggtaggccagtccccagggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggcccagaggctgtcttggggccgctggggccccgggagcccgggtgcggccgcggagtctgggcgccgggtgcgtccccggcccgggccgctgttctcgcggcagcagcgccacctggtggccgctcgggcccggcccttcctctgcccgccccgcgcggggggcagcaccccgacctctttccggctgtgggactcaggcgagtcctttcagttgtctgagacgcagttcgtcatccggaaggtaggaaaatgaagtggaagcgaggtgtcgtgtgccaagcctgagcctagcggggcgctccttgcggacggtgacttcctgctggggtcagcatctgccggggcggccctttgggctcacttccccaggcctcccgagaacgtccccgcagccggcgcctccctccctgcccagcctggctcctgagggtgctcgtgttcattccttcatcactgagcgcccagcagccggggtcctctggccgcgttcgctgcctcatcctggcatggagagcagaagccgggattgctccgtgaagggaggagtggggctactgagggcaggcgtgggccagggctggggcacagactcgggcccagcaaccacccggccctcaaggagcttaggctttagtgactcagaggccagcgacagcaacaggcacatccccagtaggtgccccatctggcaggtgaccgatcgcacgcaggaggagggacccggcgggcagctcagagccagggtcccgcggccaggatggggctgggacttggagctggacgcagcctactcgtccacccaaggcccacgggccccctaagctcctggctgttccctgaggcccgtggggttacccagacccctgcaggctgggcctgaggttcaggggcccgcagtgtttcctcacccttgccctggccaagcctcctgacagccctggggagcattcagcaaagtgaccttctgacccaaggtgagggccatcaagctcttgcctccctaaggccctcagatctgccctctccacctcatggtgggatccctgggtctttcaggcatgtcctcagaccctttccagcccgggccaggggagccaaacaggctgaacccggaggaaacaccatccttcttgggaccaggctcccggtgctgctgtgggagggccccaggggcctggacgagtgtctgcctcctgcatctgggcagctctgtgaaccagcatagcaaggagggtctccatgtggacataggtgggcactcatgatggccaaggaggaccctgcactctggaagagccagcctggtccagggccccagagcactcgggcagtggagcccagttgggagcccatgtctgcagtggtcgatgtcacctccaaacaggggtggcagagccctccatgaggggtgacgactgtcctggggcccctgtagaggatccgatcagcctcttggaagctcatctgttcccgtgctctgagctagggtcagcccactcaggactcctcctgcatcctgggctggatgggcccctggacttcatccacagccctactgcaggcttctcccgcctggctcttctggggccctaggctggacctgggagttctgggagctgctgccgctgtgaagagtctgccctcagaggccctgcctcactcaggaggtggaccctgcagctaccatgcagccccagggcctcgaaatgtccatccccggtcatacagcaccatctaccgccccctgctctggaggctgggtgcccgcggctgcccctgggagggactggctgccctgtaaagtccctggctggtcctgcagccaccccctttgcagagcccagggtgctacggctcactcctggtccccccctcagcacagctaggaacaggtggagtcacacagacagactttcctagaggagccgtgcagagccgagcaggcagctggaagtcaggtgcattcaggactgggagggacgtagatgaccagggcgagctggtgaaagactcctcagtggaaacaagcagtgcagcctccctcacttctggaggagatccatatatgagaaatgtgtcttcttctcgctcaggggaagcacagttcccaggcttgatacatagcaagggcacaggatggtgggggctggggtgccccaggcagcagggacccatctggcctcctgcatgcaggccaggtggcagaggagcaaaggaggtcgcatcccagcaggtggtcccgctggagcccaagtgacccacaggggagttcactgcatgtcaggacagtatccttggctggaggtctcagcggagagacctgagcttggctcttcccttgggttccgactgcctccagtagcgagggccttgccctgtccacggccagcccagacttccctcctgggccgcagacctgtccagctgccccgatgtctctgcctggacatcagtttctttctgtgaggagtccttagaggcatgcagaacccaaggctgcctgtagctctcatggagtgggaggagtgggtggaggaaagggggctctggggtgcatgagcctgagtttgcggatggttgttttgggtgctgccaccaggcaaacccacttcagccagttttcagtcctttcgaacctgtgctccatgggcctaacatgggtcccagctacggcttgggactgatcacccacaagggctgcacccccagaagtgggagagctcccaaagcaaaacagcccagctcttcccaacgagcaagctggccaggaaagacattgccgtgaccatgtttcctgcactgcggaccccacgctcttcctctggcacttgccgtccccttcccgcgccgcctcttctgccttgctaccaatccccaaagccagacactggtgccgtctctgcctcattgctcccgccctgcagccctgatgcctctcagctcctgccaccaggtcctgaccctcctgacgtggcaccagccacacctgcatgcatctcagtgccacactgtccccttctatccccactccttcctcactgacccaaagggctgttttaagaatgcacacagaccttgccctggcctctgggcacaaggtcaatgtctgggcctcatgggtaccccatagcccttgaatgctccagacccagcaaggacaagatctctgcccctgggctcctctgtgcccgtcagagataggctgggaccttggagatgttgggacgttggcagagagagagaggaagcacaagcagctctgtggcttgtcagttaagctcccagtggcaggttgagtcctggggtgcccggacactgaggtaaccctctcctctacttcttggggtaccccctgctgggacccaggctcccagggtctagcacactctcatgtctcctgaagtcctgcctcccagggctcccctggccccagtgcagcttcccctccctgtgcccatgcaccccagccctcccctctgccccctcctcagggagtctcctcagaaccccaaagccagaagggggtcatagacccctttagctctggaccctgcagcacaacctccttggggttggagaacgaaagtggcaggctgccttcttggactgggccgagaacaaagcgaggcaagaacaaaaacacaaatcaatatttcaataaattgtcttgccgcagcagcaagatcactttggctgctaagacgggctgggaacccaggctgaaccacagaagccagcatctgggaggagagaggtgatcggccagagtggatccagtctgcaggacgtggagaaggggctgcccactgcagggctcttattccagggttctggaataaagtggtgacggggaggatgcgttgttttgtctgcataactgatttcaatttgagccagtgtttactattaggtaggtgtctgtagaatccagatttcacgattgacctgagaaatctgatccagcagctctgggcctctgttcctgccagcactgggcggatgttgctcccttcagctgtgcctgggcacctgggtttgccacagtcctcgccactccttatcaccgacccccactctattctaatagggaaatattcctctgtaccctttctccttcaaaactgggaaaacacaagatggacttacttttcgtgcaaccagcctgcctcattgacttgtcacctgccttgctcctgtaggcgcttgggtttctagcatcctcccggtactccccacaagcccacacactaggatagcggacctccctgcacacccccagcctgcctcagcctggctcctcccgcagctctgtcctacacactagcctcattcctgcctctggtcctgatattggggcatgtctttctggctggactcttgactcctcctcaaagacttggccagggcccttctcccactgagaagcatataaactgcccccagaacatatcagctgcccccagatcagacgccatctttcatgggccagcgagtgtcctgactggggtccctgtggtcccccaaaggaggaagcacgtggctcagattctcttcgctgcaagtgacaagagcacaactcagaattggctttcacaaggagaggaacttcttcaggcataaatgacacccgtcagtggcaggcagccttcgtgatggccgccagtgacccagtctcttaatgtccatgccctgcggtaggcgggactgagattctatcaaaagcagactgtggcttctgtaggggaggtgccttctcttgttgtctcttgggtccctcgagcaggggcgaccgtgtggggtaaagctgacatgggtgacggccccaggaggggcccatacggtatggtgtgcaacagctcagctggggcccgccgtgaccacctgaatgagcctgggagctgacccgcctccggtacagccttcagatgagactgcagccccagtcttagctcgacagtggtctcatcctcctttaatccttggtggggggtctcctgtagtgcaggggggctccagccgctgcaggccccccacctcacaccttgcctactccttggcccgctttggttgtatgttcaccctgatccttcatggtggccaggaaggcgtggtgctgggattggccaggcctgcctgcccctgaagcctggggtctgactcagattaaaggaggggaagtttcacgaaagggaaacaagggcaggcagaagtcaccgcaacccaccagggcatcggaagggaccgtcccactacatggggcttaggaccctgagggcaggtgagttcatcttggacaggactcccttgacactgatgctgggagacgtgccctggaggaagcaaggcccctttccctggagcccagcaaggctaccgagctgtgctgggtgtcctggatggagacactcacactgcagcaggggccctgccaccaccctagcaaaagcgcttattagtgacctttgtgctgaccctctgatttggatttggactggcaatttttaaaaaatgtatgttaaaaagtcattcttgtttggtttttgattttgctcttactgttatttttaattggcatgtaataattgtacatatttctggggtagggtgtgatatttagacacgtgtatgcaatgtgtaatgattacatcagggtaattagcatatctgtcacctcaaacattatcatttctttgtgttgggaacattcaaagtccactcttctagctatttgaaaatgcacaatacattcttacggattccaggcgctttccggcactatagggcactaacgcttattcccccatcttgccgcacttttggatatgttaaccagccttggcaatccccagcccgctgccccccactctccaggaactactctctatttctgtgacatcaactgttttagcttccacgtatgagtgagagcgtgcagtatttgtctttctgagcctggcttatttcatttagcataaggtcccccaggctcatccatatctgggctgccaatcttaagttcagcgagtacaaccaaccacaaggcccacgctctagcaccgaatcacatccaccccgagtttcccttccttcttgtgccatcccaagctcaccccctagctggagacagtgagaagggacattctttcgcccgattcctccttcagaactgtgacctctcaaggctacccagaggcggatactacctggcagggactcgagatgagctgcaggggtcaggcttggatgtgatgcagatacccactcccttcctcctgtatcaattatagtaggtgaggttatgctacagaaacaaacacactttgcatcccagtggcttaaaacgaccaagatttcctgctcacgctgtatgttcaatgtgggttggcggaggattcgggtctcatcgtcactcaggtcctaggtgacagagcagccactgtctttatgttgccagatctcgtgccagaaaggagagctctctgaagggtctcaatgggaaattagatgctccaaccgaaaagagacatgccccacttttgctcacagctcattggccagagctagtcacatgctcttcctggtcatgatgggaacaggaagtgcacctccccttgccctcctccagcttcctctggtctgtccacttctatgccaatgtcccacaagtcttagtcacaggacatcacactctgatttatgacttatttcatcgggactcatggaaaccttgttagaatgagttatcttatctcccaggagcaggaaataaagtctttacaattaactctgtgcttgggacttgggaattggtctgccatcttgtcagtcattgactgggacccctgggaacgacttgtcttacctagccttgaattgtgctcccttcttctggaactaactggcttgctaacaataccctttgttgtttgttttgttttgttttgagacggagtctcactctgtcgcctaggctggagtgcagtggcgtgatctcagctcactgcaacctccacctcccgggttcaagcgattctccttcctcagcctcccaggttgctgggattacgccaccaagccagactaagttttgcatttttaatagagacagggtttcaccatgttggccaggctggtctcaaactcctgacctcaggtgatccacctgcctcagcctcccaaagtgctgggattacaggtgtgagccaccgcgcacggccaactttttgttatttatagacacaaagagaaatacgtggctctactttgtggatacatttatgcaagagaaaaaacacctgcatacgtagcttccaaggaatgcacatctctattttatggccagataaatccttaaaggggaaaagaacatgcccaggactcagaggggctctcggttctcttggagggaactacttcggtgtttggagtctatggtgagaacagaaaccaaaatgcctgctgtgaggattgtggaggaaaaaaggaagggtgccgctcacagaagccttgcttttgaaatgatattgtgtatgtcttatttaaggaggaagtttagggcagtgagttgaatctagattttggtttcagccttcttgggatccgatctcaattctcctacttcctagtttcatgacctgggcaagcttcttaacttctctgagtctcagtttcctgtccaagacaggcttcttagtcctgaagtctaaatgggagtgcctgctgatgtcatggtgcagagagagtgtgcaagacgagcggtcccgaggccaccctagctgtcaggtgtgcgtcatgatacaaaatggaatgggatggttcccgggggcttcccatgcatagttcctgtgggaatcatctgtgtatgcccttgttcttgatatggctgtttttctattaggttgatgccaaagtctttgccattacttttcatggcaatactgcgattacttttgcacccaccaaatatgtcagttgctgtttcttttcctccattgtgttggtttctgcaagtaccttcacacggggggaacgtataaggtgatctgcttcctctggccttgcacaccacactggaatttccgcctcccctgccacggaccctcccaaaactgtgagctctttggggtgaggtccacatgacatttgccttctgtggaggccttgcacggaacaggtgcctcatagaacaaacacagggacttctggaaatggggtagacggtgggactatgcgaggccttagatgacgtagagcttggcttctgcatctcacctgaaaactgcggtgactttgtgtggaaactcacgcaggtgagtgtgactggggaaacttttcttccctgtcaaagactggagcccagtgggagcaggtcctgagagtgaccgggcagggcctttgtaccacctggaacagattcccagtggatggggtctgtcaacactacagcctgctcggccccccactgggccaccaggcgccaacctctctcttccatttctctccatccccctgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggtgagcctcacccatgcagggccacagaggcgtgaagctggaaatgagcccctggccatgcaaggggccccgggagccttggcccagcccagggaagagtgtcagggcagggaaggccgtggccaccttagctgggtgagggtgtggggcagtgcactgatggacaaatacatcattagaagagaatccagtgtcctgaattggacctatgtgtatagggacgctaatgtgtcacaaaagtgacatttcagagaagaggaggaaaacagcctaacaaatggtgtggggccaatttggaaagaaaggaggcctgtcacctccactcactctatagacagagagcatctcacatggattttaggtctaaataagaaacgcaaaataatgaaagaagataacgtaggtggatggctccatgttcttggagtaagagatgttttctttaaaaagagacaaaaggccgggcgcggtggttcacacctgtaatcccagcactttgggagtcggaggcaggtagatcacgaggtcaggagatcgagaccatcttggctaacatggtgaaaccccgtctctaataaaaatacaaaaaaattagcagggcatggtggcgggcgcctgtagtcccagctacccgggaggctgaggcaggagaatggtgtgaacccgggaggcggagtttgcaatgagtcgagatcgcaccactttgctccagcctgggagacagtgcgagactctgtctcaaaaaaaaaagagacaaaaaaaaccaaacaaaccatgaactcaatggaaaaaactgataaatagtagcacatttcaaaagtttgtgcattaaaggcacgctaatccactgggggaaatatttataaaaaaggatttatatctgaagtatgtgaagaacgcctacaaatcataataaggataataaagacaatccagtcagataatgggcaggagactcttatcaggctcttgacaaaatatgaatgagcaataaacatatgaaaaggcactcaacctcactagacattggaaaaatgcaattaaaacaatgaggctgggcatggtggtggatgcctgtagtcccagccactcgggaacctgaggtgggaggattgtttgagcccaggaagtgagctatgatcacaccactgcactccagcctgggtgacagagcgaggccttgtcttacaaaaaaaaaaaaaaaggaaaatttaaaaacacaatgaaatatcaagacgcacctaatagcatagctaggttaaaaagactgaaactaccatgtctgggtgaggagtggatagctcccctcaaacacagcgcagccaggtgttgccctgaccatgtgatgagagtgctgttggctgttttgtcttggggagggcactaatggggagcagagctatcccctaggaggggaaaccgacacagcttttatattaagtgacctgatccctcatttaaaaatgtgaaattggctgggtgtggtggctcactcctgtaatcccagcactttgggaggccaaggcgggcggatcacttgaggtcaggagttcgtgaccagcctggccaacatctctactaaaaacacaaaaattagccagtgtagtggcaggtgcctgtaatcccagctactcaggaggctgaggcaggaaaatcactagaaccccggaggcagaggttgcagtgagccgagattgtgccactgcactccagcctgggcaacagagcaagactctgtctcaaaaaaaaaaaaaaaaaaaagaaaaaatgaaaggacagccaagggttaccagatattttaaaaaaaccaaaacacaagaaatccttacagcatgaaaaagatggaccaagatgtaaaacaaaacaaaaagtttgaaaactggctctaagagaaaatagagataatttagagacaagaaaagcatgtttttaaaagtagtattcccagaatgtttgagaaaatacatccataaaccctaagagttttctatgaaaaattagagaacaacaaaccatttgtataaaattatggataggatgggggaagtaaaaaattcgaaaggtagacggggcgcggtggctcacgcctgtaatcccagcactgtgggaggccgaggcgggcaggtcacgaggtcaggagatggagaccatcctggctaacatggtgaaatcccgtctctagtaaaaatacaaaaattagctgagcatggtggcgggtgcctgtagtcccagctactcaggaggctgaggcagtagaatggactgaacccaggaggcggaggttgcagtgagccgagatcacaccactgcactccagcctggacggcagagtgagactccatctcaaaaaaaaaaaaaaaaaatcgaaagctgaaataaaaagtcaaggccatctcccaatgggagcaaaagacaaaaagattaacatgagagaaaagttaggagacagaccctccatcgaggaggcacactctatctaataagattccggagagagaaaacagccacaaagtaaaataagagggaagaaaacaaagaaaaacataaagatgcgctttcagatctcgcaggctcctgtaatgctgagtaggatgaatggaaagcctcccacggaggcagatgcatctgcaagcctggcatacaaagggcaaagaggagatggcaacgttccactcaggcacacagactccacgctcgtctcaaaatctgcagagcaaaaaatgcagattttcctgtttattacaacgggaaaagacaagggttagatcacgatgcttctatttttaggcgcgtacaccgccagctcacccggggtcccagtggccctccttcccttctctgtggaacgcgtggcctcagggtctctcagtggggcatggcaggagtgagggcaggttggggttctgaaagtcagggctccatgcttggcaggcctctaggaagactcccaggggtacaagcagagacctcgtgtggcacccatagccctgtaggcacttccctatctttccaagccgcctccctctgctgagacaggagctggggaagtgaataggtctcattatccatcttcctcagtttgacgtggggtctctgcgtcatgaacttctgccaccctccccctggccctgggctgtcgtaggccactggcctcatcttctacggcggctctgacctcccagtccgcaccagccagccccctgctgggatattctgcagggtagtgtggcccatcggctgaacagctttgcagccttctgcggcattatggaaacaggtctagctagggtctcaaggaccccagagaaacacggggagacccaagaaacgccccccagaggaggtgggcttggagggtgtgataccaggcagacgaggggcaggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggctgtggatggtcagccgcgctgaaggctgctcgcggcaccgtgtgtcccccacagctcctatgactgcctgctggatgaccccttcgcccacgactggccggcgctgccccagctcccgggactgcactactccatgaacgagcaatgccgctttgacttcggcctgggctacatgatgtgcacggcggtgagtgtgcagccctgcagccgggaccctcccaggtctggggggaggcgtgctggtgtaggggcagctcccgggacagtgtgaggaccggcccagtgtggggagggcagagcggccctccagagtggcagcctgtccctctgcacccaccactccccaccccctaggcaccctgagcccacctggcaggcccagacgtggtcctaggcaggaagcacacgggggacaggactgtgaccagggtgtcagccaggggcagtgagagcctgcagaggtcaggagggctcccaaggaagaagggaggcctgcaggctaagcggaaggagagggcattcaggaagggagggccacggacgcagaggccacggacgcagaggcctggaggagagcgcggcaggcacaggagcactcgctgctctccagggccaagtgccagggctgagccgtcagaggaaccggccatcggcatggaggccacactgtgggagcttcagtgtctatgagcgtcttaatgctcgcctctgctgcatgaaggaaagaagcaaagtagtcccattttacagatgaggaaacagagacccggagaggctaggtaacctgcctgagcccacaaagcgagcaagtggtagagtcgagtaccaacgcaggagggccacctccttccaagactccctaaggagcacagtggactcgattctcatggcgatgggggctctggaaaggcttgagtaggggaggctcagggccacgtctgagtttcagctgatccctcagggacgtcctgcaggaagtgctatcaggacaggaagcagaaaggccagggaacaggactgtgaagtccaggggaggccgaggctgcagagagggcaggcctgtgggggtgggggtagggcttcgccagggtttaggagggaaatccacggcaaagggtcagcaggtgcccacctagcctcaggctggcacttagggcccagctgcccgccaggctccctgaggtgtgcagcctccaaagactggaggcagagaggcccagccgcgtccagggatgctgcagcctccacaccgtatgggcaaggtcttcaccaccccagaatcacaacacccaccagcctcacgggcccatcatgggccagtcccactggggcatctcaggttccagaacccgggggtgggtggcatccctgggaggtccctgaggtgggagggacctggcaagctatggtgctgtcttccagttccggacctttgacccctgcaagcagctgtggtgcagccatcctgacaacccctacttttgcaagaccaagaaggggccccccttggacgggactatgtgtgcacctggcaaggtgaggcagcatcaagggctcttggagggcagcagggcagaggacaggaatcttaggtgcccgggtcaccagggacaggccctgaagtgggggtgggggccctctcaggggacctctgctgccctctcctttcccccttctaattacccctcacacgctgtacgccggagctgcctccaccctgtgcttctgatgctggagcacacctggcatctgagagttcctcatggtgcttcatgccccccactcaggaatccccctttaaggagcaatttctggggtcctggcagccttcggtcacccctgggcactgtgggtcacctcacctggaggccagcattggagtcctcgggcccagcatgaggcttaacctttccatccccaggacctcagtgtttgtcccttgttgggcacactgtccttcgaggtcccttgatggctgccccaggcccacttcccaccctctggtgactcttgaaagaaggacttcttccctgttgtcctcccagaactccagacctgattctcatttgttcagatgaaatcacacacccactcctcagccagttacttgctagggggctggcatatgcagatgagctaagcctggatccccacccaggaaggctcagccccactgagaccaccttggccctgcagtgggggcagggagtagggagtggacaccggtgcacatcccagccaggcctaggacgcccccaaactgtatggacctgtggctccttgatggaagtctttggctcgggactgggccagctgcctaattttagtctctggcggagcttctgaaagaaacaaattcccaggcccatccttgaagacttttgtttggggtaggatccaataattgtttttggtgttcttttttaaactatggtaaaaattctcacaaaattcactatctgaaccactttacacagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttcccgcaaggaccctgagtggtcatgcccagcttccatttccaggttaggcaccgtcttgcccagttgggacaggaggaccactgcgtggctccttccatcctcctggctcctggttcctgcggccaccagtgacttagagtctgccccggccgcagccttccacggtgccaggacagctcacactccatcttcctcagcttcggctgctctaacagaaataccgcagactgggtggcttacacaacagagccttgttcttcgcagtcctggaggctgggaagcccaaggtcagggtgccagcaaggttggcttctgggaggaccctcttcctggcttgccatcttcctgtggtctcctcacatggcagggagagagggcatctctctcaggtctcttctcatgaggacatcagtcccactcatgagggccatcacctaacgcttcccgaaggcccccacactgggggttagggcttcaccatatgaatttgaggggacacacgcactcaggccacagcactgccttacctgggcccctcctcgcctgcaaccccacctgcgccactggctgaggggaacgccagccagcatttctctgggttgttcccctcccctccatgctcgagtgaggggagctttgggggcaagagatgaggtaatggtgcccaggaaagagatggctaggaccccccaggggccgggagccaggcctgcctggccccagccagttcctgttggcccagcctgatgggaggagcccttgaccacctgcccacagtacccccctccgtctgggagggagaatccagagtggcggcctctgcagtccccacgtggctcagactgccacaaaggcaggtctgggagggttttagcaaggcatgagaatgaggggcctttgctaggaaggaaggggagatgtgggcacaggtgggcgctaggtggggcttgcccgagcgaggaggaccaggaaggaagcacgggaggggagcagctcaggcatggacacaggaggacggctccccagcaatgacctcagacacagagacctggtggcaggaattccagggcgcactttcagggccagcaccgtggggagagtgaggcactgcacagggatgcgacctcagcagagggctcggccagcgccacgtgcagctctggagcctttcagagttggcccaattgaagcaacgtttgaaccgcaaccctgaccagtcactggctatggctgtctgcaggaaaggggactgttcctgggggctgttcctggagaagaactcagctgtgagccatgagcagcccacatgctccacagcttgaggaataaacgacttggtcctgaagagggatctgggtggcacagcacagggtctgctgtgccaggcgtgtgttgaggagatggaggcgtgcacaggggcagggagggaagggagtgcggtctgttcagagccgccagcgctgcagtgctgctgtgctgggggaaggtgaccctgaggcgtaagtagaggccagtcgtaccgagtctttgatgccagccacagggcttgtcctgctgcgagtggggagccatggaggggctttgggagggaagcagaagtcgatttaccatgaagctcatgatgcttacgctttggggtcccttgctcacaggagccccttccgagaccctgggagaggccaagccatgtgtttacatggtcacatttttgtaaattttgcaaaaataagatattttaaccatacttgattaacagcacttctcttttcattcctgcttctcattgatacaattctcctcccgtgggtgccactgatacacttcccctcctgtgggtgccattagaatggccttgggcattttgctgctttggctacagagaaaatggattgagggcatttgttttggcttattgccatgattctgtctcttacaagtagagttaaatgattgtgtctgtccaggtgtaatagtagcttccagaaatactcgccacaccgctgtgccaactcatctagggtcattgcagaatacaggctgtgtgctggccatttccctcagatctttgcagaaaaaggtgcctcagcggtaccggaggttgtcactacttctatatgggcagtattttgtttgatttttaggtttgttttatagatggagtactttaaacacagatccaacatggatatttctttagaaaggccaagtgtaacaagatggtctgcttgttcaaaagctggcttaggccaggtgtgatggctcacacctgtaatcccgacactttgggaggccgaggtgggcggattacttgagatcaggagttcgagaccagcctggccaacatggtgaaaccccatctctactaaaaatacaaaaattagccaggcatggtggcgcatgcctatagtcctagctactggggaggctgaggcaggagaatcacttgaacccgggaggtggagcttgcagtgagtcaagatcatgccactgcactccagcctggacgacagagtgagactccatctcaaaacgataaataaataaaacataaataaataaaagttagcctagcctcacaacatatggatgacaataaatgaagggctctaaaaaatttcaaagacagaagagaaaccgcaatgaaagcgagatgcagaaatgttggttacgtctgaaggcgctgttttcacttccgttttgaaagtggcttgggaatgtttccataaaataaggaagaaatgacagactgtgatttggatatatgtatcaaatataccttttatcattttctaatttatttattagaaaggaaagaaaattcagataaaaattaatgggatatgaaactaaagtagtagaaaatgagcaaggaaataaaaaaaataataactctgacttcaaaaagctcattgtcaccaaaaaagaaaggttttatatcaaaccaaaagcagttgctcattaggaggaagagacacatatcaaagaagttaacaggccttggagcgtttgacagtctcattaacgaagaggagtgaatctgatgaacacataggaaaatggttcagacatctttctgatttgccatgaaatgttgacaacatcaaagacgccagggagctgcgaacgctgccactgcagtcagggcgtccacggcaactgctactgagcgttgctcatccaaagagtgtcttaaagtcaagctcccacagagaaaacttgaaatgccctgaaaaccacatcaaggacggaaaccagagagcacctcctccaaatgtcatcatcctaaatgttcagatggcgtcacccataacttctttaaagtactgatcattttttaaaaagaaagaatttccctcaatatgccagggccaagtgctggccaactccatctgctgcctgtttggttggtattggtttttttccctaacagctttaataaggtgagatctatatttaaattcactttttaaagtgtacaggccgggtgcagtggctcatgcctgtaatcccagcagtttgggaggctgaggcaggaggatcacctgaggtcaggagtttgagaccagcctggccaacatggtgaaaccctgtctctgctaaaaatacaaaaaaattagctgggccttgtggtgggcacctataatcccaactactcaggaggctgaagcaggagaatcacttgaacccgggaagcagaggttgcggtgagccgagatctcgccacttcgctccagccgggacaacaagagcgaaacttcgtctcaaaaataaataaataagtaaaagagagtgtacaattcagtgattttcagtgtattcatagagttttacagccatcacaacaaacaagcgctggaacatttttgtcactctgaaaagttccaaaccctttagtagtcacctcaatccatcctactctcgcccaactccagatagccactcgtagccactcatcctcttgctgtctttatcgattttccaattctggacatttcatatcaatggaatcatacaacatgggacattttgcgcctggcgtctttcacttggcataatgttcacagggctcatccctgttgtagtgtgcagcagccctgcattccttcctgttgctgaatactaatccactgtgtgggtattcatcatttattagttgatggacatttgggttgtttccacctttcggtaatgatgggaaataccgcacaaacattcgtgtacaaagtattgcgtgcatgggtcgtttttcttggatgtacacctagaaatggaatcattggattttatggtaactccatgtttgacattttgaggaactgccagtttcccaaagcagcctgttttacattccaactggcaatgatgcttcagatttctccatatcctccccaaaacttgttattttatttgttataccaatcctagtgcatgtgaagtgatatatctcattggggttttgatttgtatttccctagtgacctatgatgaccgtcttttcatgtgcttaatggcaatttgtatatattttttgtataaatgtctatttagatcctttgcttattttttcatggagttatttatatttttattattgaatcctaagagttttttatttattctggatacaagtctgttatcacactcaccagtgtaagtggtctgcaaatatttcctcccattctgtgggttgtcttttcactttcgtgatggcatcattgaggtgcaaaagtgtttaattttgatgaagtctaatttatctatttttacttttatcacctgtgcttttggtgttgtatttgagaaaccattacttaggtcaagaagatttactcctatgttttattctcagagtttcagctcttacattgacatctgtgatccatttttgagttaatttttgtgtaagtgtgaggaagatgtccaacgtcattcttttgcatgtgaatatccagttgtctcagaaccattcgttgaagagactattccttttccattgaattgtcaaagtttaacttatcaaatgtaaaggtttagttctaggcttttgttctattccgtcggtatatttgtctgtccttatgccagggatacactgtcttgattactgtagtttaatagtaagcttcgaaatggtgaagtgtcttcccactttgctcttttttcaatattattttggctattctacatcctgtgactttccatatgaattttaggagcagcttctcaactttgcaaaattctagtctgcattttgataggaattatgttgaacctgtagatcagtgtgaaagtatttccattttaacactgatcaatgaacattgagatgtctttccatttacttagaacttgaacttctttcaatgatgtattgtaatttttagtggacacgttttgcattccttttgttcaatttattactaaggttctttttttctttttggtgctattgtaaatggagttattttcttaatttcatttttaaatcatttattactagtttatagaaatgcagttgatttttttgtatattggtcttgtttcctgaaacctcagttaatttgtttgttagctttaagttttgtaggggattctttgggattttctatacagaagatcattttgtctgaaaataaagataatatactgttttaactgccattttgaaagtggttccagaatgttttgataaaataagggagaaatgacagactctgattggaatatatgtgtaaaaagtaccttcttttattattttcaaatatatttgttaaaggaaagaaaattcagataaaaattaatggaatatggaactaaagtaataaaaaatgggcgatgaaatcaagaaaaatgactgacttcaaaaagctccttgtcacacacacacacaaatctattccgttgcttttcgtgtgcttaatggctatttgtcctcacgtcagcagggacgaaagggcaaaaagggacctcgctagctccctctggcgcttttataaggcccccaatcccatccaggatgacctcatggcctaaggatctccttaaggccccacctcttaaaactgtctatgttcaagttcactgattgcatctgctgccagctcaaatctaccactgagccagctaattagtttatcttttaagtttttgtaccattcaactccagaatttctatttagttcttcttttttttttttttttttcgagacagagtctctgttacccagcctggagcgcagtggcgcgatctcagctcactgcaacctccacctcccgggttcaagagattctcctgtctcagcctccgagtagctgggaatcacaggttgtaccaccatgcctggctaatttttgtatttttaatagagacagggtttcaccatgttggccaggctggtccagaactcctgacctcaggtgatctgcccccctcggcctcccaaagtgctgggactacaggtgtgagccattgcactcagcctctattcagttctttttataatttctatctctttactgagattctccatttggtgacacgtcattcctgtactctcctttagttctttagacatgatttccttttgttctttaaacacattacttatagctgctttgaaatctttgtctgctgagtcagacatctgggcctcctcagtggtagtttctgtcacctgcttcatttcctgcgtatgggtcacactttcctgtttcttttcatggctcagaaagtttccttgaaaactggaaactttagataatacattgaagaaactggataatgatcccctgggccttgctgctactgtttgcttgttgattttagtgccctggtcctgctgtttcaatgaagcttatgtcccctgcagtgtgcagccactgatattgctccccagaggtcacagccttggtcatatgcagtcaccctgactgcacccctgcccctaatgccctggggtagtggcattagccaggctctttgactatctctttcccagatctttccattaagcttctggtcattctgcctgtattgctatcacacccaactgttagccttcactaactgctagctgctactaacagctagtgcgattgattgctgtattgtttttgacagtgtcctggggtatatagcttgctctacaatatgacctaattaaattctagacctttcacaggggcagggtgttgccagtatctgaggtgtattgagaccttcaggagggctcttagctgtctttgtccctggttctgtctgtttaacttctacaggttgagcatccttaatctgaaaatctgaaatccgaaacacttctggttccaaacgcttctggttccgagcatttcagataagggacactcaacctgtagctggtttaacattttgtttgttgctattaggaccattggcctcctcttaattgctcactgctaagacccttgttgtttttgacagtgcccttagacatgaacatcctccacgctctgtttcagatcaaagtcagtccccttagggagagctgtgaagccttctgttctgactctccctctgggcaggcccctgcaccactgagccagagctaaaggagcagggtcagtggcctgcttctcccagagtgacattcctggcctacagactgctcactagatgggaatggtagccactagtcttctgggcttgcccctttcaacatggaacctctaccctataagcaatctggggaggggctatcaggtccaccattcttggcctggtgtacctggagcagagcttgtgccctatgagtggggcctgggtgggggaagggggccccaggcctcttggccatcccaccagagagagactctgcaacagagttgagagggatgacaccagtggcctgggtttctcagtatgaaactgtagcctcagaccgggagcttggagtagaggcagccccgtcttcttggcagtaaagcttctgtcacactgagctagggcaggaatgggggagggctgtggctccaatgccatagacttttgcttttcttaccaagatttaatagattttcttgagaaaaaaaaaaagcttcttcatttgttgtttagaccttaggacaatttccagagactttaaatggctgctttttaaaaactaattttcgtcagttactggggagagggttcaccaacctccttacacttccattcaaagtttctgtttgctgcctgtttttgtaaataaagtttacaaaataaagttccaataaggaacacagccatgtccattcatttataggttgtctatagctgctttcaagctctgatggcagaattgattaattgcaacagagattatatagcctgcaaagtctacaatagttactctctggcccttttacagaaagaatttgctgaggaatggtttgctgagaagagtttgccaaggaatggctgcgttctctttctgttctctttgtggaaacagtgctacaaaattaggtcatacaaagaagggttaaagagtatgcagtcggccgggcgcggtggctcacgcctgtaatcctagcactttggaaggctgaggcaggtggatcacctgaggtcaggagttcgagaccagcctggccaacatggcaaaaccctgtgtctactaaaaataaaaaaaaaaaaaatgcaaaaattagctgggggtggtggtggacacctgtaatcccagctactcgggaggctgaggcaagagaatcgcttgaacccaggaggcggaggttgcagtgagccaagatcgtcactgcactccaacctggggggacagagtgagactctgtctcaaaaaaaaaaaaaaaaaaagagcatgcagtcggaactgaaggaaaagttctgtcagtcaatgtattagaagtccttgttctctgttttttggttgtttggtcattgtcagttttaaaacgtttttgtgtgatgtattttctcatttcaagtcaataacccattttgcacctaatttaattctttaattttgcaatcttcttcttaaagtgggtcccctaaactgtagacgcttcctccccctagaggaatgagagcactgtgatcagattaagatgtggaatcatttttcctacatgccagcattggactttattcctggtttttaccatgtcagcatattacttgtcccttttttccatagtatttcctctaaattgccttttttgcttaaataaaccttgtatgtcttgcagtcactggcctgataggccagtggtatctttataaatgggctgtgtgtgggcacccaggaggcatctatcctggcggcgtcatgtggtgcagcttccagctgaggggacacagagctgctagaaggcaggagggtgggtcagcaagcgggaggcagggcaggccagcccctcactgtgcctcttattgcctctggccaatgaggcctgtcttctgggggctctgagcatctaggggcgaggagggtgagctccccctgtgccccagagtggggccaggacgtgtcccagacactgcaggctgcagagcgcaggactgtccccacggcccggtgtgagggtgagtggagggactggcttcctgtctttcagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacagtgagttggccccatgtccccctggccttgctgagtggcagctgagggtccaggagaccctctccagccagccctgtcctggagggccctgtggctgcacaccagttctggagaggtgcagggcaggctgccccgcctgcctcaccctacctgggagggggtgacggctcaggggacgcttagctctgcctcttaccccttcccctggccggggcccacagcccacctgcctgcagcccactctagacagatttactctgtctctcctggccacgggcatggaggagaggagggaggaccgagctggggaaatgggggtaagcgggggtggtctctcagcccccccgatgctagcacctgggcagctgtttgcagccaggtgagggcagggtcgggatttgtcatcagtgtctggctgcccaggggagggacaacctgtagagccggcccatgccagctgcatccccatgctcagctatacctcagccccacccgccacgcaggccccatgccctgtgctgtcctcctgccccttctcattcctcccacctcacccccacacaccccgtaaatatctcccgggcccgtgctccctcctcagcccgcagccactttctcatccacaccctcctctccctcctccactgcctgtctcctcctgcctgaacgctcaccctggcctcacccagggagtgtcccgggggggctggcatggagggagaaccctccacaaacatcagcgttacccccgtctcccacctgcgcagcgggctcttacgccgcaggccctgcagctgcttagacacacagagcttcggtctttcctttttggcctgtctggtattttaaagattttgatttgcctgaaaatattgacaatctgtaatttcacattagaaaaacaaacaaaacagatttccagcctccaaattgggcatcacagatgcacagccgggcccagttaccagctggcgggcagggctccgggtgcgtcccggctgctgcgctccggcctctgcggccgctcctgggtcctgttcactcgggctgctctccttgctctggccaggcccgagctggaccctgcggagccagagaggacccgcagtcacggctccgcggagggatcccgcagtgggacagcctccctcagcagcacgtgtgaacacgctcgtgcatggagccctctcctacccctgctgtcctcctgccccaggctccaggctgccctcccggccagaagcagacagggagccccgtggcccctcctcaagcacccctggggcttttacgccagactcggaaagagattgctgggcatttagaacctcaagaggcagtgtgtgggttggtgctgttcccagtgaagcgaagacgttgcagaaacgcagcccgccttctccacagggagaaaacccagcggccgtgatgcgtctgctttgtgccaagacacttgctgagaactgcagcaccgggactctggggcctcagcatgcctctttctgtgctaggctcggtgcccagggccagctgcagaggagactcactcagctcctgccgtgctggggttttcgccctgtggggaacacagaacctaaacacccaatcacagcttcctgttcatctccaagcccaggcatcagtgctggggaggaggtggcaccagggctgtgagcagatgctgcctccccacaggaaccccaggagggaggatgtggccatcctgtcctgtcctttcaagagcttcactctgaggcctgacaggctggacaactgcccaggtcttacagctaggacatggcagggcaaggtccctttgctcagcagagctgccccccggacacctgagacttagggatcccccctaaaaagatctcacaagggcacccgggtgctgcctctttccaatggcacggagcggcaaggcctttgctttctcctccagcccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatggtgagcccttctgggaggcatcagtgggggctcagcaggcaggccctagggtgggcagggtgggggcttgtgcctctgatcctgcatggggcaaggctgccgcgaccctgggctggcaggagagcccaccctggctggtgtggctgccctggcccactcctgggtggggcattaaagttcctagcagggctgcaatcccagagcaccagaacaccccagagtagctgaggacatggaagaggtggccgggctgcgggctcggcaggggccgggctcctgcagttcaccgtgggtggacgaggcttgagctgtgtggtcagctcagggctgaggccagggctgaccctgccaaggaatctggtgacctctgaccttctctattagtcgggactctcagttgcgagtgtcagaaagttgactccaaccggtttcagcactagaaggcatttattggctcagggacctgaggagtctggtggccttgggcatggcagtgcttgtgtggcagctggggaccctcctgggacggactgtaaacacagtccttgtttctcctccatggctgttgccctagcccagcagctgctgcctcatgtgggccagtgcagggttggaggtgacacagcagatggggtccccctctggcggaggccacagtctgggggcccagcgttttagttgcctcagataaaggctgagaagggaaggttccagggacctgagtctgaatcgaggcaggctggcctcattctggatttcagagattgactgaaaaggattatttactttttttttttttgagacggagtctcactctgttgcccaggctggagtgcagtggcgtgatctctgctcactgcaacctctgcctcccaggttcaagctattctcctgcctcagcctcctgagtagctgggacttcaggcgcacgccaccacacccggctaaatttttgcattttttgtagagacagggtttcaccatgttagccaggatggtctccatctcctgacgtcatgatccgcctgcctcggcctcccaaagtgctgggattacaggcatgagccactgctcctggcctttttttttttttttttgagatggagtcttgctccgtcacccaggctggagtgcagtgtgcagtggcgcagtcttggctcactgcaagctcggcctcctgggttcaagcgattctcctgcctcagcctcccaagtatctgggattacaggcgctcaccaccacacccagctaatttttgtatttttagtagagacgggtttcaccatgttggccaggctggtctggaactcctgacctcaagtgatccacctgcctctgcctcccaaagcgctgggattacaggtgtgagccatcttgcctggcctgaaaagggttctttagatagcaacccagcaaacagacatttgcagcctcggaggtctccaagcggggcctcggggatgtgagagccgggctgcaccaacagcctggctggcttggttgggaaaagctcttccaaagtccacaaccaccagggtcaaaggcttaggagacacagagacaggaagggggctgctgtcacccacccctttccctctctgtctgccctggagggtgggccacgtggggacccttgtggaaatttctcctgcttggtgcctcctttgcacacacatggggaagccatcagggctccttgcagacccccagctgcttcccttccagccaaggagagatgccacctgtactgcgagtccagggagaccggggaggtggtgtccatgaagcgcatggtgcatgacgggacgcgctgctcctacaaggacgccttcagcctctgtgtgcgcggggactgcagggtgagtacacagaggccggcacggggggctaccgtgtcaagtctcagcttcctgggtactgacctcccccttttcggggtattggcaagatgcatgaggtgaagcatacgaagtgtcagaaacaatgcccggaccagggcaggctcttggcaaatgtctgtttacccctcccctgtgctgggagcctgagacttgagtatgcctaggactcacctggagagtttggactccacctcagacgtcctgattccacaggtcacggtggtggcggcctgggagcatgaatttttaggagcatcccaggtgatttccaatgcacgtgacctacaggggacccttgtgaagcaggccccatccttgcaccctgcagggcactgggcagcttcttgctggatctgggtggccactgtgagggtcactggtttggtgctttgtagaaatgccctcctctgttttcttttattatgatgcctttggcttcaatctttggctgtcaggaaaaacaatctcgtgtcacctcgccatgtgacggtgacatgaacatagacttgtccctgccaggctcccccgaaaacaaccggaagtctctgcttagggcttgtgtagacaggactgatggcaggagtcgtggaggctgactctggcttgaccttcctgagaaacagccgcatcggcaggaaggcacctctaggggagtgggcgcagggacagcggctgggggctggagccgggagctggagctggagtcgggagctgggggctggagccgggagctgggagctggagccgggagctgggggctggagccgggagctgggggatggagccgggagctggagctggagccgggagctggagctggagctggagccgggagggtgctcgagggctgctctgcatttgctcctgtgacttcggcagggccgggaggctgggctatacagctggctcagagatggcgacaccaaatacgccaaaacaagaacaggtggtgtctgctctgtacccttgggattttaatttatggaggtgacccagtgaggacgtggggaggccaatgtcactgagagggctcctgaggaaggcagggcagtggaagggggacagctcaggaatggccagtttgaatcattccagtgggctctggagtttagggtggtccccagtagcctggtacccaaccctgggatgagttagggtgcaagaatcttggtttggtatgtgagtcctggataaaggaggtgcttggggtatagactgaagactggctggcttgcatgtgaaaggtgtgtccccaacccagtgctttgctgtcccttagaactggatacccctgggaggtgtagtctctccccagacaggaagatttttaagatgtcaaaatatcaagacataggacgttttgaaaaacaaaaacataattaatacaggcagcaagcatgggaaacagttgtagtacaagtagcttcagatggcagctgtgatcatggttgtaaacctaacggggagggaagatcactaatgcactgtctccgtgggtgtggctatcacgtcactcctgacatgggtattaaagaaggataggggctgggcgtggtggctcacgcctgtaatcccagcactttgggaggccgaggcgggcagattatttgaggtctggggttcaagactagcctgaccaacatggtgaaaccccgtctctactaaaaatacaaaaaaaaaaaaaattagctgggactacaggcagcgactcgggaggctgaggcaggagactcacttgaacctgggaggcggaggctgcagtgagccaagatcgcgccactgactccagcttaggcgacagagcgagactgtctcaaaaaaaaaaaaagaataggttaaatattttattaatgttgattttgacaggtaatagcaggttgctcaattttgcataattagaaaacataaatattcatgcagaacctaatactgggtcaaaaaataatatccaactggattctgtctgttaaagaatatcaaaacttggccgggcgcggtggctcaggactgtaatcccagcactttgggaggccaaggcaggtggatcacctgaggtcaggagttcaagaccagtctggccaacatggtgaaaccccgttgtactaaaaatacaaaaaaaattagccaggcatggtggtgggcacctgtaatcccagctactcgggaggctgaggcagaagaattgcttgaacccaggaggcagaggttgcagtgagctgagattgcaccattgtactccagcctgggcgacagagcaagattccgtctcaaaaaaaaatgtaaaaataaacagcatctcctgcttgccaaacataaatgttcatcaagccagggacggtgcctgcctgggcctcgatgagtcccctgcccaagaccagccgcgtgcacaggggcccagacggaaactgccaggtcgagacactgctgtaggtggcaggcaaggtccgtttaactgatgactagacgcactctgattttggagataataaaagatgaggccaggcaaggtggttcacgcctgtaatcccaatgctttgggaggccaaggcaggaggatcgcttgaggccaggtgttcgagactgggggcaacatagtatgaccctgactctactagcaggacgtctcaagtgctcactgcctcctcccccaacagaaggtgggctgtgacggtgtgatcggctccagcaagcaggaagacaagtgtggcgtgtgcggaggggacaacagccactgcaaagtggtcaagggcacgttcacacggtcacccaagaagcatggtgagtgggtccctgctctccaccctggagcctggatgcctgcagcaggctcatgcccggacagctgagggcctgactcatcctggggctgtccgggcttatgactgttctggggagggggagaggtctgtgacactgagggggagggagaatcctaagtcggggacagccccagctgggtgccagggtgggtggggaagaggagagtgggggccggggtcacaggggttagagtggagaatgccagtatatgaggatgcccgggttgggccttaaagactagcctggaggcagcagctttcctggtggcccctctcaggtgggtcctcaaagccagagaaataccagggtcctgggagagcctccggaggagctgccttcaagagcgaggcccctccttgcatggtgcgaatttgagcggcgccttcccttctcagttttctgtgtctttccacatcaaaaaaaggttacatcaagatgtttgagatccctgcaggagccagacacctgctcattcaggaggtagacgccaccagccaccatctgggtgagtctcagagccggacaacttgacgtcctcaggacctggctcctctgggatcaatgggcagagtgccaggggtcaggggtcaggggcccgggttgtgcagccatgacctgagccagggcagcccctccccaacctgtccctctgctcagcccacctgggccctttcccagggtcctccccttgtggagaggccagggtttgggatcagagggctccgcttggcagcagctatgaaaggacatatatgcaaaacatgtgtccctcagtctacaggatgactccctgtcccctgttctcacagtcggggcgggaaggccccctgccctcgggaaggcaggcagggtctgcaggcagcagggtcctgggcagccctcccatcccctcagcaaggccagctgtcaggtgggtgcacacagtgcacttacattttcaattcgtttaattttaaattcaagagattccagctaaaatagggatcctggtatctcctgaaaatatggatgttctcacacctctcggtgcccctttccacgaagcagcgctgcctgggagaccacgccctcccaggccacgcgggaggctctcaggacctgtccaccctccctctgaaggtgcctgggccctaccttctgggaattcatgggccaaggtcagaagtgataccagggactgctggggcccctggataagtcccttccccaatctgagccccacattcatccccatccccaggaggctggacaggattggggctcccacgctgccgtggaccagcacccacgctgcctgacaaacataccatgcccttttattttatctcccttttgttttattttattttgtttttatttagagacaggatctcactctcttgatactcatttttctttcttactttttttttttttttttttttttttgagtctcgctctgtcgcccaggctggagtgcagtggcctgatcttggctcactgcaacctccgccttctgggttcaagtgattctcctgcctcagcctcccaagtagctgggattacaggcgtgtgccaccatgcccagctaattttttgtattttttactagagacggggtttcaccgtgttagccaggatggtctccatttcctgacctcgtgatccgcctgcctcggcctcccaaaatgctgggattacagctgtgagccactgcacctcgcctcttaagaggaaactttcgactgctaccctaaatataaaaacctgtaccacttgcctgaagcaggtgaacagaaaagtcagtttctgaacaaaaagacatttctgtcccaacgctgcttcctgccaccgcctctggggctgaggtcgctctctgtggaaagggagcaagggccagagagaaggcagggacgtgtggcaccaagcagaggctttgtttgtgagtggacagaattacaggggacgtgacagggaatgattttctcactagtgccctgtctgcggccccactcacatcacccagctgccccgcagcagccaccccccacactgcagagagcatggggcttcctggctagccaggtcctctgctcctagatgacctgagtgtcacccaatcaggccaggcctcttctggggctgtggggagctgctggggcctcggctgggccatggtccctgatggggtgggggttctgctgtttcagccagacatatactcaccccatggcaggaagccctactccagcagggtcatgtgctcgcctgtccagcagatgccctgcaccgcgtacagacccctcccagccatcctgccccgggtggcctctaagcgcccactgagtgctcccaatagggtatgggtaggtggccttgacggctactgagtggcttccaaggggagccggcacctccagggctggtgggggcagaggatgcgagtggagggtaatctggtcccgagggagcagtgatgggcaagcagggctcccagagccatctgggctgtcgtggcacagaggaaactggccgggggcagccagagagacaaggggtccagctagctgcccccactccccgaccagcccaaaccagtgggcctgggtcctgctcttgggtgaccacaacgggggacttggtcttgccattctcagccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtgagtccaagcagggctgggcccagggaagggtgcgggtggccactgggggagggatgggggtgcctgggacgctgagcctcctgacccttcaggtgacactctgcgtggcccctttggcctgcctttggcaccaaggggctccgacttggtcagagccaggaagggacatgcatccacgagccggggctctggaccccacatgacccctaggtgaccttgggcacactctccctttgagggtttcggtttcaccatctgaatgacattcacagctgccatcagcatgctcgttcgagtgtgctgttacattggaatcggtgacactctgggaggtgacgctcagggtctgggaagctagatgcccagacccaggttgagctggactgtgtctctaagcaggatgggaccccagatctcctggttgtaggaaagtaccacgggggctggattttcaaatcactttctttttacctggttttgaggaggtcagatcactttttaaaatgtaatttaactgcatagggatatattttatttgtcaaaaaaggtacatatcacaaataaggctcccatgctctggagcccctccctaaggtgggcatgctggcattgggattaatccaccagcccccagcgctccacacgtgggtgcacctgtaagcaggtgcagcagtgagccaggtatgccccgtgtaccccctggcaccctgcctgcctcgcctgcagtgacttctggccccctggacgtgcctttggtgacctgcctgcatcagtgtgtgagcagctggtcctcggcactcacggtttctgtatttgcaaattcacctgctcactaaaattgattcgtgagccccaaacggacacgcacagagtggtgaagtgtgagtcgcctgccacacgtgttcccagcggaggtgggagcaactcagcacgctgtctgcttgtttctgctctcatcccacaaacaggggttctttctgcagtctgttgagtgtcacatacatcacattttgtgctattttgggggcgatttcgctgttgaaaatcaccctgagcctgttgctgaagtgctgtccagtgttcctaagcccaggaagcagtggtgtcttaagaagaaaatacatgtgttgaataagcttcgttcaggcatgggctgcagtgcgattgactgtgagttcagtgttaatgaatcacagtaaaaattaaataaagtgtctttaaacagactcacacataggccaggcgcagtggctcatgcctgtaatcccagtactttgggaggccgaggcgggtggatcacttgaggtcaggagttcaagaccagcctggccaacatggggaagccctgtctctactaaaaatacaaaaattagccaggcgtggtggcgggcgcctgtaatcccagctactcaggaggctgaggcaggagaatcgcttgaacctgggaggcggaggttgcagtgagccgagatcgtgccactacactccagcctgggctacaagagcgaaactccatctcaaaaacaaacaaaaacaaacaaaaaaataaacagactcacacataaaacaaggttatatattgatcgggtaacaaaaatgttgagacagaggctcacaggaacctcaccctgtgccccctggggtaatggctccctattcaagaatttggtgctcggggcgacttcatggaatgtaactgccatgaatgatgagactcctctggagtcggcctcggctgccgttcctaagctggctggggaggaagcatggagggcaggtcaggcacatcaaggctcttgggctggcacaggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggaggtgagggggtctcgaagctggggacctgggtgacatgagggtgaccacgagaaggtagggagcatccctggggtggggccagcgtgagcaggggccgaggagccacagcagggacctttgcctgggtgggcaagggcttagcggcaatggaggggccggtgggtgggcaggaaggggggtgctggggcattgggtcaaatgtggccaaagggtgtgtggggcatggaccctgtatttgtgggcctgcttcagtgtgggggtgacaggctggcctagcaagaggttgatgtgtggacacctcagaaggatcatgccgtggcattggcaggatcgcataggcaagactctggcagtgcagatgacacctccagaggcttctctctccgttcactgggaaaagcctcccagatgtttctgggacagggctgagcacagaggggtcctacccactctggaccccagagagtctgcagttgatgggacataggacccagaggcagacaggaagcgctgatctgttctgcgtgctcctgggggctgggcgataccaggcaagtgaccaggacagtcctccctcgatgccatgctgggcccacacctggaggacaaggagctcaccaagaggtggggtcactccctggcccaggcagatggaagggtcctcttccagggcccctgggcacccccggccccacaccgggcctggatttcatcagcgcatccacccctggtgattcctgaaatctcctgggcctgtgtgctcttcccatcttcctggccattccccggtcctggcacccaccttcctctggactggcccttgtgtgtccactctcaccccaaagtaaccgtttgagggaacacatcagacaatgtctctctcttcctggtgtcatagtcttcaacagcttcctctgctcttaggataaaaaacaaaattctcctcatggcctccagggttggggcaacttgttggcctctcccagtatatctccaccctgtgcctcgcccccaggtcctggccacgccggccttaagggcttttcctggatacacaccatgtcccaccttggggcctctgcgcaggcttctcctcgcctgagcccctccaccgccctgccaccacgtcagcctccccagcctctgcttcctgggatgcctccaggcacccagaggaggtcaggctttatctccatgctttctttggtcttacccagcaggccagggtttcgaagcctgggcatcactgacattttgggctctgtcactcgccgccatgggggctgtcctgtgcacggtggggtgtcaagcagcatccttggcctttgctcaccagatgccagtagcaccccttcccccagttgtgacaaccaaacatgtcccagacgtggccaaatgtcccctgctggagaaaatcacccgggttgagcacggctgctctgggcctgtgggaggaagcatgcgggctgcgggcccagtgcttgcccggctcctggcttgcaccaggcctgctgggcatgtgaggtcaaggtagaagcggtgcctagcagtagcaaggaaatagggcctccactctgacccaggagcccagtgagggagaggcagcctaggggagaaaatggcctctcctgccctctcgcccctccacccgggacacaccaaggcctccccccagccagccgcaggctcggtgccctgcccacccttattgtcatcacaagggtgagcaggaaaacgaggccagcactgctggtgcagcccacccctccttgcaccctcgggcagggcatgctgccccaccgacccccgtcgagctctctgccttcagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgagtgcccccagctcgggctcccactagaggagacaggccaggggccaccaggggctcccgtgcttggaggtgtggggcctgggcctggcatcatccgaggcatttgaccaagtctctctcaccacatttcatggaatctaagatgctgcagggcagaaggcgcaccccagcttcaaacccgccaaactgaacagcatcttagagatgacaagaaacagggatgcccagatggggaaatgggggttcagaggcgcagggctcgcctcctggccctgtaccatggggtagatgtttcttaagcagtggctttgacgttcaggccctggggctgggcccagctgcgtttctgggtccagggacctcagtggggaagacagttgggaaatgggcaggtgggggccacataggacagcgtgctgagggaatccacactgctcttgagctctgccgagaaggatttgtgacgtcagcagaaggtgaggccaggtagcagggcccagaccctaaggaggctgggaaacctcttcaggctagggacctccagagccaccagctccaccagggcctcccagtggtgacatgcatgggactcatggtcagtaggacctggggcagctgagcctcagtttcccctctgtgcaagcctggacagccagcatcttagtgagaataagagaaggtgcaccggggaggggtgcaggctgccctctgtgctcgctgtctacctgggctgcagggagcggcgctggagctcagccaggcaggttctccaggtgctgcggaagcctgactgtgccccgctctgccctggcaggtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccaggtacgcaatcccccgatcccgtgtcctcagctccaaaactgagggtggacaggcatgcaggtgcgctccgtgcgctgcattcagccgctacacaacaccaccacccgctccgtgcatgccaagcactgcaatgacgcccggcctgagagccgccgggcctgcagcagcgagctctgccctgatcattggcgagccgggccctggtcccaggtaagcaatcccctgatcccgtgtcctcagctcccaaactgagcttgggtgggactgaggtgaccagagcattcccctttcggcccgtgggcctggatgtagctcctgtcctgagccacatcctgtgggtttcacggcgccagtggctgccacgtggtcagtgctgtactaagaaaccagtggaatgtgtgtcttcactgcacaggcagaggcttctgcatgatacggggtctggaatcccaggaaactgagggtagcccgggctccgaggcccagtaggatgttcggggctccaggatcctaggggacgcctgggtctcatgcagaggtgggaggggacaaactcgcaggaggggagaagagcagggcgtgcttaggcttgtgctgggaggaagaatgaggatggactgaagggcttcaggggtggtcctaggggcagggcctgagagccagctgaggccaggacagagctgacgtgagctctgacagcccggtcacatgcagggcccacgctggcagagctggaggagcgtgtgtcaggggctccccaagaccaccctcaggctcagtaatccactagaaggactcacagactcagaagcgggactcgcagttgcaggggcttacggtgaaaggatacagagtagaatcgggaaaaagaaaagtcacaggcaaggaggttgggaggaatccaggcgcaggctcccggtgtcccctcccagtggggtcacggaaatgccctgaattctccctgcacccatgtgtggcaatgcatgtgaaatgctgccaagcaggggagcccaccagagcctgggcgtccagggttttcaatggggtcagctacataggtgtgacctcagactgtagaggaaaagcaggtgttccccatccatcactgttggtatgaactacccagaccaactggtactggtgactcaaggcctcaggcaggcaaaaacactcttaataggtggagccttccatgagcttggttcccaggagctgcacaagggccagtcttgaaaacaggcgttggccgggcacagtggcttacgccagtgatcccagcactttgggaggcccaggcgggtggatcgcctgaactcaggtgttagagaccagcctgggcggcatggcaaaacaccgtctttacaaaaaaattaaaaaaaattagccagatgtggtggcgtgtgcctgtactccctgctcctcgggaggctaaggtgggaggattgcttgagcctgggaggtggaggttgcagtgtgctgatatcgtgccactgtactccagcctgggccacacagcgagatcctgtctcgaaaccaacaacaaaagaaacaaaacaaaacaaaacaaaaacacagacctttgttgggaatgtgcaggctttgagcaatccaggtctgctgagtcagccttttcctgtgcacctggtgaggcctggagaattttccttgggcaaggctgggcgtgactgctccttctggcacctccctggtcagtgtggtggagcagtggtggtgctgggggctggaggagccagtgagggcactagtggtggaccctcatgcccaggattgtggggagcctactggcgcctcctaggctgggtcagagctttcccagtgccccacctcaacccctgcccagggcacagcaggttctcctgggccttggacctcctccagccagagaagtgaggctgtcactgagagtccagcagcgccaggcctatgccagtctgtatatgggcactgtctcacagcagctcagagagacaggcatgtgggtcccttctttagagccccaggagattggggctgcccccgagggtggggcaaggcaacctgaaaccccactctccccactgtcccacacctcctcctgagcgcatgggtcatgtgcctggggactgtgggctcctccagctctgccagtgcgggccctgtgtgggaggtgaaccctgcctggcgactctccccctgcagtgctcagtaacctgtggcaacggcacccaggagcggccagtgctctgccgcaccgcggacgacagcttcggcatctgccaggaggagcgtcctgagacagcgaggacctgcaggcttggcccctgtccccgtaagccacctgcagcccctgcccctgctcccagcatgcagcagcccagggcgggggtgtcagaggcttggttcaggcaaatctggctcttcccggagagtagctggactcaacatctgtgagcatggagaagcggggcactgcaggccaggtctgggacctttgcctggcaggaaatggagggagctgtgtggagctgactcgcccctccctgctttcagggcactgcagactcacggtgacagcaggactcggccagctagggaatgctggtggctatggtgtagggggtgcctgtgtgaatagggggacgcctgtgcgagtagagagtgtgctctgtgacctttgaggagaaccagaatacctaccacgcacagatgcctgtccaaacgctatacatgtgtcacctctaaggtctccacacagttcaagactggaccgtgcctgccacagttcccttctatagaggagggagctctggggggtctaggcacctgcccccagctggggagggtgtatccaggatctctcattcccctggcactctctgtccaagctttctgggagctcagagctcgagtcagcaggtggaacccggggcgcgggcagggtgcaggggcagaggagccggcccagaaaaggaggcggcagggcctgcatgccagggcagcgagagggacgggatagctgagacccagctgagaccccggctgctgtcaggaggggcaggaggtgggcgtggacttggcagcggaggaccctttgtccgcccggggaggcgagggccttgaatgacgcttccccaggaccccgggagacccggagcctctctgcctggggtgggggccccagcctggtgccctgcggccgcagcccctctctcctccctctaggaaacatctcagatccctccaagaagagctacgtagttcagtggctgtcccgcccggaccccgactcgcccatccggaagatctcgtcaagtaaccgacccgtttataactctgcctctgccctccagtgcatgccctgcgccctgtggagcttgccttgggcccccctcctctctgtctatggaaagctcccctgactctgcgggcgcgctctggggtgaccgttttctcccgggcctctgagctcggcgtccgctccgggccgcgctgcctgctggcgggggctcgggcctctgctggggccgaacctggttggtgatggcttgtaaaggggcaaagatctgtcgtggttgcaggaggggccggtggccaaagggcgaccctccgggccgagcccgtcccggcccgggggggttcgcggtctcgcggcgtcgtgcggggaccccaccccgagtttccggcactgccaggtgcttcccggctgccaccgccgtcgctgctgccgccgaccctttgctgagcgtgtccttctgactcgtggaactatggcccgcttccgcccggccttcgcgcagctcacagccccgcgcggccctgtcctgcgggggtccggtcgcggaggcggcggaggggcgcggggacactccccacctccactgtccgcccgtcggccccggtggccttttctcgcctcgcgcacagctcccccgccgcagggctgagagagagagtggccgtctggtgcgcgcgtgcctcgcccacgcgtgtgaaccactacagaattacctcaatttttattgcttttttgcttagaaaaactatgtagaagatgccttaaagttgaaaggtaacgggattggctgccaactccagcttcagagggggaacgtgggccagtagaaggcagggaaggtgtaggggagccggtgcgttcatccaccttttgccaaggttgaggtttccaagtgcagacggcttctctccttgggctgagcggtgcgcaccgtccgtctccgcggactggagtctgccctgatgccccactggccagtcggcgctgactgttgcatggagcccccgagggtgctccacagcgcggccttacacccagggggcgaccccctgggccctgagccgcgatccatgtagcactcctccccgcccctccaccccagccaccgcctctgttcacaccgcacccctgccgggcggccggcccctactcccgcggctctgaccgccgttctgtaaataactggtgtgcacctgcgtactaatctcacgactgttaacttccaactttgacgaggccatgcgagcgacacgcgcgactggggaaggtgcaatactgtcctgggcatatgcactttggtttatcagggatattttattagtgttttgtatgtatttaatgacgtattctataggttccattgtcgttgcttttctggttttttttatgagacgttagcgtgtgccaaagtgactgtgaaaatgacctttcattcttactaatgatggaaagacctcctgtcatgcatcccacaaataaactcaataaaagttccatgaaactgggtgcgtgggtttggcaagctgatggctccttctctttttgggggcccagacactgaggagttgcggggcctcactcagtagcattaactaccccggtttctaatttgaatgactttactgccccactccccactgcccaacatagatatttagggcccctccccctgaaaggtgtatctcccctccccaggtattttccaaaatctgatagcaaaccgtgcagacaccccaccgtgactccgggttttgaatcatgtcatatgagcacctcgcaagaatatctaggttctatatggaggtctcctcgtcaggaaaagggcccgagatgggtttctcctcatctttggagcagagcctgtggagtgggaatgtggggtcagtagcccagacattgctagtccaggtcacctgccgtgagccaccagcaggtcactaccctggctccaggcacagttctcggccttgggctactcgtccaggaagggagaggtgcccatccggctcaggtggggggctgggccagccccgggaaagcctgggtcgggagaggggcagggcagtggtggctctctgggcaactggcctgcccatgtcttccaaggtcttcccaggcagccacagggcctgtgttctctcacattgctgaaaatggccagaaagagggtctgggttcaagagggacctcctgacctggggcctgggctgtgtcctgcccatggaagtctcactcctcccttttctgtaccactgaggagtcccaccagggagagggaagaaagcgtggaaggccatgagaaagaacagtggggagcagcccagtgtcatggggacaggccttgggcatagggccgggcccgggggctagcctggggagggagcaaccatggtagcgatggctgagttcagcctgcccagagctcagatcattgatcatcaaaagcaatcgcagcttaaaggagacaagaagcatcagggaaaattgggtcagacagtgcttccctccactcagtctctcttcccagagatgggtcaggagcaattcccgctaagaggctcctaggccagagctagagacgccgcctacagcccaggtgccaaggagggcacatctggaggggggtgcctcttgcttttttaaccagctgcatgaccttttgaatgttggcatgggtgtctgagcctaccactcctttactgagaaatgagaatgaggtattctccatccagcattttccaaagcatgggaaatggaaggtgattcggtggtgcataaacatagctggggctgcactgcactgagcggtcccttcctagttccctttatgctttatggtgacctcaggaagaaagcctcacttgctaccagctttagcctgtctcacatttgctcatttcccttcagctcagagcttggcaggcaggagtctctctctagaatttgatgagttaaagtgtgactttgaaattgactttaaaaggactttaaactttttttttgtattcctattttagggttacctttgttcactgcagtagctttccatgagtggtaatagtataaggtcttctaaaacaaattttaagtgtaaaaaggagttaatttaaaggatatgactaagcaaataataatgcaggtgctgttcaggtgtagccaagatcgtgggagtagcctacagtgacttaagtttatgaaaactgtgtttactctcaatggttgattgtcattcactggaagacaataggtctcactacttgattgctactggaaatggccgaagaccaaatattgtaaaaccacagtgttcatcttggcggagaggcatcgccagtcattacctcaggtgcatcactcttctctgtggtccgtgatgatacttaaaaatgtacaaacctggggcatctttaagatcagttggtcatgatgactttgaaatttttctaggctattttgaaattttcctaggctatttgcatagtcaatctcttggccaggattttatttcaattttgtatttactcattgacgtatttttatttttttaaactaagagcaatgccgcccactgtggggagaaaatcagacatagaagtccagtatgtagaccaggtggaagggggaccccacctggggctgccacccctcactcaatgggcatttatggagcactttctcgtgcatggctctgacctaggcgtgcacttgacccacgatcagtcaaccttttctgtaaagggccaggtagtcaatattttgggcattggagcccacatggtctctgtcacaggactcagctctgcctttatagtgggaaagcagccacagataagaaatgcatgggccgggcacagtggcttacacctgtaatcccagcactttgggaggctgaggtggatggatcacaaggtcaggagttcaagaccagcctgaccaacatagcgaaaccccgtctctactaaaaatacaaaaattagccgggcatggtggcacgcacctgtagtcccagctactcgggaggctcttgaacccaggaggcggaggttgcagtgagccaagatcacgccactgcactccagcctgggcgacagagcaagacttcatctcaaaaaaaaaaaaaaaaatgcatgggcatgggcctgatccaataaaactttatttacaaaaccaggtggagggagggacttggcacactagccgtagatggcccaccactgtaccaggctgatgtgattcctgcttttcagggatcccagcctggtgggggagacagtgagggagtggagatgtggataaatgtgtaacaccagccttatctgtgtgaaggaaaaactatgggcaacaggagagggggcagtgtgcagccagggtgtccctcccagcaccatcaggcccaggctccctcctttgtcaaagcctatggggtagggagaagggaggccaccatcagctcttatccagaaccccctgtgtttccctgagggtagggctcagtggtttcacaaaccaggctgctggagaggatggggtggggcagggatgggagctctgtgtctcctccacccaccttcaaacagtactatcatcagcagtccgagtctatctgtttcatatattgggcacctgtgtaagatttttatctgagaaaagccttctgccagtttcaaaatcctgacagccacatctcaggatcttccgatttgatttctggcatctcccctgggtaccaggccctcccccttcctccttggcactgtgagcatggttcttgggctcagtgtcagggagatccccacttctcctgatggccgatgggttttaactcccttttcatggtggaccctgcagccagtcatgtgttctccttattttggccacgtagaagctcagggccgaagtcgggcaccctctgatgcatgggcctccctgcattcttcttgcctggaaattgccattttcagattcaaaatttccctgttttgaacttcctcagttattcacattgatctttttcataccttatcttttttatgcctttatgcattatttggttcactgttctaggctctggggctctgccctgtggagctttcaggataatgaaaaagtctggcactagtcattcatctgacaattagatgcgagcttggctgggaaggcacagctgctgagaccgtgtgctgcagagaccttacctgctcaaggaggtcaggcgatgcctgcctgaggaagatgtgctccaactgcccctgaaggaggaagggtggtagctggaggcaggagagaggcattgcatgtgcaaaggccctgtggccaaaaggagttccatgcagagcaaggagtctaaggccagagggaggttggaaaggggaaagggacaggtcagggacttcaagtggcggggggtggggggggggtgccgtggtcacatcttcagtgagaaaacagcattctgactgaagcaggatagctggatgacatgggtgaagaatggacacagacccctcccatagtgcagccaagaggcagctcagccagggtggaggtgggagacggggaggaacaagggcatatctgagagtgtctaggacggggcacccaggtgtttggcttgtgtgcctgaaacaccatgcaccgagacagggtgggcagcagaggccctaagctcacgctgcaggggttgggtctcgggcttttgggacccacaggcccttggtggatttggcttgtagcaagtctgaagcttcaggggtttggagctggtggtctgtcaccagcttctaagggaaaattacaggctggagcagtggccattaagaagcaggacatcagaaccactggccctcgatggaaggaagggggtcttgtctgttttggacagcttcaggtgtagattgtgtcatatgttggtgtatgggataactgtcagatgtggctcccatccaatgcctgagcctttctccctccctttctccctccctttcctcctccctttcttccttttgtccctccctccctttccttttttcctttctttccttccttcagttcctccttcctttcaccctctccctccttccttcctttcaatagtagatgagttcaactaaggagagtgagggaaaaggagggcacgtcgggggtttgtgtgggaaaggtctgaagtcatcactgtggagagtagagagcagctgagcagagaccacaacaggcggtgttgggctcacggaggtcagtgattcggaatttatactggatcaagtatctcctgtaacatgacttattctttcttcttgagtgaattttttaaaatcatcttaatttttgtgttgtggaatgaggggatggggagagggaaggggtgaaaacttgggaaggagacagagagtaaagagagtgtgagcgcaagaagagttgatgggttgaatgaacatagccgcagacagaggtcgagatgggccagggagaagatggctgggtggaaagtgagagataatggtggcttctgtggagagtcggggctctccatgtaagctggaccacagatgaccagtttcttgggtggaaaggaaagagaaagatgtgcagggtggaacgattaatctatgtgagggcagcacgtttctttgggaaatggctggatgcgcaaggtggcggtgctatagggggatggagcagaggctggaaatgaggttgttgggtaagttgaggcaagtataagaaagcccatgcaggtttgggtgatgtttaactttcctttaggtgctgttcagttaaaagatcgtccggggcatctgggtcagaatgggagcaacatcagggagttgtggagcatggtggggccacagcggccctgggatttgctatattgggtcttaggaattggctcttttaggtttaattttgttatagttactacttagagattattgtagagtcaagccttgccacagaatttcactggggttaccactgggatgtcaaatgtgaagatgtgataaagtcctattctttaagatgagtttggaatcactctgtaagaacaaacgggcctcatttctttctcaaactttaagagatactgaaacatccaggttcaactggggcctgcttggaagagggaagccttgctcacagcttgtgtgtcagcacttccaggcaggggtccctggacactgcctgcactggggatgctttgacactgaacccacacagactttctgcctgggctcacttgcctctgtgctgtctctgggctcttccatatgcctcctccagcaagctgcaccctgtgggggaacaaagtcccccttatcttgtcctttggttatttgtcccacttttctttttcagagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgt

SEQ ID NO: 688 - DNA, 64994 bp, Human
  misc_feature (1)...(64994): n = A,T,C or G
accacacccagctaattttttttttttagtagagatggggtttcaccatgttgggcaggctggtctcaaattctgatctcaggtagtctgtctgcctcagcctcccaaagtgctgggattacagacatgagccaccactcccggccatgattgtgttttttcaactgcaatctcagtgtctgacacataatagctgtaagtaaaattacgttgaattaatggagaaaaaatatgtaataattaaaagttgaagtatcctttctgttccctggaaaagacaaagcaatggaacttgggttgaaaaggcaagaaatctgtgaatcgcaatcctgatggttaaaatgctcagtaactagactcaaaaattcctttgtggttttagttgatgactgtataatcatttggagacatcaataatcactgtaatccctctagtatgagaatgtgtttcagaatctgtaaaatgatgcatgattttagtggactaggactaggttttgtggtaataactggtcctcagcgtaatttctattccttaggaatttcataattatttctattctcccagaatcttttcaatagaaatgatactgggagtacaagtcagctaagccaagggaaagcattagagtatatgactaagagcccagacaacacatagttcagattccacttctaccacttactggataggtgactttatctgcttaatcttcttaatctatacaatgaggggacaactgattcttaatcttttgaattttgcctttaaaaccccaaattttcacctgcaaaatgattgtaaatgcataatacatgagtatcataaagactaataaaataacaagtacagtagatttaggagagtacctgtattagtccattttcatactatcacgaagaaatatctgagactgggtaaattaaaaagaggtttcatggcctcacagtttcacatggctggggaggcctcactctcatggtagaaggtgaaggaggagcaaagacacatcttacatggaggcaggcaaagagagcctgagcaggggaactgccctttataaaatcattagatcttatgagacttattcactataatgagaacagcatgggaaaagcccgccccttgattcaattatctcccactgggtccctcccacaacacatggggattatgggagctacaattcaagatgagattcaggtagggacacaaccaaaccctatcagtacctaaaacttaataagcagctcagttgatattagttattttattggttataagtatgatttttagacatgcccagtttagccttactaccaccagtgacagatcctaaaattgtatcctttgggtcttgaatccttcttccacactcctcattgccagttatgacacaaatacccccaaggatctaaaaattattgtgcttatattgtcagacattcttatttcaggatagttcaaacttcctgagagtacacttgtgtgaggaatagaacataaaataatggaaaagagaatgctatatagtaattaggttgaattagaaattgctttacataaccacattatgtatgtgggggaaaaataacattcttaataacttttttcctacaactgtatatatataaaaatatatttaaacatatatttatatatcatatccgtaatgtaaataaatgtctagcatgtttttcaagactcattaatgcagttgcctctttccttgtagcttatctggctatagtaatatgttggaaatgtactactttggagtggggagtatggcaaaggagagcaaaacaatagttcagatcaagtaatcttagagccaggaggcagccaggacttccgcctgctgggccattgttgcaggaccacagcttcgaggttgcgcaacacctttagtaaacacttcctgaatcagagacaagaatgaaccagggagtttcattctgtctcactggagaggaggcagggacagacccagcagcacccacctgagcgagaagagcagacaccgtgctcctggaannnnnnnnnnnnnnnnnnnntcctcctctctgttgcaggtacatatttagctctttttcaggttctattgaatgcattagcgaacttttcatagtctcctaatagttttattgtataaactattttgacttttttctttttcttttttctcaatcaatcttactaaccagttgggctggttttaacctgttgtttgggggctgcgagtgatacaaagacaatgttaaaaagaggcaacaagaggtcttgaaccaatatgtatgcatctcatctgagaatatacagaaataaaagggacaatttcatacagcacaatttaaatcatgaatatgatttttgactgaaaaagtggaattcatcaaaacccagcttgtcatttaaagaatggtaaagatgtggcagatttatttatttattactgtgtacaaggcttaggaaaatacctactattattatgggagccagtttggctctttctgtttgagtgtatatttttgtatttactcattattagtaataatacgtgtgactaactggaaataattaatattttttatttataaggtattgtgatattacttaacaaaatatctctgttaagcttaaattgataatttacttctattttgctgattataccaaacatttaaaaatttgaaaggagaaaaatactacttcctaacaggaaattatgtctagcaagtctctcaatttctggtaaattctctaattagactttggttaaattagattgggtattgtgattcttcagcttctatttccagtagcttatttaactcagcacatgaactgcagtgcctcgaattcctcccagtaaacctgttcttgggtcttagaatgtttgctgggacctggggatgggaacagattatcaactagaggtatgggcttagggagggaaaagttttccttgtccatgcaccctcttagtactttgttgctaaaaatgattttcctgtgtctcacctgtttctgatttgttttcaagacttataaaaatttcacttaacctaatatctttaaatatcgaattattttccttttgtttctgtgtatttttgctttatataatatgtacctatatctgaactgaaccttttcccactgtgctgtgatcctcttcatctctaatgccttttgctttgatacctattttgtctgatgtgaacgtgttacaccagctttcttttggtaaaataagcctgaaatattaaaaatatatataaaactcatgccaggcatttaacattgacctgaaattcctactttttgaggcagacttaatagaaatgtttttttctctccgttctccaaaaatgctatcaccaagagcttttccagaaccccctctaagctgaaatacaagaactgcttgggcactagcttagttgaagagcgtaaagatcaagctggatccattaacagagtcacatggctaacactggggcccatgcacattacagtccttttgtgcaactgggcacactaatcagttctgctgccccgacggtgcatgtataacatggcaccaagagatgcaacttcctctgatgtcaactctaaaagtgtgatgtcacccctcctttaacttctagcttctatttttaagggtgtctttttgccactgaactatccctgttatgattcccatttgggttgcctttctagtcagaatataagaagtaaagcaattttcatttcccagttcttcctgtttgttctctgcccccatcatcaaagcaatacatatgtgcccctctgaccatgacttctgcccagtccccagatggttgaaataaaagaaagagatgtaaaataaggctggttgtgtgcagtgaacttcacaatcccgagaaaaaattgacttatgggatttcatcctaggaaaaggaaaaacaaatatttaaaaggatgtgacaggtgtttgcggggtgaagatgtaaatgattgcatcaacaaaggagaaaggtgcttaccttattacagcagaatactcagggggtacagcactttttgaaattattttatttcaaactaccagttcttccttgcctttataaggtaactggaagactgaaaagaaaatatacagtttaatctaaatagtcaaaataacagacctaatagaaatgcagttttttcccttttgtttgtactcacttttaatgcatgaagtttaaaaccacaagatggtttgaggagatgcagagaatcccaggacataagtcaatatccttgtgtaaaccctaattcagcgtttaatatgatgtgttcagtttggaaagaagacatttctttgaacagtttcaaacacatttgaacgaaaatgaaaatgtcaatattacatactcatgttcccatttccaaaatgaccccaaacacatgaacaaataatgtagcaatccagactaatgtctctcatattaacgttgttaatgagctttggcttttctaagactcaaaacagtcaaaaataattatcccatctaaaccaaaataacagttttctttttcctgatctggttttgctagtcaagactaatccagtgtgtgagttctgtgggagagagaaggcaagtattaaaatgaattagtaaaaacatattgtgttacaccttggatttgtgtaatccctggatggcagttagttgtgtttgttcctcaggcttcaaaaataattaacgtgatgttattcagtggggaagacgctgcaccatttccattaaacttaaggatggatgagctaaacaatatttaggtctgttacatccctacaatggctgtgtaatttgttgtattccagatcccattatttcagggacttctaggtttccagaaaataagagcctttaagagaaattccatttagtttctttagagaatatatggagtgacaggagtttggaaggagctggaattccattcacttcaaactgaagagattgagaggttgccaatgatttctaaaagaaatgttgtgggtttttttttttgttgttgttgtttgttttattttgctttgtttttggtttccatttggaagtgttcggccaccaaaaagttggaaataaattacataacttacatattttaagcccatatttaagagccagtttgcaatttctaatttcatgaaacattgggattcagatactaactagaagcatagaggtcagggtgcatgtgagagaaaatttgtgttggctagatgagcctgttttccttcttaccatttctgaatggtgctgagaaggaaactcacttcattttctgcttttatacaaaaaatcgggaacgtagctattattttattccacgaaggcagcttggactactatttcctgttagaatcatgtgtgttctaatatagcatttaaaaagatttatgttggctgcaacattggtgaaatttggcttcttgaactctctatcttaacaagactaattgcattgattagctactgtaatgtaccaggcagcacgtgggtgccttatggtatgcttgttttgtgtccctgaattaaggaggcagcagggaattgtgtcaatatcatcagttaatttctggcaggagtaattttcttacctcttggcatcttagtgtttcaaaataattacaataattagaaaaattttaactcagaaaaagaatcatcaatttttctttaggtttttgaacttatgtttcaaaaattttttataattgatgttattcttttcctttaccaaaagttaatttaatagaaataaaagacgcccagcgattacctctgtgacagcaagaaatgaggaactgaagaaccccgtgatgttgttcttgaagtgtgacaatgtaatgaggcttattttatcacattggatcagaattcagttatcctaatgatcactgactcttgaaagaggttataggggattctgtacttgtatgcataaatcataaaccacttgaactagctttagaaaccatttaattggcgtccttttttcaaactatttaaagactcaaaccaaataaaaaaaataaggtattctaatgtcagtgccatggctttaagtaattttgaatttttttttagagtaactcttacaccactgaaagaaaagatagttcattactttaacaccccatttttgactcaaagagttcttagctggtttaaaccctttttctgttcttcaaagttaaatgtaagtgactcttgagtcgttaaatgaattaaagtcattctcgagtaatttttaaaaaacgctgttttttgaaagtttatgctttagtttctgaagaaaactttaaacaatgttttgctctgtgggaagtgactggagtaagtgcacagtcctcctagataagcaaggaataatacttattaagtgcctcatctatgtttgttaaaagatcaaccacagtaacataaatgtatctcaccatagaacttaagatttgagtactttaatgagctggcattacctttagagaccctcctagtccttactcagagaagagaaaaaaactttttcagttttagtcttagaaagttgtagagttaggccccattctgctactgcagtctacattttggttaagcctgtagccacctgtagcagctaaggagcaggtctatcgactatatacagagcagagactagaccacatgggcaaatcaaaaagaaaatagaaaatctaatgttagcttcgagaaaattgaatctctctctccaaaatgacttctaggccaggtgctgtggctcatacctgtaatcccagcactttgggaggccgagccaggaggattgctacagcctgggatttcaagaccagcctgggcaacatagcaagactacttctctaatagaaaaaaaaaaaaaaagccaggcatggtggtgcacacctgcagtcccagctactctggaggctgaggtggaaggatggcttgagcccaggatgttgaggctgcagtgaaccctgtttgtgcctctgcactccagcttggtgacagagtgagacattgtctcaaaatacaataaaacaaaatgacttctaaagacaacatggagaggagcatttaaaatgcagataggttggatcaaatcacttttcagttctctttcaatatgactgcaggctcaaaaaagtccttccaggccagtgattctgtttgaattatctgcttctctaattttcattttttaaatgttctgtatgcaaaaataaggtttttctgtactgcttatgccagctcattctatgaacctagtattggagccttttcttactgtgacatagttttttttattagtatagaatattgctgttttcaaatccaagaaaaatagaataaaaattgtgcacattagttattttatttttctaacattgtatggtttccagtgcttcaacccaatttttctgggactgattcgcttctcagaggattactttcgcttctatcttcacttctttttgcctgagctgttgctatttccctgcactgcaggatcaaagataagaagtgggaaaatccaaaagaaatactttctctaaatacagtaacacctgtaaacttttagtggggaaggatctgaagatataggctaaagtaaaactttaagaggaaagagtagctttctgaggttgttgctctcttctggtgtcagcacattaatcactctgacattcatcacttcaggcttctgtgtgtggcatcgttcattgggaatgcagtaaggatggcctttactgaccagcctacttcagttctacctggataagtcttttctttttcttttttctcagtaagtgctataaaagaactccctggggtgaagaagtatgaagtggtttatcctataagacttcatccactgcataaaagagaggccaaagagccagagcaacaggtacagcttttgatttatcaaaggatcttgatttgagatacatatatacacacatatatatatctatctatgatgagagatagatatgggatttatacatgtatgtttatatatgtgtgtgtgtgtatgtgtgtgcctgtgtgtttcaagtggaatttgtgatgttttcagcaattacaccttggagttaaataacaatgattatatttgtatttgtttttgaccttttaaaaaatcttcactataacccaaagttatattattaacctcattctacaaatcaagtttctgagaagtgaaagaaactgtccaaggttaaaaagagtaaatttgttttttgttttttgtttttttttccagacagagtctcgctctgtcgcccaggctggagtgcagtggtgtgatcttggctcactgcaagctccgcctcccaggttcacgccattctccgcctcagcctcccgagtagctgggactgcaggcgcccgccaccacgctcggctaatttttttgtatttttagttgagacggggtttcactgtgttagccaggatgttttctatctcctgaccttgtgatccgcccgcctcggcctcccaaagtgctgggattacaggcgtgagctaccgcctagccataaatttaacattttatgatgatttattctacgtacttccaaaagaaaattggatgctatctctctatctatccatccttccaaacacaactatgacaattgaaacagaaacagaaaacaaaatacagcaggtgaatgcatgtatatatgcacattaacatgaaatttacctgtcttttctgaataggctcttcttaatgtttgtacgtttcttactgcaaatgaaacaacatattctcagtcaacatttactcaataaacatttattaattctaagagaaaagctaaaacatgatgattcattcaattataacaatgttataattacctgcactcttaagtcttcttctgggagccagcaagatacagataaatgagacacaaataatagtttacagaaatactctgaaatccagcacactcggtgcacatattccctcactggacacggtttcccatagcatttcttctaaagcaaatttatgaaaacagaacctgtatttgaccccatttcccaaaataattatcaaccaagtggtttcactaacttcagatggaacccaaaagcataggattccccttcaatatgactttcttcaaatgctctctaagactttctttaaaatgtcagacaccttttttcctgttgtgcattatgcttattatctgggtgacaaagtaatctgtacaccaaacccccatgacatgcgatttacctgtataacaaactggcacaggtatcccctgaatctaaaataaaagttggaaaaaaaaataaggatttttaatatattttcatatttagtcctttcaacaaacatataacttaagtgtatttttacagtattttatttctaagtggagagataggggctcagaaaatttaagtaccctgcctaggagcacatagcttatacgttttctagctaggattcaaacctctgtttgactccaaatgacaactttatgtgttagtattatttgtggctgcctatccaagcagctaaattgatttaatatatgggagagtccatatgttctcctgagagcctctgtgggatcaacacaggctttctggccattaaggtagctcaagttctgttacactaaagtctaagagtcagtctgtaaccctgagacactgaccagtttgttgtatcgtttactgttaaaaataagagactcatcagctgaattttttttctaataactttttgtctttttgaaaattctattttaagttctgggatacatgtgcagaatgtgcaggtttgttacatagataaacgtgtgccatggtggtttgctgcacctatcaacccatcacctaggttttaagcccagcatgcattagctatttttcctgatgttctcccttgccccgccgcctaccactcctcagagtgtgttgttcccctgcctgtgtccacgtgttctcattgttcagctctgaattataagtgagaacatgtggtgtttggttttctgttcctgtgtaagttcactgtggataacggcttccagctccatccatgtgcctgcaaaggacatgatcctgttcctttttatggttgcatagtattccatggtgtatatgtaccacatttcctttatccagtctctcactcatgggcatttgggttgattccacgtcactgctactgtgaatagtgccgcaatgaacatgtgcatgcatgtatctttgtaatagaatgatttatattccattgggtatatacccagtaatgggattgctgggttaaatggtatttctggttctaggtctttgaggaattgccacaccgtcttccacaacggttgaactaaattacgttcccaccaacagtgtaaacgcattcctatttctccacagccttgccagcatctattgtttcttgactttttaataatcaccattctgactggtgtgagatggtatctcattgtggttttgatttgcatttctctaatcatcagtgatgttgagcttttttcatgtttgttggctgcatgaatgtcttcttttgagaagtgtctgttcatgtcctttgtccacttttttttaaaaattataccttaagttctagggtacatgtgcacaacgtgcaggtttgttacatatatatacatgtgccatgttggtgtgctacacccattaactcatcatttacattaggtatatctcctaatgctatccctcccccctcccccctccccacaacaagccacagtgtgtgatgttccccatcctgtgtccatgtgttctcattgttcagggttgtttgtttttcttataaatttaagttccttgtagattctgcatatttgacctttgtcagatcaatagattgtaaaaattttctctcattctgtaggttgtctgttcactctgatgatagtttattttgctgtatagaagctctttagttttattagatcccgtttgtcaatttttgcttttgttgcaattgcttttgatgatttgtcatgaaatttttgcctgtgcttatgtcctgaatggtattgcctagattttcttctagggtttttatagtttttgggtttacatttgagtttttaatctatcttgagttaatttttgtataaggtggaacaaaggggtccagtttcaattttctgcatgtggctagccagttctcccagtaccatttattaaatatgaaatctttttcccattgcttgtttttgtaaggtttgtcaaagatcagaggattatagatgtgtggtcttatttctgacctctctatccatttccattggtctatgtgtctgttttgtaccagtaccatgctgttttgtttactacagccttgtaatacaccttgaagtccggtagtataatgcctccagctttgttctttttgcttaagattgtcttggctatacaggctcttttgtggtttcatatgaattttaaagtaatttttttctaattctgtgaaagatgtcaatggtagtttaatgggaatagcactgattctataaattactgtgggcagtatggctattttcacagtattgattcttcatatccatgaacatggaatgtttttccatttgtttgtgtcctttctgatttccttaagcagtggtttgtgttctccttgaagaggtccttcacttcccttgttagccatcagctgaaattttacaagttcacctgtatcttctttgttatcaaccttttgctactaaaccaatgattaattgtgtccttgtggaaatttacactaattatctactctttatgtgtttttttctcacagtaaacaatgcttccaagaaaacccaacatttacacacacacacacatgcacgtgcacaccaaacacccttttttcactgaacattttgaggaaaatttaaacacaagtgaagtgtttttaatcacagctgtgaagtgatttcctcacgactgtaaaaaataaatttgagttttgaatatatattttgattaacgaaagccatagactagttactggctcatactagatgaacaatattaatttttgcaatgattgactaggtggatgaggttgatataatgtgcttgatatttactgcagttatattatttatctagtccattactaggttaaatggctacatgaaccttacattttcctgatccatagtgcaagtatataggagctgaattcagaggattagtttgtgttcacctgtaaattttgtccattctctctgtataaatttagacaaacataaaccttacgtttcttgtcttaaagtggagatgatcataatacttgtataaatatttggggataatgtatatgaaaagcaaggaaggatccaaattttaactccctattcaagattatgctatgggctgggtgcattggctcacacctgtaatcccagcactttgggagattgaggcgggtgggtcacctgaggtcaggggttcaagaccaacctggccaaggttgtgaaacctgtctctatcaaaaatacaaaaaattagctgggtgtggtggtgggtacctctaatcccaactactaaggaggctgaggcaggagaatcattggaaacctctaatcccaactactaaggaggctgaggcaggagaatcattggaacctgggaggcagaggttgcagtgagctgagatcacgtcatttgcactccaacctgggcaacaagagtgaaactccttctcaaaaaaaaaaaaaaatagattatgctatggtgctgccctgtgtagcccatcatattccagttcttatgactaattttcagtttttgtggcttcatgtcccagttaataaacctttattttaaaattcttcttttcgacataaattatcaacttcaggttgcttttcttaataatattcttgtttctacttctatgttttttttaatggatttcttgctacttaaaatattctctctacatttagagtccctcccatttaggggactctatatttagagtctcttatagtctttgttaagctgacttgccatattcatatatacactaatatatccctatcctgaaatcgtgcgtcagtcacagtcagtattataaagtttagctactgattttaaaaagaaatgttgattttgtgtcaggagcgatggtgtgttcacaagtgtgtgtatgtgtgtgtgtgcatgtgtttctatgagagcaagtgtaaccttcacttctggtttgaaactgtccaggtaaatttttaagaggtttcttttttttttttttttttttttttttaaaatatgtctttgctatgtctctactcctccttcaccctcacctgccaatccttgtcctggaacataaatacttgtttcattaatacatgttggtctaaataaatacttgcaaagcacattaattttatctttaaaggaaataagagtattaaataaacaccatagataattgaagaaaaaattacctaaacaattagaaccttttaatgttcctttaaatggaaaatcttttatttttttagtttcatctattacatttccaagttctctcctgctccctttggttgaagagtgtagaagagaatatattatgaggcctgatgaatataatggaatgagcactgaatgcttccacagcatctcagaaataaatataactctcccatgtttactttttaatatctcaggtgtcaggtgacacctttgaattaccccacaataaccatgtggctaaaccattagcagtaagttttgccagggtttaattccagctgttcacagggagatatcaaaaaccgcatgacagggttgccagatgaaatacagagtaccagttaagtttgaatttcagacaaacagtaaaacttttttgtataaatatgtcccacaccactttgggaggccgaggcgggtggatgacgaggtcaggagttaagagactagtccgaccaacatggtgaaaccctgtctctactaaaaatacacacacacaaattagctgggtgtggtggtgcgcacctgtaacaccagcttctcaggaggctgaggcaggagaatcacttgaaccctgggaggcagaggtggcagtgagctgagatcatgccactgcactccagcctgggtgacagagtgagactccatctcaaatacaaataaataaataaatatatatatatatatatatatttaaaaatatatatatatatgttccacacaacacttctgatataattataaagaagcattccaacagaatgaatctaattttcccagctagtgcatttgcatctcttttccttagtcgctgatctctagtttctattctttcccacatcttctaaactcctccatgtgcaggattgtcacatttagcaaacagaaatataggatgcccagttaaatttcaaataaacaacaaatatttcattagtatgtcaccatggtcatagggggcatatgtattttaaaaagtattgtgtgtttttatgtataaacaaaaaaatattctctgtttatctgagattcacatttaattggcatcctgtattttatctggcaatcctatcctgtggcttttgatatcaccctgtgagcatccagaactaagccctagcaatctgtccatgattccagattctgtcctatccacagatctaaggttcctaatgctgctgcatgcctcatatctcactcctgccctgttagggttcttgggttctgccatatcacagttgttttacaaacatagactgaagaagctagtgacatctttgtttgccacacaacaaatacatgatttccattggcatagactcttctatagtctctcaggcacaccttatgactaataagaacactgtcttctagatataagccaagttttaggagttatctttgtagtttctgtgttgagactatgggtcttccctgtgcaaagacttgattagcaaatactatttgaaacgatcccaaattcatagtgcagttgaccacccttctgatcaaggggatctctgtatatcccatgaaagcttcataggtctcaccctagattaagtgcttcacttctcaagacagtgaacagatggaagacttttgtagttatcattatacaactgtgccctgtgttgttttattatacaaccagagaactgaggcactggctttacctgtcagctacgccagggttgtgacgtcatctttctgacttgatcacacatgccacattgcttaatatttcagctagactgaaataatcctgtgtaaaaatttttgggggctgggagtaaagaacaaggtggaactttgaatattttattcataatcatattcacgattgtatttatatgaatgacataaggactaaataagtatgtgttaaataaatgaccaaatgagtaagtaaactaatggacaaatgaataaatgtttatgactggagcatattacccataaacctccatagatgcatatttaacctatactctgtgaaagtccctgatgctgggaacttaaattctaaagacagtaactattcttcagagaattcagcatccagattgtacatgttcttagaggcccaaaccatcttggtattggcccatgtcgtaaaagaaaatatcttacagcacaattcctccctcagattgagaattctttcaggcccattagctgatttagcagggtttctagagctcacggatttactgtaagttttgaacaactgttgtattactagaattaagaacctctctgtgtattctacggctgcccttgatatttcctgtgtgcccattgacatcccctagaccttacagatttgctccatcccagaaacatccaggactgtggctttcccaatccacccactaaatcagacccatgtcattattttagaggaaatttggatctatatgtttctgtggtcagctagtcttactcagtaaaaccaaaatcatttccttatagtgagtgctctccaaatcaaggtgcatcttacttctcttgatgcatacttcagaacctacagagtacacaactagaacacacttcttatcctcaaaccttgctctccaccagggaactctctttcaaaagtattattattacattacccagtgtactctctttcatagaggccctggctttcttccttcatctttccttccatccataatctttatgccagtgttaaccaaaactccactccaaaagcatttattcttttctaaaacaaccttcagctaaagttttagtaactaaatctactaaaaagccattgctgaacaggaagcagatatctggaaggccatttctggtagaagaccatatttggtatcattctcatggcttcattctagctaggctttcttaatcctgaacagtaagaggttatgactattctgcataacttttattttcaatgccctttctctttccagttcctgtcatccatgaaaataagctgagtccatcaacctctacttatctaggcccacatttgggggaaatttatagcctgggattactgacagcagagcagacctcaacaactgaggatttaagcaaagtatggactgtaagaattgactttggagagggctaaatcccagcacggtgctcatgatctgatgattctaacatgccttgtctgtctgtgagctcagataccataccggccagaaggggagggagagaaggaaggcttgagcttaggtgcaccacagcagaagaaacagaactcagtccataatatgtgtttctcaacaacctttggtctaccatatttagatatctttaatgacaataacgaggcacttcctaataactttttagatattgagtgcaaccacagccaataaccctgttttatagaccaaagtcagaacttagtaccccaaaacatcttctttaaaataattctgtgtagtcctcaatagctctccttatataccaatatccaagtttaaaataattttccttttacatggtttacccgaggtaatatttcttccttcttaaatacctgggactgtggtttcttcttgatggttcttcctcacattacagtatacattcctgttatgtttctcatagtttatgttccagttagtcttgagaagacttcaagaccaaaaatcatgagatgtgatagaagtttttaggcgtctgtgtacactattccttctaatcagttaacttcccttactcacttcacctgggtaatttatgtgtcgttttaaacattacttcctcaaaaaagcctttcctggctttaagatgtgagacatcctactatatacatccattatcatgcacataactcacctcattgtctgtcttttcacaagatcataagctctctgacagtacgtaccaatttttcttgcttagagtagaattttcaaaaccaagcagtatcttgcaaagaaacagcactcactcaaacgatactttaaaatgcagggatggatggatggaaggatggttggaagggtggatggataaaaggctctcagataatttgtttatttagttgccagagttgtttgatctgtcaagaggggaagaggcaagtatttggtattatactgctaaaaaatagatattgcttgctaatgactacacagatagaaatataatagtcaaatgaatatgtttttaattacaagtaaatgtttgtgtatttttgcaggaacaatttgaaactgaattaaagtataaaatgacaattaatggaaaaattgcagtgctttatttgaaaaaaaacaagtaagtatctttacctgtgatattatcctcagcaagagcaaggcagcctatggagagtgtgctgagtctgttgctgcttatggctcacacaaacctggactaatcagcgtttgctctcaaatgacttgagaatttccatggacttagcaatcagcacaagtaaccacaacatttttgtgtttctttctccaggaacctccttgcaccaggctacacggaaacatattataattccactggaaaggagatcaccacaagcccacaaattatggtataacggagtctcttcaattctttaattagggttttacccacagacctaaaggtagtgtccttgccaggcaaataatagaagtgaaactgcatttgtaacattagtgcttttttcagcagtagccattacttaaaatataaaaaaaagaaaagtggaaaatcaattaacaagaacaaaacaatttcttggcaactccggtaagtttttccagcctttaaggacccctgtaggagggtgggtagaaggagcatgttattttcttgagagtgaagagttacatacctctggtgttctcaatcaatttctatcatttctctggatttgtggtctcttcagccaagactatttcctcaatggcaattgcagaattgcttttcttaaacaatttctctttactgctattcatagcccatcttttcttagactgagcagatgacagtgtgtagccatgtgaggggtcatgcaccattacctctttttctgagctccattttccatgggaagcccttcaagcattgttctctgtagcaataatatcagagtttacatgggtcaacacctcatctgtcccgaactagaaaggtccttcatggaacacccacacgaaaaaatgttaagaagggcattttgctccaaatggaggcaagaaatgtgctgatccagttaatctgatggaacgcttttgataaatcaagaaagaaaaaacaaaaacccaatctaaataacctatcctttggaaaaaagcttgtagatctttgctagaaagaagttaatgagaaaatggccaaaaggaaaaatgagtgtccagtgttttaggagctcaggttttaaactgacatatccaagtttattccatctaagtattattgacattcatcctacttagtcaacattgacagttaataccttgtaaacattttgggatcattaactgacattaacaattttaacttacatgaaagattttaattattttttaaacatcttagtttactgttgtacagcagaatattgtttgaaagcatttaaaatcctgtttcaagatttcagatgcggctttagcagcggtgctaaaattcacatgtacttctctttacaaaaccccttttcctttaggatgattgttattatcaaggacatattcttaatgaaaaggtttctgacgctagcatcagcacatgtaggggtctaaggtaagacttcaggaatgttttgcatgtacctgtgattgtggtatttatgtatgtatctaaccaaccagatgaatcccaaatatcattaatttttatatagttgaatataaatcataagggccataacattttgaaatttgaagaaacaccgcttctcttgatagtggcttgtaaattacatatccgaattgctttcaaatatatttttgttagtttagttttaaaatacaggattttgaatcccagttctggagtcagaatctttaggtaatgggagctgctctctcttctcgctcttcactttattttactcattgatttagatggagtcttgctctgtcaccaggctggagtatagtggtgcgatttcagctcactgcaatctcagtctcctgggttcaagtgattctcctacctcagcctctcgagtagctgggattacagatgcccgccaccacacctggctaggttttgtatttttaatagaaacagaatttcaccatattggccaggttggtctcgaactcctgacctcaagtagtctgcccgcctcagcctcccaaagtgctggaattacaggcatgagccaccacccccagactctctccccactttaagctctcactcgctctctctctagattgccttatccatgactatgacataccattctgtctgttaatgatatactatgcatctgtctatatatagtaatctatagtaaggtggctcttctgatgtccagacttgattatctaattttctttttcatattttcagttggatatcttaaagaaacctcaatctcagtatgccttaaaccaaactaatgattgtcttttgaatctggtatggtttccatgttctttattttaatcaatggtataattagataatcacttgcccaattcagaaacctaaattccttgaggtctgcttgcccctcagccctgcattttcaatcccttaccaagtcttattgattctatcttctaaacactttctgaaattgttcattctgtctctactacgatatcctagtccatctaccatgattccttatgcagaccattgcaataaaccccataatttatcttcttatatccactcttgccattatctaattttatgtacatttaattcagtctgtctattatatctcttgtactttttcttcacatcaattattataattatatataagtacttactatataattatatatattctgtgattatttgatacacatccattttcctcatttgaacataagctccataagaaaagagaccatgtctttatttttgctgtctacccttagtccaatgcctaatgaataatgggtactcaatgaatattggttgaatgaaccctggttcaaggctttagcagagaaaattgagaagaaattgataatatttatttgtcatgtgctttacatgttctctcattcaatctttactatcactatattaggtaggtattaagacaaataaatgtggagaacctgaggcttgtgagtttaaagaattttccaaatgtatcacagtgaatgagttataaagccagtatattaacacttatctataaaactctaaaatccttttcattataagtgtacctttagaacaagtatagcattaaaattggaagaatgctgtaccaagtgtcaggaaatattcattctagtgccagaactgatatggttgcttgtacaacactgcagcagtcacttctccttaatatgtcttatttccttgtagaaaataagtttagataatcttcaaggtatcttcagctgtaagttttactgtattttattgccatgagcttaaattgtttttgacattgactaggaattttaaaggtcctcttttggatcttataaatctgtatgaacctaatgcaacaatatttgttaagaagccagaactctcatgttttttcaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtagtatgtgtaactttatttatttgaaatgctctcatgtattctgccctggtttccagaattagcagtgcaatttactgaaactatagtcattgtcaaaattagtaagttatagagacactaatccttaaatattgctagacattaatgattcatttaacaagtacttaggaatcaactattttttttttttttttgagatggagtttcactcttgttgcctgggctgtagtgcaatggtgtgatcttggcccatcacatcttccacctcccaggttcgagtgattctcctgtctcagcctcctgagtagctgggattataggcatgtgccaccatgcccagctaattttgtatttttagtagagacagggtttcaccatgttggtcaggctggtctccaactcccgacctcgggtgatccacctgtctcagcctcccaaagtgctgagattacaggcatgagccaccgcacttagccggaatcaactattattttcagcaatgtacaaaggttaaaaataagtgtaaaatataactgccctctagaagcaggaatctgtcacactattccctgtagcctacaataaaccacaaagatataaagtattattattaatttactcttgattttagccaaaaagctatgaagtgattattattattttgaaatatcttgctgtcatcataaattcattcaacaaatctctcttaaagtgctgtcacaggtgctgggaagatagaaatgagcaaaatagacatagaatctggctacaggaacttagaatattattttatgtgtggaattctgcttctagtcataggagataaatgaatatagttttgtgttttagactgtatatatcaaaatatctttgttgaccttacttttatttcttattgatactgcttttatttccaagatttatttcaaatccaatcatttcttttaaatgttctcagagtctgtgagcaaagggtataattggtctaaataaaatttctagtcagtttaattttctgtaggtttaaattctaccagcaagttcagtagtaaaggtaaatgtatagtcaaacccagaatactccaatattttaagtgctctgtagatcacatatatctctagtatgacacttaaaaatcaaatgagtaaaaaataatgatgcccataataatttgttaagaaatatataatataaaatatgtatattgtgacattaaaagtataaattgtcagggggaagataaaagtctagagtttttatacatgactgaagttaagttgttattggtgtaagatactccattacaactataagatgttttatgtaaacctcacggtaaatacaaaaaaaaaaaaaactatagcagatacaaatgataatgagaaaagaataaaaatgcagcactacagaaaaatgaccaaatcacaaagataaacaagggaggaagaaatgaaaaagaaatctataaaacaaaatggcagtaggagatccttacctataaataattactaggaatgtaaatggattaaattttccaatcaaaagataaagagtggctgaatggctgaaaaaacaagatctgactatatgctgcctccaagagacatttttaagctttaaagacatgcataggctgaaagaaaaagatggaagaacatattccatgcaaatggtaacaaaatagacaaactcttaggcagactaagaggaaaactcaaatatataaaatcagaaatgaaagtggagatattacaaaagatgtctcagaaatgaaaaaaagatcttaaaggactaatatgaaaaattatttgtcaataaatttgatagcctagagaaaatagatgaattcctagaaaaatacaacctataaaggttgaatcagaaagaagtagaaagcctgaacagaccaataacaaagagattgaaatagtaattaaaaatctttcaacaaagaaagcctaggactagatggctctagagctgaaaagtatcaaacattcaaagaagaattattaccaatactttttaaaattttcaaaaaaatagagacagaaggtgtactgcttagtacttgttacaagcccagcattacctttatacctaacccaagacaaagacgccaaagaaaggaaaactacaggccaataattctgacaaacactgaggtaaaaattttcaataaaatattagcaaatcaaattcaacaacacatccaaaagattatacatcataatcaaatgggacttatccttggtatactgacttaacctacacaaattgatcaatgtagtatatcaattatatcaacagactgaaagacaaaaaatacatgatcatatcaattggtgaaaaggcattaaacaaagtttaacatgctttcttgattaaaagtttaggtagttaaataatggtgtggagttaatggttcttgatttgagagtttaggcatagaagaaaagttcctcaacatcataaaggccatttatttatttatttatttatttatttatttatattttttagcagtcaaatataccttattttattctcataaaatgctacaaattatcttgatttaggatatttgtaaacattctatagcagctaggaacatgtttttccaaaaccaaataaagttttttacatgccagttacatttcagagattttgtcattcttatattcttctttcttcataaaagtaagtgcttgctcaaatatgtgggccttctactgaaattcatttaatatataacttttatccttggcttagttggaattcgagttttgataagaaaggtgtggttgaatggacataatcataggctttcagcaaccacacaaatgttgatagtgtgcaatgcagttgttgatgattaaacaataatgaaaatttaagaacactgttgcattattttatttgaagctggaatgatgtgaaactctaaaatatgtctcagcccaagcattaaggtttacctgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatcaaaagcatttagaaaagacacattcaacttggaaatgaagaagtaaaattacctctatttgcagatgaaatgattctacctgtaaaaaaccctaatgactccactgaaaaaccattaacactaacaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaatgaaggaaattgaagaaaatgcaaataaatgaatatcccatgctcatgaattagaagaatgttgttaaaatgttcatactacctaaagcaatgagtagattcaatgcagtccttataaaaaccccaatgacagtatttacagaaatcagaaaaaaatcataaaatttgtatggaaccacagaatatcccaaatagtcaaaggaattctgagaaaaaaaaagacatcatactacctgatttaaagttatattacaaagatatagtaatcgaaagagtataatggcataaaaccagacacctagaccagtggatgagaatagcaatctcggaaataaatccaaacatatacgttcaattaatttttgacaagggcaccaaaaagacacactggggaaaggatagtctcttcaataaatagtgctgggaaaactggatatccacatgcaaaattatgaaatcgaacccttttcttataccataactaaaattcaaatcaaaatgaaaaagaaacctaaatgtaatacctaaaaccataaaactcctaaaagaaaatagaggggaaaagctgtttgacattaaccttgacaatgacttcttaaatatcatacctaaaagctaaggttataaaagtaaaatgtaagagactatatcaaacgaaaaagcttctgcacagcaaagcaaacaaacaaaatgaaaaggaatctaaaaaagggggtgagggtgagtgtcaaatatatagaggtagagaataaaacagtggttaccagggtctaggtagggacaggaaatggggagattcgggtctaaggataccaagtagccaaatatgcggggttaagcagttgaaagatctagggtacaatatgaggactgttaaggacaaaaagtagacaaatttaacagagtttaattgagcaaagaaaggtttgagaatccagcagccctcagaaccagaagatgttgagagcaattccatgctggtcgttggttggagaggatttatagacagaaaaatgacatacagaaaaatggattaaggtacagaaacagctgcaccggttacagcttgatgtttgccttacttgaacacggtttgaacagttggccacctttgattggccagaagttggtgaaactcctagctatatgttgctgtgaatatcaactcctgggtttgcttgtacagggcctcttatccctctgtttccattccttggtaactacgtggaaagagctttgcttttgagacattttatcgttttggctttcctctacctcaggagtgctactcctcatttcatttctgtcacccttactctgattgactggtaaatattagagaacctcacatagctcaatcctggatctttatctatacattcttcctaggtaatcttaccctgccctgtgccttatttaaataggaactgtgcactaatggccatcagacgtttatctctagcctctgcccctctcctaaaggccagactgttataattatctttttaatatatctactcaaacacctgatatcacaaacctaaaatatgcccccaaaagaactaccaatttctaaaccacaaacaaaacctacttctctctcattctccccattttacttaacactaccaccactcatcatttgttcaaatttggatctagaaattatccttgattctctttttcttcatcccgccttatatggtatccatcagcaagtgcctccgacatatttcagatcttttactttgctcccttttctgactaccccaaggtgccatctcataataaccatggcaacagcctctgcctgacctgcccatcctcgttcagcagaatccacactccacacaatcaatccagtgctatttttattgtaaatcacatcacatccgttttctgctcaaagccctccgatgtcttcccattgcatttagtataaaagccacacaactgaccatgggtcacaaacccctatacgattgtggtcccatagacctctctggtctcctcctactctttactccccgtctcttggtgacctcccccattatgttataaaaacacaagcactttttttctatgctctaaatatgccaatactatttcaccttggagtctatttactcattttttttccctgctggaattgtcttccaatttctctttccttgcctggcttctcattttcgttaatacatctgcttgagggccagctctttagagaatttcacctattctgaaataactacctagtaactcaatgtcacatgcccactttaatccttcacatagtactggccaccatctgatatgtttatgtttgtctcttggtctctctgctgatggagctcacatggtgatttcactactgcatttgcagttcccagagcactctcagtgtattgtaagtgctaataaatatttcgttcccatggagggtaggaagtaagtacatgtctcatcagataatacctaaaaatctatcttcaggagtttcttctttgtaatcgaactttagttacctattaaaagacatgcacttccagaaatgcaatctaataaactttgatgagctattatttagtaggaataatctgttggtcccttttcaatgagtcaatccactatgtaactttttttttttttgagatagagaaaggaacagaacattggtaagtttgaaacatgggaaggagattcaactctgcctgaagagaacaaagtagactagaaacaatggtgtctctgcattgcaccattgataacggagcatgtatttcaccaggatatgaattaaaggctaccaaagaaaacaaaaaaacaaactgactaaaaacactaggaggatgctgaagtcaaactttctctattttgtgtcaggatggtgaagaagtctactgttcaaaacaatagaaagactggttttatttctagctcccctattgtaacataatttagaccccttgataaaaggaaggaatcagaccagaatattgctggtgtcccttcacctccaaatttatgagccttgtcagtagataatcctgtcggttgaattggtgttaaaatgctaatattgtctgcctttactccagatatcaaccaactgcttataaaattacagatgtcaaataatagaagaacttttgcagaaaacaatattgtatcagtaattctactctttatatttcagaaattgaaagacaggaaggttcaggaacatgagaaatacatagaatattatttggtcctggataatggtgaggtaattatatgagataaatgtgctgtcttccaaaactcccacccacatatatttatttattatgtgagacattaaatatctggatgagatttaaagaatcatgaatatgagctatggttacatgttcttctaaaactatgaaatttgacatttataattaagctgatatgacttcttttcagagcgatcagggcaattgatatgatatgcataaattgttggcacttataacactattttcttattgacttaagagtacccaacttagtttccaattacattcttctgtcattttgtcttttgttaagttgttaaatcatttgtaaattaaactttattctcattagggagtcaatacaaaagcttaattggtcacaatgaaagcttagtgaatggaatcctctgaaaaggcaaatctttggtaatagtcactgtttatcttctactgtaagaatgcattttcatatactgtgttttcaaaatttaaaatgcacatgtgtatgaaaatataagtcaaccattagctcaggccctaaagctttggtcttacttactgtgcttaattcatgtactgttcatgtatgtgtctcttaaattaataagatattccttctgttaattctgcacaccttagaaaaccatagaatttaagtgaaaatacatttggagtaattctttagagctttatactgagctagtacttcagaagagaaaacatcatattcactcccaaagtgctttaatgtagctagatgaataggaattaatttgattctaacttttaattaaatctaataactaatctttaattaaaatcaataataagtaatataagagaagatgcctttttaaccttccaagtatattcatttttatcaatgcccatattctttcttaatttttcttttagtttaaaaggtacaatgagaatcaagatgagatcagaaagagggtatttgagatggctaattatgtcaacatggtaagacatattttattacctgcagttttaaacagtttgctgggagatgtcactgggtttttcaatgaacgcacatgaagcatggaagcaaagtcaagacatttgagaccaatgtggctgactggctcccaaaggatgaccacaacttttgctacataggtgaacatgaatattaataccacaaaccaacacttttcttatttacctgccacagtattctcaggtataagaagacataaaagctacatgggtgcattgtattttccaaaaatccgctaagaaaatgctgaagaccaaatcccaacagaaagctggtccagaggggaaaaaaataattttaaacataccaagcactgtcacagtagcatatttcataaaatctcatgtaatacccagaacaacgctaaatgttactaaagcctaatgcatagctaaggaatcatattctcagaaacaaagaacttacccaagatcacaaagtgagaaaagaatagccatggggtttgaatacagatttgtcagatttccaaacccatttgagtcatgcaactattgactatgttctttagacatgattgtgttatctaatttccaaaatatttaaaaaatggttttacagtctttaaatactacttcttagttttctgtttgttggatatatagttggcatacttattttgaaatgaatgagtctctttgtggtatcctataaatgctctaaagataattttttgttgttgtacaacataatgctgtaatatacttcttttgatatgcatatacatagtgaagtgattaccacagtcaatatatatgaaataaaaaagtaatacatttcctttttatgctgatgggaattatttgtggagggctaaacattgataatgcaggaaagacagaagaattattggaataatcttgattgggggagaaataagagatttagtgcatgagtggagaaactggccttagactcagagattgttcatttatatagcagatggggaggcgcaaggtgtttggacaagactaggtgaggcgataagccaatggtgggagcttgtggacgttctcttcagattgctcttatagtctcagcgaatgtggaagcaaggacagttgtgaaagtcggattcaaaggaaatgttagaattactaagaagaggagcataaaaaatgtgtgcagaaaactgcgtgtgaatggaatttggaaatacagcagttttgctggaacgcgttaaggactgcttgagcttagtcacagctttaaagtgagagcaatcagaacaatgtgttttcccctgtgttcaagggcagaaggaagagagatgtagaggcaagttgcttttaaccaggattggagttttgtcaggtgagtaaaattaagcaagaaaggaacaaggaagttgaggaaataatccagtgaaggatgataacatggctggattttaacttcactttcagtaactgcattccttaatgcttttcctgttttccaaactaccttttttttaaaagaaatatttaagtttcttagcagaaagttgctggtgagaatgtctgtcactgtgcacttttagaaactatagtagtaatttaagcttttatctttagagtaagcatattgtttcataagtttaagtcattatttctaaagtttatcctatatgcattgtggattatttggttcaatccatgtttaagattagaggaccattgtctcattctgaaaatacataatatgggtggctcataaatgacagcaatttattgctcacagttctgggggcttggaagtccaaatcaagttccatcaagatttggtttctggtgaagattgtcttcctggcttggagacagctgccttctcactgtgcctttatatggtagaaagaacaaagcaattctctggggatctctttaagggcactaatctcattcatgagggctccactctcgtgacctaatcacctcccaaaggccccacctcctaacaccaccaccttgggagttaggatttcaacacatgaattttgggggacacaaacattcaaactatagcgactacttagcttattgtaaatgcatcaatgtacaacatttcatcatatcaagttacttctttcatgcctaaaccagcaccaagccaactttgctaattctgaaatattctcactctgagagcactgaaaaacatataagcaattgaagccatagtaatgggccactgacacaaaattatagtatttcttaagagcataaacaggaatatgttgtcttaacagggccttttctcctccctaccaccccccacccaaaaaagaagtttacggacctaaactatcttagtgtatttatcttttgttttgaatgggagttttagtgtctacaaaatagtcaatacattctgtttcacaaatatgcttggaaataaggtttttatactgctgtgatgaatgtttaaaaatacaaaatatattgaaaatgtttaaaatgatatcaccattataattaattgctttgccatttattttctttggacagctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacgtatgtacagattttctcccattgcacactatgtggtatttagtggatgcttttctgagccttggcaaagtgaggggtgcacatagaggggtagacatttatagagcacttacttggattatatgtcaaatatgctcttattttggatccaagtattttttttaaaaaaagagagggtcaataatttggcaataatttataaaatgtttgtttttattgggtatacaagaagaaaagacaagtttatataatggaaagagagtttttgattcagtgtttaaaaaaacaactgattggctttaggctcaagttagaagaaacatctaagatattattagaaaaattaagtattatattctaactccacatcttcactaatttatttcccactgaaatgacctgttaagaacaacaggggaaataaatctgatggctgtaaattatatgagactggagcatgtgcctcaaaacattcaagaaaatgctgctgggtagatggataatatttagttgaaatcagatagaaggaagcagtaaggattgacttgaagttactggagaggctattacctaagaaaaccatgaatttcatggaaatcagtgaactatgtcctgccagaattagttaatgtttctgtgctggtcatctgttaactgcataacaaatgagcttgaatttctgggcttgaaataaggcttcttcacttacataattggtgtgtgggctcatctggctggaacagtgagtctggttggtcatgtttctgtctatatcccctttcatgtgcctaacttgagtttccttcaatatggctatcttagagtaggtggacttcttactaggtgtctagcttttctcagaataagcatttcaagaggcatgagataatgcatcaaggttttttatgacctaactacaaaagtcacagggtgtcactactggtatattatcttaatcaaggggaagttgtagggccagtccagattcaaggggaaggcactactcaggctgagaatactgcaaggctggttcattgagggggtcacctttgggaagcagccgacacaatttcttaatttggaaaggtgagttttagactcgagagcccattctttgtggaggagtttagtggttttctaaggtctcatagctggtaagtaataagggagccagacaaattgctgaatactccatcactgtaagtaataacgtagaagcttaaaaataatagacgagatgataaatgtataggtaaaaataaatgacgatacaatgtcaagaacagattccttgaagagatcagaataaagatacgatgaaaggaaatagttgttcttccagttatgcaattaatgtcttaccatttaccaaacaagttaacaaaagagacctatacttaggtataagtaggttaaaaaaattagagtccgaatatactgtttacttaaaagataaaccaaaatatataactccaaaatgaacgaaatgttattttttgcaaatgagcaagtggggagaactgaaaccacaaaaatgtagaatgaagtataaataactttgtgatataattttaaaagagaacaggtatcataaaccttttaagtatgcataatgtaaaatatattttcaaaataaatatctgaaatcagattaaatagataaaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaaaaaaaaaaaaaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagatataaataaaaacaaagcctgtgtggtactgctaatatcaaaacaagatacatgtagacagatgtttattaagaccaaaaatagcctttctttttcttcacaagggatacatctcacaatgaaaagtgttataatcagaaatgatagaaaatattcaacataattctatctaggtgtttggattttaagtaacacaaaagccattctatagaaaaatgccttatgcaaattcaaaaactaaagaaaaatatgacagtgatggttcacagtgagtttttctgctaaccatttagggttttggatgtattgtctataaaaatagagcttagcattataatttgttacatcaatttattcctttcttgcagagcaacagaacttgctggaacgactgtgggtcttgcatttatgtctacaatgtgttctccttattctgttggcgttgttcaggtctgtatgatgataaactgttggttctatgatttacatttatcaaatgctttttaaaaaatctatagagaagatcatgatagtttttctctgtagtctgttgacatggtaaataacactgattgaatttcaaatgttgaactaattttgcattccagtgtaaactcaacatattgataatgcattatctttttaatatattgtttagcatgaagtttttagctacaaactctcaataaactaggtattgaaggaacatatctcaaaataatagctatttatgataaactgacagccaatatcatacttaatgggcaaaagctagaagcattccttttgaaagacagcacaagacaaggatgccctttctcaccactcctatttaacatagtattggaagttctggccagggcaatcaggcaagagaaagaaataaagcgtattcaaatagaaagagaggaagtcaaattgtgtctgtttgcagatgacatgattgtataattagaaaaccccatcgtatcagccaaaaatatccttaagctggtaagcaactccagcagtctcaggatacacagtcaatgtgcaaaaatcacaagcattcgtatacaccaataacagacagagagccaaatcatgagtgaactcccattcacaattactacaaacagaataaatacctaggaatacaatttacaagggatatgaaggacctcttcaaggagaactacaaaccactgctcaaggaagtaagaaaggacactaacaaatggaaaaatattccatgctcatggataggaagaatcaatatcatggaaatggccatactgcccaacataatttatagattcagtgctatacccatcatacaattgactttcttcacagaattggaaaaaactattttaaatttcatatggaaccaaaaaagagcctgcatagcaaagacaatcctaagaaaaaagaacaaagctggaggcatcacactgcctgacttcaaactatactacaaggctacagtaagcaaaacagcagggtactgggaccaaaacagatatatagaccaatggaacagaacagaggcctcagaaataatactacacatctacaaccatctgatctttgacaaacctgacaaaaacaagcaatggggaaaggattctctatttaataaatggtgttgggaaaaatgtacagattttttaagagtatgcctctaactctttcttcccatctattgtgctattattatcatatgtttaactttatatcaccataaatacacaatacattgttattaattttgttttagatatccatctttcattgcaatttaaaattaaattagttttcatttgtacaacaaacccccatgacacagtttacgtaagtaacaatcctgcacttgtacctgtgaacttaaaatagaagttaaaaaagttttatatttaccatcacttcattgcatttccagcactctttacttctctataaaaatcctaatttctatctagtatatattttttcctttcaagggaattttttaaaacattccttataatacagtaaattctttcagttttgtttgtctaagaaaggcgatcttactttcattttgaatatattttcacagactttttggatgtcctgtaaccccaacttattggtggattcaagggaagttatagttgtctacctgccttgtccttgttagtgtaagaataatgttctttccagctttctacatcctagatagaaatggaattaacatattttttagttactatcttttgagtctgggtttgtgataggcttcatggatgtacagaagaagtaaaatacatattttcaaacttgaaatagcttgccataaaattggaagagaaactggcctacctaaagcaatagttctaacatatagtaggtagcttaatgctactttacggaagtaaaaaccattctaggaattcataacagatgatcgttgatgaatattaacatagtcaggaaaagttgcattaagatggacctcagcctgtaatcccagcactttcgaaggccaaggcaggtggatcacctgaggtcaggagttcaagaccagcctggccaacatggttaaaccctacctctactgaaaatacaaaaaaattagttggacgtagtggctggtgcctgtaattctagctactgaggcaagagaatcacttgaacccaggaggcggaggttgcagtgagcagagatggcaccattacactccagtttgggcaacaagagtgagacacagtctcaaaaaaaaaaaatggacctcaaagggtaggtaggatttagagtggggcaagacagaatggaggtcattcgagggcaaaaatcattcaagttaggaaaaccattatttaaagaaagaaaccataaactgaaaggaacttcatataggcctctaaacacattttaatttttctggggctttttggcttgcatttttccccatttggagcactccatatttctatataggaggttttaccatgttcatctcaaaagaatgaaagaatatagtgtgtctaggtatcaacttcccaacttacacagctgttccttgtttgccactcttgtactgttcttcatcaaactttacatttagttctttgagatgaagtagataagagaatcagacttctgtaggtggatgttactggcagattcttatctcctcaataggacattttaacctgcaacgattctcctgcattgttttattgctcctggataatttatagctgcaagctctaatttatctgcaagcttggagttgagtccaagcacctcagaccagaaacagtctggtgatcaagttggctataggctggatttcatgcaatgggcaagtttttaattgactgatgtctgtctactcttggcaattatggaattgagaaagatacaagtagagctaaagtgctaggctgatgaacaattttagatccctgatggccaaatgcatcatagacttctaaaaggcaagccaaatgtaagggagatagatcacttaaaaaaaagttctgatttcttattgttgatgaaaatttgccatctttcttggaaagaaaactagaacaatttccttcattataggaacctactcaaagaggaaagggcagaccatatatgctgtgatgggcattcagttccatttagtactctctctctcttgctctgtgtgtgtgtgtgtgtgtgtttgtgtgtgtgtgtgtgagagagagagagagagagagagagagagagatggcaagtagagtgatgtataatttcattcgaaaatcagagaatctttttcttctttcatacctttaggaccacagcgataatcttcttagagttgcagggacaatggcacatgaaatgggccacaactttggaatgtttcatgacgactattcttgcaagtgtccttctacaatatgtgtgatggacaaagcactgaggtgaggctctctgggccctggggacatgctatgtagccctggttttgatccactgtgggctgtactactttaggtcatcttcaacaacgtgttcgagtttttgagtcactaaatgtgcatttgtgccaagccacctcatctatgggtaatattttttaataactaagacataatttaaacatattgtctctttgctgatggggcaattcatcattttatcctcatcttatctatacaagacctggcttcagaaaaatcgttagcatttatcaggttttccatgaattcagcatagatggtggtcagaaaagagttctagaataaaactctaattaaagaagaaactactcataggacaaagaagacagtctatgaaaagacatcacacattccctccctgaattaggcaaaatttttaggcaatcttatctttaaaaatctcacaatcttttttaaatattcatgtcctcttttctatacatacagctcactctataaactctatttcctcttttctattttcatttcctccctcagcccactgaagctagggttattctccaaagcccctgtacaaaacagcatatggctgcatgccagttacagagcttatgttaactctcccctctattacagcagttttaaacctcatctttatctgtaggatgaagagatcctatcaataggaattcctctaaaggaaagtgaattctgagacatgtaaataaatattttggtacctttaggtctttacatctcccagatgatctaagattatctggagaagtcagagacatatttgttttattaaaagtggcctggatgctacacattgaaatatgactatattttctcatgaagttggaggtgggttaattcgggcatgcaaatgagctcacgatctggcagttggtcagtggattggattttgtcttttggggcaggccgtgggtgtaattgtgcctaatgtcagatactgcttcgcacatgttaagcatgactatattccagtttttctttccttatcttcacagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggtatggccaatcactttctaaaacgatctagttggtttttcagttgctaagaagatcaactacaaaataatgtgtggcccgctataacattataggttttttgggtaattttgggtacgcccatttgtaggtattttccaggaaaatctttctgacaaggaaccctgcacttctgaacagaccttgctaatttctcccccaggtttccaacctcattcctttttttaaggactatttactaacttgggccttgtgtcctcgtccctccctttctaagtgaaatacttgaagctccttacgtgactatgacttacccagtattactttagacagagcactatgagtgcccagagtacaaatagcttgctggttcaaggtcactgggctggcaaatggaggagccaagaactggattcaaatgtatctgtttccagctctgaaacgcaagaccacccagcacagggatctggttcatcccttactgctttgggactcgggagttattaccatcagaagttctgtcctgaccctcttcacagggcagctgggattttgaatgggacctctgcttccatgttattgatgcttaatataaataatgcatcaagccttcagagtactggctttcagtaactttgaaatatgattatatatttgattatgtatttatttgctctatgagaaaaagtagtctgtcctggttgatgattatatttgaactaagggctagagttttaaccctaaaatattgtaaccctgaaactctcagtcttctatgggaatctagacagctgcaggggaacacttttgaggtaagagtttctccaataccttttgcaggcaggattctgacacaaagcagagagactaagacaaagtatttgcttcaagcacagttgaattaaatattaaagttagataaagagctgtatctttagcttttcagtggatatcctagaaattggatttactgctagatatgtacataactgatgagttgaaggaattatattctataattagacaaatcttatttcaagaactgtgttttttcttcatattttaccaaaaagaatagatctttccttaatattattggagactgaggaaactagttaatagaaaaatgacgtaagtggaattcagataaacaacaaaccatcagttgctccaaaatttcaggttttctaattttttttatattttttgaaaaagtcctatttagactccacgaaagtaacatatgcctgatgaatatagtatgttacaaattgtgctgaactgggaccaaaaagtaatgttgcatttacatttgtttctcatatttcttaggaatgtaccaatatttgctgtgatgctaagacatgtaaaatcaaagcaacttttcaatgtgcattaggagaatgttgtgaaaaatgccaagtaagattattttattctattttaataattatgattacatttttatacattaacatctcagtgattatgttaactgaaataagcaatgcaatatttttctttatataaaatgatatatttactatttatgaagcacttactcagtgttctacacacatggcctattgaatcttccagtgatccttcacagtagatattatttcattttgtttttgagaaaaaaatgcagagtagaaaatgaacaaaataatatggccactatttgctacagcctggatacacctgagaacattatgccaactgaaataagccagcatagaaagacaaacactgcatactgatctcacttgtatgtggaatccaaaaacgttgaatacacgcaaacagagtagaatggtgtttaccaagggcaaggaggctcggaaaatggggagatgatggtcaaaagggacaagttacagttatgtagcatgagtaaggttaaagatctaatgtacaacatgactataggtacaggtacaatgtgaccgtattgtatgttaataatttgctaagagagtagattttaagtgttctcaccacacacacacccacaccaacacctatgtaagagaccgatacatcaatttgtttgactgtagtaatcatttctttctaaaattgttttatttttaatttttgtgggcacataggtgtacatatgtagtaagcatttcactgtatatatgcatattaaatcatgtgcaccttaaatacaggcaacaaaaaaatgtaaaaataaacatggccactgttgagtaggataaccccaagtgtgatcatctccaaagccaaagctggttactcctacctgctgctgtttctcatgctccatggctttctcaggtcgaatctcacaaaactgattgtatctccctttaacaatgtgtgtggtggaagaggttttattctgagtagtgtgggggtatccccatcttcaatctttgaagccacttcagggtgaaattcttctaaatatgccatttcatgttctctgtggtgcttttctgaattgtccttcaagtttagtatttaactttctgttgttgcatatcgttctatattgtgagggtttgtttccatactcagattgactcctaaggccagaagacagattcactttcacctagcacagaatttcatacattttaaatgatctgtaactgcagcatgaatgtgcacatggcataccaggttttatagggaatgtttggtgttattttgtttttaatgtcagagagagaggaaagaaagaagtccaaaaggaagtaaatttgagaacttaagcagtactcaaagagtgtttagtaaatgctatttgttagagattatggtaggtaaaaaagtatccagtttcttactatttagagcaatgatatacatatatgaaacatatgaaaatataatgtgtgattcaatggccttgtagatagcataatgatatattaagctttttacgtacagtctcacttgattttcacaatggccttgtaaagtagatgttggatggggacagggattttcagagagattaaatccattttctaaagttcagcactcagacacatgcaaagccgagattcaaattcctgtcatctaaatatgaattcgaggctcttcccaagcacatgaagaaagcaggagcagcaatttgcattaaaggtgtcagaggagacttggtgggaaaatgggctttcaactggacttgaaaaaagattttagacagaagagatttagacataaaagaatttccaaatgagggcacagaaacagcaaagacataagagaagatacaagcatggtttgtctggtatgtggtaaggaattctctgactggagctttgggttgaatttgtaggatctcacatgcttgcatggaaatttggatttgatcccgtcactggtattaagatatttaaagttatttgacgcattgaaaacatacctgctcctgttaggaaggaaaacaaacaaacaaacatactttctcagttttgcaggaatggcagaatttgtttcactaaagtttctctgagcaaataagagtaagatttgcagtaattgattacaactgagttagtatatcaagtgaatatttgcttatttctccctcatgataagtcattctatggaagaagtgagttgaaaggaaatagctgaacctacaataaaagggattaaggattaggaaactcgaggcctgggaaagtccgagtctgctgatctggtgcttgtaagcttatctccttgaataccgaagatccaattcaccagtaaatctctgaagttgcagatttaaatctccttggagttcctgacagagatgcatccaacaaaaggagaaataactcccttctttttatctaagttgttgcctgttttttttttttcgtcctgtacttttctacattatgtttctttggtgtttttgatacaaattcagaaatattgcttaaaaacttagggcattaaccaatattaatagaagtgatataacagatcatggctttaatttatgacaatgtaagcttcagtgaaatgacacctccaactactatgcccaaaaagtccaaatggaaaatatttgtgttaatttgaggtattagggtaaagcaggtagggagaataaaaagccttctatttttgtttttctacagtttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggtaggaggacaaatcctttcccctgtgcatgtgcgaaggaaaatcatttcagatgacagtgtttaaccatggtcaaaggaccattctgtcctatccttcttagaagcttcgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgtgcaggggtggcagaagtactgtgggatgggacagaaataagaaaagatggaaaaaagaaaagaactctggaaatgcagaaagccaataaagaaaagtgaaagttcttaaatggtcgctttgtccataatgccaaaattttagagaccatattctctaatttcaccaagaaaacttgaaaaataaaagtttaaagagatatccgaaaatttaaacagcaatttgtatagtattaaataactttggccaggtgcggtggctcacacctgtaatcccagcactttgggaggctgaggcgggcggatcacgaggtcaggagatcaagaccatcctggctaacacggtgaaaccccgtctctactaaaaatacaaaaaattagccgggcgtgctagtgggcgcctgtcccagctactcgggaggctgaggcaggagaagggcctgaacccaggaggcggagcttgccgtcagcagagatcgtgccactgcactccagcctgggtgacaaagccagactccgtctccaaaaaaaaaaaaaaaaaaagaaaaaaaaagaaaaataactttattagaaagtcaattttagatcataagtgatctagcttatatacctaaaatctaaaaaagttgaacgcatagaagcagaaagtacaatgctggtttccagggtgtgacagggaggaggtggggagatgttggtcagaggatacaaaatttaagttgaaaaaaaaaggcaagtttttaaaaaccagttatttggactttctggatatgatgtgtatgatgtacatgtatttaattgccatactcccttcctaatagtttcagactcctacttaaatgactgaaacaatatttattaaaatagagaaaatctacatagtcctattatttgaaaggggtcattgcgtgccagaaacttttcataattcctgaaaacagagctaaaacaagattgagaaaatcaacaaaaattcctaacttgcaatgcactgtgaaaacaagaaacctgggaaacaaatagacaagaccctagaaaaacctccctgtaaacttctctgtctttggctacagcgggttgagacacaatttgaggagcaaagctcaattcccttagtatgtcagcaagctcactagtatcctggaaccaggcctcagcaatcttgcctccacttcgtggatgcgccaggttaaaggtggaaacaaaattgattgttggttaagaagctcatgtttccttggctaacttcagtatacggcaaaaaccaggagaaagaaaatctttagcacagaggtgaagttctgagcatcacctttattatcttgtagtaaatattaactgcaaacaatattaactgttaccctcctccctcctttgtccgactttatgattagtctcctcggcaaatctgtaaacttcctggaacagggacattgtctacattgttcacagttgtattcccagtgcctcccagcacagtgtctggctttagtaaaaagctcaaaattgtctattgaattaacattgaacatatttatctgatcaggaaatggagtagacctcttaagtcatacatttaaatacagccattataaaaggccagagaaaacaatttgcctaaacaaaattccaaattttataattcacagaggatcacgtatttattttaaattaatctgggaagtttgaaaagtcttgcaactttgtaagtaatttaaaaatcattctttttggcatcaaatcattcccacaaatcaattctaattccaagtattgaaaatgtggctaaggcataagcaggcaatttgtcataaagaagaaatacaaatgtcctgtaaaattaaaatcattttaactcattagcaatatacaaaacctgaatgaaaacaagttaatcttctacatttgctaattggcaaaagtttgctacagatgttaatgttcagtgtcacagaaaacataaccaaacaactcccttcgtacactgctggtaaatacacaagttagcatcatctttacggacagaaaaatgcatacacaaaatctaaaaataattgttttttactccttctcctagcaattgtactcaaataattatgaggatttttcaaccagcattttttaatgatagtggataactgaaaaacatctcaaaatccaaaatatatggattagttaaataaagtgcattaattcaatacaatttttgcagctgtgatgctttagaaaatttaatgcctggggaaaggacagctatattgttaattggcaagaagttataaaacagcatgatgccagatatatgaatgataccttctgcaatatcagcagcaataactctgaagtctcagattaggaatatcatgcttctccctgattattcatgactaatgattcttttcttccatgtagattaggaatatcatgcttttccctgattattcatgactaatgattcttttcttccatgtagatattgtattataataaaacatgaatacattttactaagatacaaataataaaaagtaacaaaactcattttatcttacacattgaaacatgaaattcgtttaaaagtatttcttaaaaacaatgccgtatcttcataggtgtttattttaacttagcttgctgtttgtcaaaggctagactcaaaatttccaaacgtttaagacagaattacttgttcttgaagagagggtacctcagcacagagaaggaacataggtctttctctgtgacttgataggattctgtttccttattaataaattgagaatggcaataagaatggctagtatttgtcaaccatgtactgctgaccaggcactgttctcagtggctcacctatattaagtaatttaatcttcaaaacagctctttgaggtaggtactgtcatatataatgtgtatatatatacttttatatatgtgtaaatattaaatatatatgttcacataaatataaattatatatccttattttacagatgagaaaactgaggggttaagacacttgcccatgttcacacagttactcagtcttgcttgaagcctgagctcttaacaatgtgttttgtctgatggagatctgaggaagattacctgagacatgaaatatgtgatgcctatttttgtacctagcacatagtaggagtttgttacagagtaacagattatttaaaagattatttgtaattccagccagctcatttgataccaaattactacagcctatgtttctaggagtggtcaatggaattatgctaaaatagtatttttcttgcttgttttatattttataaatcgctttccagcactgaatctttaaaatcttttattttcaagtatctcttgaatctcaaaaatctattttcttttccctgctgactgatcctggtcccaggaactgaggttgcagataagtcatgttacaacaggaatgaaggtgggtcaaagtacgggtactgtcgcagagtggatgacacactcattccctgcaaagcaaagtaagtggccttgtctgaaccttcctgcttcacagactagagcaatggtacacttccagctacacattctgatttattccagttaaagggaaagtgcatttggtcatcaatcatttgacaaacatttattgagtaactactatgtgccatgatgtgggctaggtaccgagtctaaaacaacaaataagaaatggcttctttcttcaagtatctcatggtgggtgcttcagatgacacaaagcacagtcattgttgggtagaatgaatggttgtgatggaacatgccacaaagaatgggtctggttagaaatttgtccagggatttcccagtataaatcagatgctttctcaatctcatgtttttccttgtaagattcagagtagaaatatttatctacccagaggaataacagatgcagtgcttgaacagttttttaaactttcagtagaattacataaagaaaaaatacaatatgaaaatattgacaattcatctgaagagtttgttagttttagtactgatatccgggaaaacactatagaacagcacaccagaagaacttgggatttttctatggtttaattctgcaattttgagatgagttttaaaatccaattatagattaaactctttgtacctgctctaaattttacacataccaaataatatataacaagaggttgcacaagatcaacatttcccaaagtttgtctattggacacgaatttctctgaatgacaggtattaccaaactatactttggatatagggttatctcttgggagaatctgtgcctaaagaacaatcattttcggtggtcttgtggtctcttctttataggaaaccagggcagattcaaaagaggaaattatgtaaaaggcagtatgtgagggccagaggaagggcaattgtaggtggtgaatgggaagagagtgggtctcgccatctttcctttgcagtctgtgcacacaacagtgtcccatataactctttgcatgagcattagtttctgtgctctagtggctcaagcagctccttcaccccacaaactaccctcctagtcacttctcagtagtcattggctatagtgaagagttagcctgaaattccctgtgccctaaaccatcctttatcgctttacctaagtgattcaagaaaaacacactctcatattttgagagaatatatgcctttctccactcctcaaacatattttctacagccaagagagatcaaaaaatctgatgccatcactttctggatacttttttcacagccctcttccgaattctacataaagcaattgacttccattttattgtcttttagtcctgttggcagtaaatgaatggcttgagtgagtgttgagcagtttaatctgcaccttcagggagacagttcttttagtaactccacctgatgccttgcagtgtcaagggaggctcagctttgttctgacagcattatagtggagacttgggctttcttttggtggaattattctgcagccagttgtacaaataaatgagtaacctatctgaaacaagctagaaattgatgtctcagatgcctccatgatgttaggaatccatgttttatcctctagctccatcatccacatgactttcatttccatgtgtttctctaggcctatgatagcttctctagctatcatactccaatcagcaaaaaatgagaaaatgttgagaaatagaagataattcctcatttaaggccaccttctagaatttgtgcttaagattctgttttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtaagttgaaattgtggctttcactcaaaatagtgttttttactttggtgtgctttgttgttttgcccctcggttattcactatgtgccttgtttcccgattttggggttcgccatgccttaatagaacccacagagtttgaatttggaacacagaaatgaaaatggcgcagaacctagtaaatagcaggaataagcactgacattaacattctcaaacactgtggtgaaatttggaaataattgactctcatagtcattatttcaagaagagtatcatatcgtcatgcagataacacacagtagcatccgtttaactttcatagacgaagtctgaaaactcactgaaagtgccagtgtatgtgatactgggcttcatttaacagatctgtatatcattaataatataatgaacttaaatacgagtactgtttagccagggccaatcaattcacgaactttgaccatgaggtttgtctctcttaagagattagaattaccctctttatatattcactaagatatccacatgaccaaagagttcccctgatttttcactgtggtaaagccaatcctcagaatattatcctatttacttaaactgatttggctatttaaatattaatttatccaatgatgagtccaaaattatctaagtggttcagtgtgggtattgcttatacgtggtctctgaacccctggagctgaaaataaaaatttagcaatgtttataaatctgctgatttgacattaaaatattaggtcttgcctataagaagtacccacagtatttaaacttattcttttcccccatttttcctgaaacatatgctagcatcaagggcaaggaattttatataaaatataatatttaactgcgttttcccaggttttactaatttccttgtattttctagtgctgaagcctttaaagacattgagacattatcacatgacctggcatggatgttgcagtgcttgggccttaagggagggaagtactgggactagggcagaattgagatgtttctgggtcccctggcattaagatcatctcattattgcttatcccttaacttcttgcatagtcattgcttctgggatatacagttgtttggatttttaaaaatacataaattcttagatagactttatcaacctttttgggttggtttaactaagaggataatgtaagcaacagagcccgtctctgtttcccttcttctacatcagcctcctggcagagccaccttaaacaacatctgctagcctcttcacacagacctcaactttctcatctacgttcagagaagatgaagcttcatgttttctacatcactttcaggtttgcattaatgcagaatgtgtggatattgagaaagcctacaaatcaaccaattgctcatctaagtgcaaaggacatgctgtaagttctgaaaatatgtttccctaagctctctgaatcttatgacattctaggtcagtcataagaaagctaaaggaatattttcagctttaaatgatgataattactaagtttatccaagccttcagtagcatggttcaaggagaaatttcttctgggaatcattcatgaaatgcctctcattcactcatactttttgtagatagatggaagcctggagactggggttattcctttttctgcatgaactttattatggatgagtagggccttgagtttctggtcagcctagcggggacagtaacaggatcattgctcccctaggtgtgtgaccatgagctccagtgtcaatgtgaggaaggatggatccctcccgactgcgatgactcctcagtggtcttccgtaggtaacattacacatctaacctgagaaaattgctctcctcttccaagcctttattttgtattatatgagatttcactgcttcttttctctgttcttgaaatttctgttctgttgatgttgaatccacaatatttatcccccaaatctccttaataccttttaattatattttccgtgtcttcattttcactgcacatgcaaaaaaatttcctcaacctttatatttgtaatcttattttaatttcacaaattttcttactttaggactcttccattttcatagcagcctcaagttaatggaaaaatgtaatatcctcaaaactctctaagaatatgacctattattttgtatgttcagttctattctttgaattatctgtttcttttgagttggtttgttctgttgtcaccacgtcacttgtattctgttgtactagttttcttcaggatatgtgatccttagttcaatgtggaattggtagagctggattagttcacacgggatgtctctgcatttgtgtgtgctgttgtacctactgatatttctcttgatgggggaatctggctgggagctctatgggcaggtaggcaggtctgcctataggtcttcagggtgggaaggagccagagtggggacccacctccagttgttacgaggaacattttaccctgaggaggagctcatcaccacattttctcctgagagagctgctttttctcatcatcatctcattgacgctcccctctctgtctgatatagtgtaggtatctagaggaagcctctgtcctcctgttcatgttcctgcatcctctgtttgcagaaacggagaaattcttaggattttgatctcaggtgatgagccaatcttgttctatatacacaggagatgaagtagacctcagtgagatatctgccccaaattcagattgttagacttttcaagagagaacatttatttctgatgtttagtctatatttattgtttccatccacataaatcccttaacttcctatctttctgaagatttttaaaattattttttctagtgccctatgattttattatatacacatgtatttgtcatgtattttgaaaggggcatgaacataatcaactgttttaattagaaaactctttaatggtttcaatgctcactaaaaatccttttaaactatgactttcttgactgctttattttgacatatctattgatttgctaagtcacctctatgactaatttcttcctggtgtaacaatgcatccacataaaactttctaagttgtacttatgagaatgtatttctgttgccaaatatttttaatatttcaattaatattctatatcatagcatgcatagcaggtttgattgaatttgattttttaaatcataattttgcattcataactctgttaaagtagatgtttatatttaatgtcaaaaaaaaaaaaaacaaggccagactgatttctgttgatgttaaataacatcccttttaaaagtcattaggtttgttttgcttaaatgcttttagaattaattacttaattactaattaatcaaaatgaatcactattttattcctgggtgatgttctgtttccattaagatgttacctagtgagtttctttaaactgaggatttgcttttttcttccattgaagaaatgtttctgttgttctaggttttaaaatttattttctttcagttttctggtttctgatttagaaatgtaaattatttatgcaaaatatctccactgtgtgatctccatattatattccatattgggtcatttttcttgttaattctggggaagtttttcaagattattctctgtatcataatatacattttttagcaatgttaattctcttattacttataatgacatttaaaattattcagtggcatttttatgtgtctttgaaatatttttttatcccagttggttgttttctcctgtttcacatctgtctagcttttttacagtctatattttaattgcattgagagtaccctaaatttgattctttatactccttttctgagagtatacattttatgtatacttctacttctatgtgttattttatacctaatcttttgattcaaccgatgctttttctttagttatcatccaataaggttgaattaattctgataagcactgttaaaagtatttctcaaaatttttaacttggaggactagcgatacaactttacggtatattacatgaaatttgtattttagcaggataaggaggtagctggagaagttcaaaatacatacagtggaagcttttctcaacttattctgtttgttgaaaccactacatcagaattcaactttatcccccaagccttgttttttttagggcattgtgttagtgggttcagtgccctttcagtgctatttcttatctaaccatcaaggaaagcctcagacagactgaggaacatttcctagttcagaagtgtccttgcaccaagaggacagaccctagaggatgacaatttttactatagctatggtcctaaatctaaacttgaatgggaaaaaattacatttttattttcattaaattctaaagttagtttagaattttctacaattatgggaatgtatggcttataaaccataatagtattagcaatattccatgactttgtcaccaatagaaattacaaagactttaatatctcattgcagttgttgaatgtatctccaaataccccatgagtatcatttgtttgaaattttggtaattactgacctactgttagaactgattatttcagaggttaataaacacatattttactatatcataaattgttttataatattttcacaactgtatcccaacatcaatagcttcctttaaatcttatgccttttatgaatgaatttagaaacactcagaaaaggggtttataggctttatcagattgccaaaatgatttgcagcatgacaaagtttaagagcactgccctacgacatggccatacacagccattggctttcaagattattgttaacaccatctttttgtgtgtaacataatagagcagacatgtaaatataaaggcaaacctgatgattacaaaatgaacgctcatgtaatataataagggccaagaaatagacccagacatctgctttcctgcctcttttcagtctgatctcccctctttctctaagggttgaccattaatctttcttttgtcataatcattttgttagttttctttgtagttttgcttcctaaatacacatccttaaacagcagcttttggttatataattccatgtgtataaagtttttaaacacaggaaacacagcttccctcactatcaacactgtcaccagagacatacatttgttacatccatgaacatacccggacacatcattatcaccaagagtctttaaagtttgtatgtatgaaatttttctatgctcattttcttctttttctctaccttatgctttcaagatcatccattctagtgattggattaaggtccactagttctctttcaagtttctaagaattctgtcaaatacttccttatttattaaaatgttttcccctttactctattagtactgtcaaataagtcaattggtttgtgaacatttatctaactttgcaacctttgaataaacctaagttagaaataatatcttttttatatagtgaaggatgtttactcttattttatactcttgggtgatattggactgtgattttttcatattgaaaaaattgctgaattttggtatcaaggttatgctagtcgcataaagtgtattggagagtattcatttatattctctggaagaatttgtattttttggctattttatattcatgggtgatattggactgtgattttttcatatacgtgttctgtagtattctccagatattttgtttatcaagtttattaattgtctgatatataaattaagcctaacattgtttatttgttctaccaattactgtgctgggagtgttaaaataccccccactgtaattgtgaatttgattactacttctggctctatcaatacttttatactttgagagcgtattattatatacatacaagtttagagtgttgcttcttccaaattaatgaacagtgtatcatgatgaaatggtgctgtgtctatctagtacacttcttacctttgagaatatacacttcctggagaccatatagctgtaacgtatttgttttggtctgtatttgccctgaaataacatttttccatattttcatttttatcctttctgaatcacgttttaagtctttttttcttttattaaagaaagcatgcacatatagtttttagtagtactcacatctttggtttttgtttgtttctttaactgaggaacttagtccgtttaaattaaatgtaattactgatgtacttgggtataaatccacaattatatagtttctatttgtctttcctgtttatgttcccttttctctcctttcttactttcttatagacttattgattttattattttattaacttggatgttatgcatttcttttatattttaatgattaccctaaaacttcccaattcatttgcttttttaaaaaaataaacttaacttactttcttttgtagagcagttttgggttcacagcgaaattgaagagaaagaacagacagttgacatatacccagcaactcccactcctgaacagcttccctcaccatcaacatcccccattctcgtggagtattcgttgatggtaacaaatactccataaacctacattaacacatcattatcaccccaagcccacagtttacattagggtttgctgttggttcatttgcctttcatttctttctgcatttctgaacttttatctaggattattttctgtctctccaggtccttgcccactcactaatctctacaaagtaattttatctaacatttaagtacttttatacttttaggatgcttttgtttgcttgtttgcaaaaaatttaaagattaaaagattatttttaatgggcaggttgatctcaatttcctagtccaccattaccagaaacaagaagaggctgcacttactcttcagtgatttctatcttcacctgcaaaccttccgttgttatacttccatctgtcctgtgccccaattttagctccagaccatgtcttttcaagtttggtgtgtttgtgaagtactgccaaattcccatttatttctctgataatatgtcattcttctgaaaatagttacagttctgatattagtgcaagtaagtgtatgtttttcattctgaatgtatctacactataacagaatgcttcactgttttattttcctttgactttttggattggaatcttatggagggtggcgagtagcgaatatttgaactaaagtcattgtcttacctagaattctgcttctgatgtgtctacctctatctgcatgtgtgtgtgtgctcacacttgtgaacttttcttgcatttatacaaatattaatcatgctattggtttgctgatttctgtaataagagaacggtaacttttggcattgcttttcaatcttttccttcctggtctcttgtggtttcagattattgtaagagaaatgaacagttaagagcaaaagagtgaagttatattcattatttaaatttgtcagtacaagaaaaaacaccatggaggcccaggaatatttgttcaaaccatttcctcattctcaaggtcacataacttcctgtctaattccagtgtagaccaacatcagtggaacactcgattatttgtcttcttagtcacacctcagcttcttattcactaatgacaggaatgtattttcaaagttttagtttctttttctctgttttattccaagactgcttttcaaaaatgtttcatttcttctttgccatcttccttactgtatattctcttctaatctcccagctcatttcccagttgttacaaacattatctaagtattctcaatattatgatttttaacttatttcatgttaaatgtttcctatagatttcatgtgtatttattctacctaatattaatataattatcctgatcaaaatactttttcattttactggctatgggaatttatgttcattggagaaaagggtagctggaatatgtgctaagtaaagaaacaaggactagtgtgttgtgcagatgtgtgtttctgcagtcctcagcgggcccctgttctctgctgcagacttctccattgtggttggggtgctgttcccaatggcggtcatttttgtggtggttgctatggtaatccggcaccagagctccagagaaaagcagaagaaagatcagaggtgatcctttatcttatcttgctgtagggactctttgacccctattttactttactttaaattcaatgtataacctatcctttcaaattgaattggtttacttctaatattcagaaatacatgcagatggtctttttggacgagaaactgggtttccctttaactgagaaatccttcacatctagaaatgttttttgtttttccttctgttagtcaccgtagttataataataagagtgatattaactctcattatgacagattttttgaatttgttgtaagaatataatatctaacattatttgatcaatatacgatgagcactgtgctaagcaccgccccacccacttttttttgagacaagagtctccctctgtggcccaggctggagtgcgatgctgcgatctcggctcactgcaacctccacacctcccagtttcaagtacttctcctacctcagccccgagtatctgggattacatgcacataccaccacaccgggttatttctgtatttttagtagagatggggtctcaccatgttggccaacctggtctcaaactcctgacctcaaatgatccacccactttggcttccctaagtgccgggattacaggtgtgagtctccacacccggccgtgtgctaagcccttttatatctattatcttatttacacttcacaagaacttcataaagtggtcatgagtttcattttacagatgagaaatgttttatgctaacccttacacaattttgcaaggttaggaacttcacattttgatggatatagaaacaagctcagagagattattagcaaacatgctttcagtcttgcagagtaagtggtggaggctgggtttgtctcacgaacgtgattctggcacaatggtgttttttttggttttttttttttttagcacttttaaagaaagacttatttactcatgatgagttttttaatattgagtaagacattaataaaacaacataatttagataaaatttggattcaacactatcatttttagaagtcaggggtttttggagaaaaaagaaaactagtagtgattatgaattacaaggcaatgaaagaggctgacggggaagtaaaaactgatccagggagcagataaaaacccaggcaataggcaagaaagacataatgggaaaaagaagttgggaatcttctacggagtttccctgtcatgctgaaggagctgctaagtcaattgatatcatgtgtttctctcttacaggccactatctaccactggcaccaggccacacaaacagaagaggaaaccccagatggtaaaggctgttcaaccccaagaggtgaactatatagtctgggctgtgattaccatggccccactttgcgtttctctcacactcttatcctgactacctatctatcatttctacccagcagcgttttgcagtaaaacattcagaaatgtctcctttgccttttgttaaaggcaaaagagtccctaaaatgccgaggctactttgccggggttcatgaaatgcaaacagaataaagagaacaaagaatgcacataccggatgtctgtctgtctctctctttgtctctgcttcattctctctccctctctcacacacacacactccctctagcttatttctttgcaaattgacaaaatagatacaaaaatatgtatgtctgtatgataatacatgtaatatttataacccaaatgtcctactcatgtcctgtaaatttaaagattttagctgaagttggttaataacattggtaatcatttataacattggtaatcatttcatttataacattggtaatcattttttgatgaaaacttttcattacagctctgggaaatacttctatggaatacgccagcaggaccactgtgattttctatctggtctcttggtgtcagcttagttccaagcttccatgccttgaaaagtgcttacttaaaaattacttaaaaactgtgcttatgaaactaatggttcattttgaaatattcgttcttcttttcagatgagtcagatgaagccccatgtgtatgatctgccagtagaaggcaatgagcccccagcctcttttgtgagttagcaacttctcttaaataccaccctagttcaatctccaggaaatatcggtgaaagtcatagcccacaacacttcattatttcttcaggacaatattgaaatctatgtgaatattaatataaaatacaaattcttctgcaaaatattttgaaaatataaaaaaatgaacatgtatgtcactccatgccaacttgtgacaagaagaggactaatctgcttaatagagtaccactgttttcatcagctcaggctgctgtaactaaattaacatagattgagtggcttaaacaacagatatttacttctcacattctggagattgggaagtccaagttcaaggagctggcagatccagtgtctggtgaagcggccttctggcttgtagacagctgcctttttattgtatcctcacatagcagagggagagcatctctcttgtgcttcttcttataatggcattaatcctatcatgagagctgcaccctcacgacctcattatttccaaaaggccccacctccaaataccatcattctggggattagggtttcaacatatgaaattgtggggtgacacaaacatacagtttatagcaatcatctttatcagatacctattgacattggacttaggtctcaactgtgtatgtacaactaaatggaagcaatcaaactcatattttacaatattctcatgggtggggtcatggcttctccatttctgaaaatgatttaagtcttttctttatgcacgcctattttcaggaccctatctttgaatgtaaatgttttatccttttactagctaattacaaagccagattttccaccaccgccaattcctgcacctatatcatcttctttgcttgtaactatcagatagtcattggtgaatttttaatctctcacctgctcattgcaaatactgtctccacatccatcggttatcaggatgtgtacttttgaggttaacttgaaatatcacagcacatttgtcccagggatatctaaaacttcctgtctataaattagtatggatattgatgttttattataaaaaatagtattgctgttatgcaattattgagaaacgataaatagctctgctctgtgaggtctcaaagattcatttctagatgtttatttaaggagataaaattttattaggtgatattttactttatatatattagtcatagttttctgtaggaggtagggtatgaaaaatgcgccatatataagcaaacctggaataagagtcaggtgctcatgaagtaagaattacagtacattcactcattaaatggctcctgagcatttttcttgtgcctggtattctgctgtgggtaaatgagaaagacctacatttgagattttttttctttcaagaaatttcacatttttagtgagaaaaaacaagtcatataaaaatggagcacttaattcttcaactgttatttgtagtatcgcccaagacgagtgacactgacaggaaaaatatggtgaggagaaagtcaacgggctcggagtggttaaagtaggacgaatattcattggttgagtagttggaatttgaactggaccttgaaagttgggtagaatttaaatgagtgaagaagagctaggaaataatttcattaaggaaataaatatagctaagatgggacaagcatagcatttctaatgccataccattgtttttataattaatgtagcataaagacacaaacgcacttccccctactgttttcaaggataatccaatgtctacacctaaggtaagagatctatagccaaattattatattcttgtattataatctcctactgtcaagagaaggcccaccatgtctttttagaaaaaaacttactaagaacagtatctgtatgatttggagatgggtgccaacatgaaagtcttatttctcggtatggccaataattaaaaagagaaattagaagattctcagctagaaagctatgtagacacaaatattatttattttctcagaaatattccctaaggatgaacatgagaagaaacctcccatagaataataagtatagtatcctgtaactctccttctggtcccctaccttctccatattatgctaattaccggatagatacttagatcttagtgtagtatttttctcactcccttcgtatcatctcacatttctacttcttcgtttttgctgtatcaagtgacctatgaaatagaaactgacttcagataattttaatttcttcatagttcagcttcataatagtaaatatctaaatttttgaagaaagttgatcatttagaagttatgtctgtcttttttaggactcaaatccaaaagcatgaagcaacagctaagcaagaactaatggctaaattatcaacttggaaaactggaaaatctggatggcagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatcaaaaagtaatccgatgctttgtcaacaacagacttacattgcccatagcaaccgtcagcttagttgatgggtaatgtagcaaacactattggtttcctaccaaataatcccctttttcctggcttttagaacaataattttgttcacctgcccacttctaggaaagaatatcctatctatctaatctatctagctcagggataaatccctatccttttaagtaagtcaagtcaattaaaataacctcatttttccttgctagtggtcgacttggagatgattttataatcctccccctccctttttttttttgctagtaagacgacagaggaattatgttacaacacttctggaaaatttttcctcgtctctttttctggatatgggcatctgaatactctagctggtactgctgcgctccacacggtgattatgaaggctgaaaaagatagatagatagatagagcagaaagatgaaaagaataaaacctggcctttcaatgatgtcatggaattggtagatcagtgactgctggagttacctcacactttcttggtactccttattatatgagccatacattttccttgttgtttaagccattttgaattggattttctctcactttcaacagagatcatcctaactagtaaagtagctgtttccataatcagggaacatgctttagttcatcatcacagctacagtttttcttgtatttgtctgcttcacccatttctatcaatcacttacctggtccccacaggcctgtcgcttcatgaggaactttatggttcatttacccttgcagtatgaggttctagataagcccactctggcctcaaaagtgaagctcagtcctcaggaaatccagagtccactgatcaaatcactgtcaaggatacaggctttttctccatgtggcatttgcagaagaacaactttaaaagtagagctttatctgccctgtgaggtttcagaagaccctcccctgacccagaaataaatccctatttcctggaaagccattaagtactcctgaccaacttgtgaacttttctgtgttgttgttgttgttttttaaatatctgtccccagtaatagattcacctaatccttttttatactgatggaatggaaatcttaaatctatgaatcctcaactagccatgtaccataacccaagcaaaaactaaaccatacactctcaaaagcagtggcatgtgaacatgcctgcaagttcctaaatgatgtcactaggtccctgatgcagatgcatcatacgtcctatttgaagagaagaaatgcagtacaatgacaggaaaaccattattttatcatagaactgcgaacccaagtcctacaatgtttccctttcagctcaactgcagaatagtttagaacagactttttgatttcacaatactgtttccacacttacttatatctgtaactttctaactttaagggaattccgcttatttgacatttaactacctcagatatgccaccaaacctgttttcatcattagttatttttaccttgtctactttaaaacagtgaaattattaggttaaattatgtttttatccagttactctaagataccttagtgtttgtctacttattacaactcaccaaattactggttttatatggcctttgggaaggcttttagctttttataaaataatgaagtatgcatgaaaagaaagcaaattttagttggttgcagtcagagaatatggaaagggttattattataattaggattttattattcacattggaaatcactgctatgtgttaaggaattgaaggtggcctctggctagcagccattaagaaaatgagcccctgagttcaa

SEQ ID NO: 689 - DNA, 28976 bp, Human
gaaaaataaaatatttcttaaatgctgaatgttgctttgttctatgaataagcaatatttgttcacagatacatcaactaattaggaataaaatgaatttcaagtaattcatgtttaattacttattaacatgtattatatttacattattttttatcaattatgtactaataatggcaatgatgaaatgaagatctcagtgtcttgcactgggcagaggcctttctcattctctgccacttgggccccagcatggcttccctaagagctaggagctcagagggaggggctgggcaagacagaagtcaggatctttttgtaacttaatcttgtaagtgacatcccatcatttttgtcttcttctattcatattctattgttagaaccaagcctctgggtccatcccacactccgcgaggaggattcagaaggtcgtgactcccagggggtgggatcctagaacacatcttagaagctgcctacgacaaccgctgatttttaagtaacagttacatcctctacatctatttagacttaggatggagaattttagatgtcatctttaaaatgcatgagaggatgcagttttccaaaattcttttagaaacagacaatttgaaggccactgagcttcaggcttcattcagctgggtcgtgtctgcgggcggggctcatagagatgtcgctgggggtcagcgggtgcttcgggcagcgaaaaaacccacctctcgagggcagtggaaaatacagggaaaagccacttgagtgtagactccgtgcgtgtcaaggccaggcagaggcgcacttgataggcaaggaaaagcggacggtggtggtcttgggaggaagagaggagaggcgaatgggcaggagcgtgtggatgcactagggcaggacgggctcgaagcaggaacctaggatagaggcagcgcgggccggcttgggagggtcctccagagtccggagaggagaggacgcaggctgcacgcgtgctaagaaggagactcatgaaatgtgtaattcgctggcgacagcttccgcggccgtggagtgagcctctggggagtaacgactctcttaggtgcagctgggacacagtctcacagaccaggtaagttgcctgccctccaggaactcaagtgtccccgagtccgagccaggaggctggaagtgactgctgtcccatcctccctggagcccggagctgtccttgtcttgagaaagagaaagcaaagccaaggaaagcagagcgagcagaaccaggcaaaggggtggggacaataaaatgggatatggcccgcgcttccatctactcaggaggcagaggcaggaggatcgcttgagcccgggaggccgaagctgcagtgagctgcggttgcaccactgcactccagcctgggagacagagggagaccctgtctaaaaataaagtaaaataaaaaacaaaaataaaagggacagagactaagaaaacggacttcctgaaatcccaagttgggatttcacgtccagtgacccacaagagaagcaagaagtctgaacagggccaagaatcaagtgagtgggggcggaggattaaaatcgacagttgctgcggcacggccagggtggagggtgcatgtggggcaggcgaggctccagctggagttgacgctagcccgacgcgggtgcaactggaggcgcgacgggccaggcccaggagcagcgggaggagcgcacctggggcgcgcgggcggaggagggccggggagggacgccggaaggactgggtagggacgcccggaggactgagcgtagggccgagaggaggggcgcaaggaggaacggggggagggccctgtctcaccctaaacccctccccgtcccagactaaactcctcccctcggcccggcccgcccctgggcccgggctggaagccggaagcgagcaaagtggagacgactcgaactccaccgcggaaaagaaagcctcagaacgttcgctcgctgcgtccccagccggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggtgagactcgacgtggggagcggtagccgccaggatgctgcggacgcggggcaaggtcgcggagggccggacggtcgggactacgctcccgggctggggaggcaggaagaccgcgccgcgggcttagaggggctcagagccttgggcacagatatcgcggcgcctggggaggaccctcggagcggtgggagttgcggtgtggaatacggggggggtgggtggcacatcgcgcggcgcgtgttgcacaacctggcccgccgtcgtgactggaggcgggagtgacacctccgcccgggccgcggagttcggggaaggagggcgcggcgctgggccaggccggaggggcggccagggctgatagaaaggggctgtggagaaggggcctggggaggagccaggacgggtctggacccagctccacgccttgcgcccctcacgtaccccggcggggcacggtcggccctcgggaggcccatcgcgccctcgggagcttccctcaagccgtgcccttcatgccgccgacggagccgggcgagcccacgtcgtccgtgcggaaggtggagtccctcacccgcggcccccagagggaccccgctgtcgtagagccacgcgggggccggagcgctgagacgcggcaccatgtttcggggagagctctgccgagggcggctgagggccacctccccagaggcgcgaagccctgaggatgggcagatggttcttaagacggcgcccttcccgccactcccacccccgactaccaccacctgggtctgggaacccggtgagagcgcagtcggagggtcgaacgtttgtagctgtcaagtcgtagccccgctgcgcccacaggaagtgacccacccgcctgccgggtagtggcctttctgtgagccaggaccatcttaaggaaaaaaacaaaaaaagagcaaaacgccgtgcccctccacaatatactctcctcttccccgcatccccgaggggatctttcctcccctccacctccacctccacctccaccgctgaccccaaggaataatgctcagtatctgagtcagaggatgtaaaacaaagggatatttctccttatgtagttttatggaggatttaccgaaagaaggtggagggtgagtgactatgtcgcagaaaaaaaaaaaaagatgtttttatcgtgaatgatgttgagaaatgtcctgtgacttccactattgggcaaagcaggtccctctgccctgctagtccctcctgcaggctgtgtatgaagcgttctgatatggagggttggtgcgcctgggttgacagccattggtcaggtgcctgcagagtacagggcgccatactgggaactggaactataaataaatactctggggaccctaatatccagagacctaacccatctacgggaggaacaaggcttgaagttagggaactgtctagcaaagctgcttgcacaactgctaagtgtacggaattccaggaaaaagaaaaattgcttccagttggggtgtccttcatggaaaaggcatttgggcagccctgtgggggtagcaggagcattccaggtggtggaaagggcctgagccaaggtccttaagtgggacagggtacggtgtgtggccggaatggagggtctgtgtaataggacagtgagaaaagatgccagaagcggggatgggactctgctgtgcgtggcgtgggagccaagctctgactttcactgcacagtgaagcaactgtaagtcaggagcagaagcacggcctggctccagggagggctgaagagagacacttgctgttcatatttgtctgcagtctctcgttctcttccttcctctctctctcttctgtatacacctgcctcacagacagctcttctccagagatagacagctctgggctccattgactagttcttttaaaaagaaagaaaacacatccttcaaatttctgtccctcactggtgttttagtggatgcaatgtggtatagtgaggggagggaaggccacagaggtggccagaggacctggatttgcaggcagcatcgcacttactgtctctgcagtcgggctttgaggctgcctgggcctgggttccctcatttccacaaaggcaggactgggtgagccttctcaaagtaagtccatgccaccttccagaatgtaagtgtctgtccaaagcccagttcgatttagccttccataactatcctcagacagggaggaggcttctgcacacctggcctgttcctagctcagtgctggagcacaggatgcgggggctatttgatacatatgtgttgactgaacaaaagaatgcatgaatgaaggaaagaacggtcagctctgcttggaaggtagtggcaagctgagaccaaccatagcaatggttccagatgcttggggttagcacctcaaaacccagatgactgatttccccacagaaatcattacacgagaaaccatcaataattgcatttccctgggagtttccttttggttagccgttctcgctgcctaggcttcatgcaggtttcccatgaccgccagcctggaggaatgcccataggaaagacagcagcaacttaagagttggtcagggtaaatgttaacacgtaatttcatagacaggatgtgtatttcattacagagtcttttttcctgagcgtttgcggttttgacttgtggttgtagaacagctgctcagtttaacccctttatcttttgcttgccagaagccactttcatcatgccactcttccagaggctacaaagttgtgttctttgtgccaggcactgtgccggtggctcacaagtattccttcatcccatactcaacgacagcttacaaggttggcaggatgaacctgcttttgagaggctgggttattggcccaaggtcgcacagctaatgagtgctaaggtgagattgaaagcaggctgtgcttgtaagttcaaagcccactttctctgtcaggcactcagtagtgttcactgaggcacagaattgaatacaatcttccatttcttcctcttaaccttcaccttgtgggtagagaatagtggcctattggaggtatcccttatttatttatttatttatttatattttgagagagttttgctctgtcgcccaggctggagtgcagtggtgcgatctcagctcactgcaacctccgcctcccgagttcaagcaattcttgtgcctcagcctcccgagtcattgggattacaggcgcccaccactacacccagccgatttttgttttttgtttttttgacacagaaagacactgtcgcccaggctacagtgcagtggcatgatctcggctcactgcaacatccacctcccaggtttgagcgattcttctgcctcagcctcccaagtagctgggactagcaggcatgcaccatgatgcccagctaatttttgttatttttagtagagatggggtttcaccatattggccaggctgatctggaactcctgacctcaagtgttctgcccacctcggcctcccaaagtgctgggattacaggtgtgagccaccgcacctggccaatttttttatttttatttttattttgagacaaggtctcactctgtcatccagattggagtgcagtggtgcgatctcagctcactgcaacctccacttcccaggctcaagcgattctcctgcctcaacctcccaagtagctgggattacaggtgcgcaccaccactcccagctaatttttgtatttttagtagagtcggggtttcaccatgttggccaggctggtctcgaattcctgacttcaaatgatctacctgcctcggcctcccaaaatgctgggattacaagcgtgagccaatgcgcctggccaattttttaatttttttagtagagacagggtttcaccaggttggccagactggtctcgaactctttatctgcccacctcggcctccaaaaatgttgggattacaggtgtgagcaaccacacctggccccttttgttatttagagagacaaggcagcagagattaagatcatgtattctggagcaaaacttcgtcatgcaaatgccagctctgtgggaccttgagccacttacccaacctccctgggtcttagttttttcatcagtacaattgggataagggtgcttagctcataggattgttgtcaagatcaaatgagatatatgtacaaagtgcttagcatgatgccagacacaaaagaggagctcaataaacatcagctgccatcaccttcattgtcatgacaatcccccctctgatttctgcaagatgcctcacgtaatgccattcacaagcaggtagctcatagataatattctgattctgctagttttaaagaatgggcagtggccccacgcctgtaatcctagcattttgggaggctgaggcaagggaatcacttaagcccaggagttcaagaccagtctgggcaacatggcaaaaccctgtctctacaaaaaatacaaaaattagccaggtgtggtggcgcatgtctctagtctgagctactgaggaggccgaagtgggaggatctcttgcgcccaagaggtcaacactgcactgagccctgagcatgctgctgcatgacagagtgagaccctgtctcaaaaaacaaacaaacaaaaaaaaaaacgaatgagaggtttgaaattagggatgactattggagaggaatttgttggacaagacaagatatgtcttagtaatatcctaagaagatcccgaacacttttttttttttgctttatttaaaatgttatgtaattctataaattttttttttcttagagacggagtctcgctctgtcacccaggctggagtgcaggggcgcaatctctgctcactgcagcttctgcctcctgggttctagcagctctcctgtctcagcctcccgagtagctgggactacaggcgcacgcctccatgcctggctaattttttgtattttagtagagatggggtttcaccgttgttggccaggccagtctcgaactcctgagctcaggcaatccacctgcctcggcctcccaaagtgctaggattacaggcgtgagccatgaaattaaattataaggaaaaaaatgtctactctttcttccactaaacaaattaatgttttcattcatttatcttacttttcagtcctttcatttgtttggcattacatcatagataaacttctatcttttaattaatttttgtcaagttacatatggtgatcctcctttaaaaatggtactaagatgtttaaaacaaaaaacagtagatccctgcgccacccctaaacctgctccccaaatatgattcctttagttaattcttctgagatatacctccatatttctaaacatgcttatagtgttaattcatgatttgttaattttagatattatctattgacttctaatagatgaaaattacattatctttctgccaccacttctccctgttttttattacagttaaatcatgattttagttaaattaatagtcagcatttatataacaattaagtaatcttcactgctgaggcaagtaagtgtactttgattatatattttttctggtacaattcccctcccctcctgccccagagataataattgctttaattcttcacttgcataatgtttcatgtaactagtcttagttttgttctatcagacttgtcatatcatttccctccaaatcatcagatattccatcaattccatcccccgctttccccagagaacttcctcctagagcacactgttctccagccccagcaaggtctgtgctctctagacctgtggcacaacaggtctagaccagaacagacatcctgtcatggtctaatctcccatgtcctggatcctgtgtcttcttcctcaggggttactccctcattttgctggagaatatcatcctgtaatttcctaagcatatgtatgagggatggatatagacatatatatcaggaacatatatgttaagtcttttcatgtcaacatatctttattctaccctcatacctttttctgataatttggctgggtgtgaaaattatgtgttaaagataattttccctcagaattgtgaaagcattgctttattgccttctagcaaacagtacagatgctaagaaagtcaatgttattggccgggcgccgtagcttacgcctataatcccagcactttgggaggccgaggcgggcggatcacgaggtcaggagattgagaccatcctgtctaacgcagtgaaaccccgtctctactaaaaatacaaaaaaaaattagccaggcgtggtggtggcgcctgtagtcccagctacttgggaggctgaggcagaagaatggggggaacctgggaggcggggcttgcagtgagctgagatcgcaccactgcactccagcctgggtgacagagcgagactctgtctcaaaaaaaaaaaagtcaatgttattatgtgtcttattggtttatatgacacttatttttttctctctggaaacttttaggatcttctttttattcctgatattacaacagtttcaagatttggggccttggtctgggtcttcgttgttgtttttgtgcaggccatttagtaacctttttaatttggcaacgtgatactgtgaaatatgtatttagtcttcaacccctttttctggcatagaactcctaaaatccttagaatctccaaaattgtatcttttatatactaatgattcattggtggctggcagcctctaggcagcttcaggatgggggctggtcccgggaagcaagttaggattagagggctgggacgtttagccccgcccctttacccatcacatctgggaaggggagagggaactgaaggccccctgaagttgcaatggccagtggtttaatcagtcatgctcacatgaagcctccataaaaacggggttcagagagcttccaggtagtggaacatgtggaggttcctggagggtggcacacctgaggagggcatggaagctttgtactccttctcctatacctcaccttttcttctgtattatttgtgatatccttaaaataaactgggaaatgtgtttccctgagttctctgagcagctttagcaaattaattgaactgaaagagaggagcatgggaatctcacgttgaacccggttggtcttagaagttctggaggcccagacttaccactggtgtctagggggtgggcggtcttggggactgagcactcaacctgtgggatctgatgctatctccaaatagtgtcagaattaaattggaggatacccagctggtgtctgctgccgaattgattgcttgcttggtggtgggaagaaaccaccccccgccaatatgtagtcacagaagtcttctgtgacttctgttgattgttgtggtgatgtgagggcagaggaaaaatacagcttgagtttttccacactctcggggaatatgtgtccttctcttccagaatattttctttctttctttccttttttaaaaaataacttcttccttctgtttttttgttaatctccttctagaaatctagtcaatcatattttgtttcctaaattgaatctctaatgatcatatattttttcctattctatttgtgctttcagagaaatgtcctcaatttcatagactaacccttctattgaatttttatttagtagaacttctattgagtttcaaggttcagttttcattctctgcctgctcatttgtccatggtgtcctgcccctgtcttacagatgcagtgttgtatctcttcggggctataataattttacttgtttggtttaattgtgttaacagcattgttttttttttccttccaggagcattttttaattgttttgatctatttttcatacagaaaacctatctcaaatatctggtactccttggctgtctgagaatattttaagaatgaagtcctaaaagctgattaaatgctctgtgtagttaaggtttattgaacattggacttcactgtataggaggtcaagctaatcgtgaacctggcctattgggtgacctccaaatgctgaaatctggaggtgttttttttgggcctggctgccagcattctgagatcagagcacggaaagagaggataaggttcccaacactccatatgtagaccttcacttaattctccctgcccctaagccctgaacgttataaggttctgaggggcccctggcctccttatcaataactcccttttgtagcattcagacagaagttcctccactcagcacaagccagctgcctactctgctgccacttggacagttatttatttattcattcatttgttcatttttgaggttttataattttatttgacatcaacagtttgttctcatccacaatgtctgactgtcagtttctgaaagtggtaatgggtacacaggtaaccaaagtatagagcttgcttggtgaatcttcatcctcatgctttctggacagctgcacatggacacagtatggaacgttccttattcctttggtccagacagctttgttgagcctggtgttagcatatctggagtccccatctccttcatggcaaagttctgggactttttgagtgaccaaggggcacactgcttgacgtcccctccatgggtgtgcttgtggatgctgatggcatattctggtgtcaccacctcattggtggcaggtgacagaatagcccttttattttattttatcttactttattttattttattttattttattttattttatttagacagagtctcgctctgtcgcccaggatagagtacagtggcacagtcttggctcactgaagcctctgcctcccaggttcaagcaattctcccacctcagcctctcaaatagctgggactacaggcacatgccaccacacccagctaatttttgtatttttagtagagacagggtttcaccatctcttggccaggctggtcttaaactcctgacttcaggtgatccacctacctcagcctcccaaaagtgctgggattacacgcatgagccactgcgcccagccaacactcttctttacaggagctatgctgctggggccaagttggaaaggacttttaaaattttgttcacatcttttgtccactgagtttggctctttgagtttgagaatttacaaaaaaaaatgttctttcctataattgttatattgtttggagagagggagaaaatatgtgtatatggtcaatgcgctattacctctaatagaattgttattctatatttcacctatatgtatatttttcagttttgattaaatcttttttccccttatcttccctcatgccatctcctctgcttgtgtgccctttgcccccagcaaactgtgttaacacctgttaacatgtttctattctcatttagtcatacacacactctctctctctctctctctctctctctctctctctatatatatatatatatatatatatattcagggagatctttttcatgacttatttccatagaaattgggatcatactataaaaagttatttgaaacttattttcctctctcatcaacacattccagccatctgcaggtcaacagatgtctatgcaactaattctcattctctttaatatttgcataatattccatagtagatagcaatctattcaaccatttctagtttgatggacatttagatttaaactagatctcaccttaattcagccattctctattgatgaccattcagtaccacagaaaaagagggaaagctgtccattttttttaaagctagtataagcttaattctaaaacttgacaaatcttatacaaaaagaaaaactatggaccaatctcatttatgaacataaatccatgcaattctaaataaaatattagcaaatgtaatctagcagaatatcaaaagaacaatgcaccataatctagtggtgcattaacaaactttgtttgttaatcagtgctggagaggtatatgatgaggttcagagctgttttgaatgaaaactataaacctaatagtaactgaaggaaaagacttatatgcaaccacaactatcagaaaccaagaccaaaaacagtattccatagggcataccaaactatttccctccatctcgggaatgagaggacacctgcctgcaccactgggaatcaaccaagtgtgttgtcagacccttccactttccttgtggtcttcatgaagacaagagcttttcatcatgggcatcatcctgcagtgttattgagtagctcccagtggctagtaggaagttactccaaatgatgtatctgtttgccttctctagaagagttccccatctcaaggtgaaataaccgctttttttttatcctccacatcctaggaattttaagggagaggaaaaatgagaggactcaggggagttaatcttctcgccatttaggaaagagtgacatttattagtgtgagcctaggcagccagatggattttgttgggaacatgtgcggagccccctagtggggtggtgatgctagcccgggacctgtaggggagaattcaggagctgaacagggcgagaagcacttatgaactggggtcccagagaaggagggtccaggtgaaatagcttgctagagtcaatcctaggtgcgtgcagatgtcatcctgtgtgtgaccactctgtaaatgaaccctggtggcacggggtcttctcctgtgcttagccctacctctctgttccctctcaagagagaggagggtgtcagccctggcaccctactcacaccagtcactttgttggccttgagattgtgtttctggtctgcctcagcatctgactttccaccccgggatgcgtttggtctgttttgccagttagagaactggagacacctgagcctgagctccttcctaatggttacatttccctggtagcatttgtcactagggcttctaaatttggccatcaggatttcctcaggcttggaaggttaacacatactgcccaagagggaggcaatataatgtaacatgggtgcctcagcttcctcatctgcagaatgggctgaggataatacctcgtcacgatcacccggaacagggcctggcatactttacctagcgactttgtagggacttagtgaatgttccccaacagatctgtcacagaaactgtaaatattgcccttcaccccttccgcacctcttgcagcagtgttatccaggaaggttggaaaccttaggagatgaaggggcccttttctcagggcactccaagagaaccctctcagtgtcttttaaaattgtcaaggtcccagctcatagcagttcctcataaaataccattcctgtgccgggcgcggtggctcacgcttgtaatcccagcactttgggaggccgaggcaggcggatcacgaggtcaggagatcgagatcatcctggctaacacagtgaaatcccgtctctactaaaaacacaaaaaagtagccgggcgtggtggcgggcgcctgtagtcccagctacctgggaggccgaggcaggagaatggcgtgaacccgggaggcggagcttgcagtgagctgagatcgcgccactgcactccagcctgggcgacagagcaagactccatctcaaaaaaaaaaaaaaaaaagcaccattccctttgccatcccctggactcactcctcatcctattccccaaaaagtgagaagggcaggctgtgtagatggcattcctgagaatgagccagtggagagcatctggccctggcatgtgaattcaagccttttcccagctgtaataaccaccctcttttttccacaggggctaaactgcacggtcaagaatagtaagtcatctttttctgttcttcttcttgttgccttcttaatcaagtgagagcctgctgccaacttctgacagaagtcttgccatgccactccaggttcaggctgtgagctacagccatccgcaggagggttcccggagaattgtggatgcgtgcacctgcgcttcctgtcgagaacattcattatgcaaaagtcaggaaaggagaaacagaactgtcatttggattgtgaaagtattctctggggagctgccctactgtatctataatataatttgatttgccacagcttgtcactgtaaagtgagagacatctgtgctgttgattttgttttgttttaattcaaagaggcacatattcaagtgtctgagccaattagagacccctgacatataacaataaagcagctcttactacaactgcatccctcctgtgcccttattcccaatcacaacttcttctcaaaatcaacttgtgtactttgtcttctctcctaaaattccctttagacttgagaggtttgcagtgaccccagtaaacattagagaagagggagcagggcagtaaagctgaggacgcggccaagggccacaggctggaaggccgcgggcccctgagctgtttgctgtctagctgtctgtacctgctgctggggcatctcagggtctcggctataagtctctgaatgttgcttttccctggctgccaggtacctgcctggatgacagctggattcaccctcgaaacctgaccccctcctccccaaaggacctgcagatccagctgcactttgcccacacccaacaaggagacctgttccccgtggctcacatcgaatggacactgcagacagacggtgagtgggcatgccagcagggccctgggggattctccctgcctccaagtggctctcccagtcaggctcaggattgggctcccagtcctgtgctcagacatgggggttcaaatttagtgctataaggatccgtcatttcatgcagtcaaatacttgttcagcattttagatattaacccacagtgataccttctcatcacaccattcttcatgaaaggacttccttcaacctaatatttttagcaccctgaggggaaaaaaaagcaagcagttaattttgtgactacagtaccaaaaatgaagtggaaaatggtaacacatttgtcaacctgttccctgaatttaggggccagcacttttaaaacgtcccccaagcctattcaggaatggagagtttatgttacagaattgggacgattggggcttatgagcactagccccagatttgtgaacggggcatgggggaagttctttttggaagtccccgccctcagtgctcctgctgacagccacaacctcgtgaggatggtggggatggctgtgtttgacacccatgccagattgtcaaagccctcaccacaagtttgcaaagcctttacttctagcccagtgtaaagtgtcatttttccttgcccagctgggaaataactgtctgcaaggcggtaggctgaggccagagagtgaactgaaaggaacaggatgtggagagttgggtaagacggcagattttcttttaggagtgaacaaccgcaacagatagggaagtgacacacccagcacttgtcttggctgatctgcatctgtttgtcttctcttctccctctcctgcagccagcatcctgtacctcgagggtgcagagttatctgtcctgcagctgaacaccaatgaacgtttgtgcgtcaggtttgagtttctgtccaaactgaggcatcaccacaggcgggtaagaacacagctcctgagtggattatgttccactgatgacaccagtacagacttcttgtccccaaattcagaccctgatttagagtgggggagacccagaggtgctgagggagtctgtggaattcagaatggcagcctgagatgggcagaagtcaaaagagaagtggtgtggccgccgtgagcaatagtgagggacagagcgtatttttgaaagcgtccctcacctgctcacccctggtttttcttcccactttacctagctattcgttcggaaaggaagttgaattggaaggcagcttccacagccctacctcctgccatctttgtgtaactttgtgtaacatcttttatgtgtaacttggattcagctggggcctaccttcaggaagaaaaaaccgcccagaccaaagaactgctgtaggtgggcaaatgagcactacaacagcttagtctcattttgctgctcacagctaaatggtgaaatgttgattcttgtttaagtttgtttaaagcagtgggtctcaaagtgtggtccgtagaccagcagcctcagcctcacctgggaacgtggtagagatgtttggccccaccccagacttcccaggccagaaacttttagggtggggtccagcaactggtgcttaacccttaagtcatcacgatgcgagccttagtttgaagactactggtttaaatctgcaaatggtcacttgaaaacaagttagatctcccacaaactcaagcagcaaaggcagaacccctctccgatgttaaattaggacccccaaacttgactgctatgcgaatggtgagaaccaggttcctccgtccacttagaagcaaaggaccccggcccctccaccagggtaactagaatgggggttggagtcgatgtctgtaatctctaacacccagaaaataacttagcacaaattcaaatatcattgcaactgaggtgcctgctggcccagggtgagtgggggtctctagcttgtcctttgcacctttttactccataatggtctcaagaggtccctggcttttccgtttgaggaggaagaatcatttgacaaatagtttttacctgcctggcgtgtgccagatctccatagccccaagtcccctggctccgccctctcatacccattgtcctagaatttgagagggcaggtgggaggggtgggactacttccactttccccaaattcttttgccttattcactgtctactgatgaggccagatccaggtttaaaaaaaaaaaaaaaaaaaacaggcagaaaggaccagaggaaacaaaaaacaaagatactgatttccctgaccttggattttgctgtggttgttgctttgttcttatttttggctgaatattcgggagtgggtgggaacgggggtctttgggcatagatgggtgacagaggtgtgtgtaatccatccaccttcccttcctcccttctcttcagtggcgttttaccttcagccactttgtggttgaccctgaccaggaatatgaggtgaccgttcaccacctgcccaagcccatccctgatggggacccaaaccaccagtccaagaatttccttgtgcctggtaagagcatcctcccaagacattccctccccaatggcctctgtgagaaggaagcaccaggtggcacagatgccagcccccctgctcagcaagacattggctggcattgccagcacctgggacccacagaacaaacagaggccaagactgggagtgctttggtgtgtgctgcaacctccattccctgaggcagaggccattctctgttggcacaacagtggacggtggcccaagatcccaggagttttatgggaaccagagcacctccctctatctagagaagcacccagcctgcccagaaaatagcataaaggcaagccacaagccactcgtggggaagttgcagcctctgcccccagcctggtcccagcctccgtggcttgctcttctccttccaccttacattctgcctgcatcatccaacgttcatcccatgcatggcgctctactccccatgcctatccacactgcctgtgattaccgccaggcttttcttctcaggcatcctttgatgtacatgtaccttctacttctctgtcctccccagaagctcagctattacctacatttctctctttttgtttttaatagagatagggtcttgctttgtcacccaggctatagtgcaattttgctatcctagctcaatgcagcctcgaactcctgggctcatgcgattctcctgcctcagtctctctacaattctctgtccatagccagctatgtcaggaagcccacttgaaaacaaagcctgggtcttctgcccatttttataatctccagaacctcacgaattgccttgcatatagtaggttggtcaagaaatgcttgttaaggatggtgttgaccttcttcatcctgggaccaccctgcacacacgcgtgcacacacactctgtgcttaccctgctttatgtcaccgcgtgtggctcatcactccctgactggtactgcatgctgtgtgtttgcttttattggtctcttctactgggttgcaatctccagggggcagggctttgtcttgtttaccactgtacctccagtgccaagaacagggcctggtgcatagttggtgctcaatatgtatttgttgaaggagtgaatctcctcagttctcgcttctgttcctaaagttgactgactcagtccctgtccctccatggtgattcacacctgtcacatgtcttctcagcctgtgcaaagacaggggcagccggggacaagaagctgtgggtgggcagagaaggaactggaggggaccaagattgcttggtcacccacagcaagctcaggaggaatgcacttgcatcaggagggttccccgagagatgaggatcagacaggcaggctggcacccatgccaaggtgggtccagccctggagctcactctgaaggggccacctgcggacaggctcccagtggggaaaagattgttgttcttggtgtcaggagtctggaagaacagatttctgaaggcagaggcttaatgagtttccttttttctgggtcgacagactgtgagcacgccaggatgaaggtaaccacgccatgcatgagctcaggtaacagctggcccgggagagctttatttggatgcatacacatgcacatgtgcgtgcccctcctcactcccagcctgcgtgtgtgaccttggcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcggtaactctgctctttttgacccctctagcatagctcaggaccacccctccaagccctgagtctcttctctgctggtctgacagaaccgcgttgctagaagctcgcgactcagggctgtgcttagtccatagtgatcatggcgccttgccctttttcttccccagtgatcttatgcttgatagaaaggcagttgactgtgtcctgcccatgactcagtcctttttgttctttcctcccccacacgcccccttgttctctttttgttttgctttgtttattacaaaaaggatttgaggatttaaaaaaaagaagaaatgtgaaaatagagacaaaggggaactaaagataaggaaataaggccaggtgcagtggctcccacctgtaatcccaatactttgggaggccaaggcaggagaatggcttgaagttggagttcgagactacagtaagccatgatggcaccactgcacccactctgggggacagagcgagaccctgtctctaaaaaagaaaataaaaattgaaaaataaataaagtacattaatgacataaaatatgccaggcacagtggttcacgcctataatcccagcagtttgggaggccaaggcaggtggatcacttgaggtcaggagttcgagaccagcctgaccaacatgatgaaaccccatctctactaaaagtacaaaaattagccaggtgtgctggcacacgcctgtaatcccagcaatttgggaaactgaggcagaagaatcacttgaacctgggaggcagaggttgtagtgagctgagattgtgccactgcactccagcctgggtgacaagagtgatactccatctctaaaaaaaaagaaataaaggtaatacgatgaagccagctcagtgcaggaaacgtgtgctgtgtggttctgtacaactggtgtccatgaacacagatttgttgccccaattcccagcagccaaagcaaagagagacttaccagttactacacgtacttaaggatttacaataaaccagcttccatgcagaaacggagtttttttctggaatagaaacctgaaaagcatttctcccctggccttcctaaggggtgctctggacagcctctccatggcagtgccacagcgtgttcttacccaactagccttacccatcccaactagccttacccatcctcgcctctctcctcagcccagaccagaagagttccaccagcgatccaacgtcacactcactctacgcaaccttaaagggtgctgtcgccaccaagtgcaggtgggtgagtgtggtgtggacaggtgcagggagcaaaacaggtggcaattatagagtggacaggagtgaggagtgtgcacaggtgaagagtggtgtggacgggagtggggagtgtgcacaggtggagagagtggtgtggacgggagtggggagcgtgcacaggtggagagtgtggtgtgtctgggagtggggagtgtgcacaggtggagagtggtgtggacgggagtggggagcgtgcacaggtggagagagtggtgtggacgggagtggggaacgtgcacaggtggagagagtggtgtggctgggagtggggagcgtgcacaggtggagagagtggtgtggctgagagtggggagcgtgcacaggtggagagtgtggtgtggctgggagtggggagcgtgcacaggtggagagtgtggtgtggctggagtggggagcgtgcacaggtggagagagtggtgtggctgggagtggggagcgtgcacaggtggagagagtggtgtggctgggagtggggagcgtgcacaggtggagagtgtggtgtggacgggagtggggagcgtgcacagtctggcattcttgctggtggacaggggaaagcttgtcctctctgtggcaccaagcaccactaccagtcaggattccttgcctggtaaggcactgcccctgcctttctcctgtctggttctcccaccctcacctgggcaggggttcgctgacccgcccttgctggagggagatgatggtcacctggagatcgtggtgtagccagccaggatcccctcctctcacattgccgctgctggctggaaggcatgggcgctctacagttctggagcccttttcctgccctctctgcccgcagatccagcccttcttcagcagctgcctcaatgactgcctcagacactccgcgactgtttcctgcccagaaatgccagacactccaggtaggggacatgcggctgtcctaggccatactgggagaacaagtggctgaaggcccccagcctgtgctgcgtccttacctggttctgaggggtgattagggaggagagtttagtttaacttggagtccttcaggcctgaagtgtggagtggggctttagagtgtcactccctggggctggactcctggctgtctttcattagctatgtagccttaggcaaattacttaatctttttgattctcaacttccttgactggaaaatgaggtggtttttatcctagagccctagttctgtgccatgcactgagcgcagtgctccaacatgccgtccattttttcatcctcactcattgtgagtcacggtactatgcagtagaggatccccccaccccaaaccccaggttcctggataaggaaactgaggcacagagatgttgaataacttgtccaagatcacacagcagggacgctgttttcaaaagtcgcatgccctaatgcacgggaggctgcagccacgtgctcaccagaaggcaaggcgcaggcatggagccaggctggaaggagaacccagcctcccaaggaggaggcaaggtgtctcttcttagaccagcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccgaggccagcccggggtggggggtgagaccatggtttgtcgtggtggggccagagaggacagagcctggggctggggagcagggctgggggcctcagggtgggcagggcaggccccgccgcatcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccaccactcactaccaaggcaaatcgctttattctcagagcctcagcttcttgcttgagaaccacgtcataaagctgttgtaaggactgagtgaaataagacacatgaattcttagcacagaacctggcatgtgctatttgcacagtatctgttagccacgattatatttgttgttatcaaatgtagtattattaaaatcaatagtttggaaggagccggagtaaagtttccctgtgtcaggaatgatcatccaggcaggtggagcagcctgaacaaccccatcctgcagccgccagacgtggacgcctggggtcagggagaatagtgagggtcagcatcgggtgatagagaaggctccggctgccctgagccacaggggtggaccccagccccacctcattagccttgtagtcacaggccagttacttaatacaccatggattcacttttctgtaaaatgtactgataatgcctccctctaagggtgtgacgaaggttaaatgagtagctgaggaaggtgcttgctggtggggattagtacataccagtgtcttctcccacctgcagccctctgctggccaagtcctaagccgggagaacacaggccttccggttggggcttcagcccttgcctgccccaccatgaccctaggctgctccttccgtcatctgggaagctgtttccacccttccctaggctcgtcaggattaggtgttaatcattattaattattatgtggtagaaagaaaaccagccaggcatgggaggacctatgggaggttccaataacattcagtagcatctcggccagtgctccacaggcggtgcagctctctaaaggtttggggctgggcggcggcggcgcttttggtttcctttctgctgttgcgcttctgttttccgaagtgtcctgcaccacagggtgaaggcaagaggagcctcgctgttatttggctgtcttgtgacagttctggggaagagctgaaagggttaggattgagattaaggttctaagtcgtttgctcagtcatctgtggatctcaatcctcccagctgtcactaaggagttaacccccgcagagcagttttttcatcacatctctgaggggaacaattgcttaagtatgtgggttccccttcctcacctcaaaaataccaggaggaaatgttgcaagcagcctggtggggctgcttctggaaagaagtgtggtaagatgcatgtcttctgtaaagacacttctggggaagagcttttcctcatgtggagtcagtttggggtggccaaatttcagggagacagggcagaccaggaccgtaatgaggaaccagaatggacaccaccccctgccccccggcactgggggtcccagctggatcagtgctacaaaataactgtgatcccaattgattatgtacaacgtgccaggcacgtcacatacacacactcatttaatacccattaaacaagagcaaatacagacccacctcacagaggaagaagctgcatttcagaggcactagtaactgctccaggtcatagtgctcgtagtggcagacccaggactcatgcctgtgcgaccacctagcacggcctcgctgctcagtctcggggctgcccccttacccttcaccctttgtcagggatggggcagacaccctgtgagctggtttctatttctcttcccaaagaaccactccagtgtatttcttttcctttccagggcctggaagtgaaaaatacagtgatgacaccaaatacaccggtcagtatttcctggtttgcatgtttgcttatttttaaagcagtggagggttctcctgggataagtgcgtgggtcgcctcctgtgctctaactcccaagtcccttcaggagaccccaccttagaaacccccttccagtaccccactcagaagggcccccaataacaaggcctgggtgccattttttgaatcactcagacaaggaaagaaaggtaagtattttgtgaacagaggtcctccctggagcagaccaacagagcttggtgcctctttttcttttcttaattaaagtataggctaaagaccagctaggaacgttgagagattctttttcccacaaggcagcagactgatttttttcaggcagccaaaggtggaatagtaacatctgggtttttccaacaggcctcagttgggtttctcagcttagggagggagccaagctctgtgtcctggtccaggcccctcctgggctggcaggcacagagctgccctgggccctggggtgagggtcagcatgtgtggtcttgtttccttagatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcggacatttgggataccaagataaattgcatgcggcatggccccagccatgaaggaacttaaccgctagtgccgaggacacattaaacgaacaggatgggccgggcacggtggctcacgcctgtaatcccagcacattgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaagatggtcacgcgggatgtaaacgctgaatgggccaggtgcagtggctcatgcttgtaatcccagcactttgggaaggcgaggcaggtggattgcttgagctcaggagttcaagaccagcctgggcgacatagtgagacctcatctctacctaaatttttttttagtcagtcatggtggcacatgcctgtagtcccagctactcgggaggctgatgccagatgatcacttgagcccaggaggtagaggctgcagtgagctataatggtaccattgcaatccagcctgggcagcagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttca

SEQ ID NO: 690 - DNA, 49359 bp, Human
atagagtagaacagatttagaatggattgagggagggtgacttcttggaactagatcactctattaattatttatgttgtgtagagatattgcgacatgcatgcaatgcttttatttctttattttgctttattttgtttttcattttggggggttatcccaggaattcaaggtggttttatcttatttttttttaatttaacttttattctgagttcaggggtacaagtgtaggtttatgtaagtaaacctgtgtcatgggggtttgttgtacagattatttcgtcacccaggtattaagcctagtacccattaatttttcctgatcctctccctcctcccatcttccaacctccaataggccccagtgtgtgttgttcccctgtatatgtccatgagttctcatcatttagctcccacttataagtcagaatatcctgcaatgtttttaaaaacagtctgtagtattcttctgccagttgtaataatgtgtaatacctaagggtaagataagaatagagcgataattttaattccaattgtcactgccccatttttatttctgcttatgtttgcatgacatttataaaatcacataaacatccaaaacttcttagatatgctagattcacagcatatagaatacatatatgtgtgcatattagctggtagtatcaatggggtatttttaatctcaccttcataacagagtataaaaccaaaaattcacaagactgaattttgagcgagtttttatattatgtaatcccaatgcacatcattgtacaaatgatgctaaaaatactataccacaggcaacagtgtttttgtgttgtttactaggataaataatgtcttcagctctagcattactcactatcataactaacatattttatatatgataccaactgcttaacataggaaagtcattgaattcatagtatatatttttaaaatgttgtgataaaaattaatgagatattttaagtctactcctgacctaaactatcttgattgttgcaacagatgcatttatttgattattgattgtaaataggaagatttctttttttccaattttgtgtattccaacattggcatatgcatagtttaaaaaatgcggatgtgcagctatgcaatgggacagttatttcatataacacattgcttggcataaccagagcacaatatccataacaagttatttatatcatatgtagtcctcctgtttttagaacaattactaaaacttgttgatgttatcgattaccaataaatattgagaaattccttaactggatacctatatgcattaatacatttctggaatggaattttaaataaccatctgaccactgagttttcaaaactgctaaataccttaatagttgcattaaccttcatttaattataaaagtatgacatctgataggctttagctcagtgtgatacaaatttaattttgtttatataatatatcatctacaaatactatccagaagaagcacattagaatgtttaattatactagagattaaaagatatttaatatataaacttgagaataaataaaatagagaataagaattgagaattacgaaaggaaactgaagataaaatttgcagattttaagaaaatcaaaattcctcattgaattttgtcagaagagttcaagaactgaaataattttaaagctttcagtgagtgaaaaataatagggagaagtagcaagagagattgatttttgactcactttcaactcggtactgtttttaaatgcctttcttattttcaagcccttctcaagctgttccttgaagttgtataattcctgttagtctatagatgtgaaaacccatttttatatgaactaccttctgcgttctataaacataaattctcagggttgggatgtcttctagtctaactctcccattgaatgtttggacgtcatctaccaaatccgtgtatctaaagcaaatatagtagatctaatctggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtttgttgtccgggacgtacattttcgcggtcctgctagtatgcgtggtgttccactctggcgcccaggagaaaaactacaccatccgagaagaaattccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaaggtgcgttttaaaatcactttgttaaagatatcatctcattttttaaagagtaaaataaaatgatattaatgtatttcaaattttgagtaagccatcaccccaatttttcaaaatttatgtaatttaaagcatagtggagaaaattcatcaatgcagtttttgcaattacatgtggattatgaattttcatggtatgtatattcattttcaaacagttgtgtttccattaatctataaagggatcagacaaggaggttagccctgctacttacaaatcagtagtttgcccagcttcattcttttaatctgtccagtcatgcttctgccaaaaacttgatataagcaaatcattaagaatgaatccataaatctgattatcaatttttcctagtgattactttagatacacaaattttatcttgccatttgatatggtgccaaataaatctatttgagaggtgactagaacaatttaatttattactagcatttctgaacatatatagataaatatttttcatgaggatttcaaggtaaggcaaggtctttagcatatcctgaatcatcaaattgagattaaattttagtcaatgttctgttaatgttaaatattttctttttttacaattatttgaaaacagagtgttcatttgttgtaaagggtaagtaagccttttaacaaaaaagagtcaatcagttaatttgaataacctactctggcttgatttgggtcttaggatggagaagttagagagaagaatagatagaatatttggtattcttcaaaatatgtgcagaggggccacatttatcaagttaatgatcaattcttttaaattacttatatgatataaagagaaatagataactcagatttgggtatgtgaaatagtacaatgcacttgaatgatcttggaaaatatatgttaatgaaataactaatgtgcatgtttcagatagatatgttcaggggattttcacacttttataaatattctgccaaactatgatctatataataactagtgttaaaaatatgccccaaaacatataaataagacattctgatatatatcatctgaaggttttgacctggaggatatataatatgggaaaatttctcaactaatgctgatctattgtaaagatatatttatttataaattcattcaggaatggaaggctacaaacctcttgagcaaatttcggtgaaatgcagatatgtttgagtatatgaagtgaaaacagaaagagaaggatttggaaaacagggaactcttgaatactgttggtgggaatgtaaattagtacaaccactaaggagaacagttttgaggttcctcaaaaaaactaacatttagatgatttttaagtgagcactttggggtgaagttcctgcaatgacatctccttatctgatgaaatggaaaaatattcaggagtcagatagatatggatcacagttttatgcttacctcttaccagacatgctactttcagcttaatctttttgacctttaatttcttcagtcataatatgaggatgataatatcacaggggcagaattgggaagaataagcacttagtatggagtagacatacctgcatagaagatttttgaacatgctttaaaacatttaagtacttatagaaatgtgaggcttatcacttgacataataaattgagtaacagagtggacagtctctctctaaagcaacacttcacaacagaattttctgcaaggacggtaatctgtgtgagaacaatgcagtagccaccagtcacacgttgctgtagagtccttgaaagtacttagtagctagtgctactaaggaactaaattcttaattaattccattttaattttaatagccacgtggttagtggctatcatactgcacagcacagcctaaacaaataaaaaacgtttatttggacaataaaaattaatagataaaatcaaaatgagaccttaccaagtttaaatcagatattagcaatagggtctcttcaactgaccatcttgacaaatgtgttgttttaaaacgtagtgctttattcaaagaataattttgtcatgtctcccttagggcagcttaatgaacttccaagaaatttctgatttgtcttgaaagctgcttaactaattcagataaaacaaataagcctgctggcataattttagctttgttaaaatgtgctttcatttgacattctttgaaagattgtcagcaaatgacaaaaagtctcactacaggttcttagatgagtcttagaaatgctctaaaatttctttctgttttagaatgtgtgataagcctaaagtaactatatgatgtgcctaaagtactggggcatttgtgtggccccgtggacaaatactgttttgactgcttgttaaaaataatgagaatggaacacaaagcatagccccaggcatgcagagggccatgacatgggcgactttaactgaatgcactttgactcgcaaaaaggccctgtcatgaaagtggcatatatgctatgggaaaggagacttaaagaaaaacagagaaaagaagcatgtgttgattcatccataaactttagtaaattttacaatgtgaaataagtaggccaaccataataatttcttttaaaaatccctttgtcctgcagaataggatgagaatttaattaatattaatttgctctacttttgttgaatagacaagaatagaaaaatcaccgtttatcctaactaggctaatataaaatgtatatgaatagttcaaatagcaaagggagagaagggagaaatatagagaaaaattctaggaaaaaagctcaatttaaatatttaaataggtcaatttatacatgaaggtgtcctactatttactatttgatattaattaactgaaattaaaggcattggtggaaaatatttaaatgtttaaaatgtatgtagtataaaatttcataagacttaaaacttagaatatttatttctaaaactaatatatacatatattaatttagcttaccttttgatgactttcagtataccttggcacaaacagggaaagtattatttcacattttaaatatttggaaaatgagtttcagagtgataatgtattatgcttatcatcatatgactggtaaatgatagaggtaggaaccagagtgcagttcctgactcctaatcaacagacagattgtagatggatagataaccttcagagcaggatcactgcaagttcatgatacaaaacgaaaagagtgaaagaaagaaaaaagactgggcgcagtagctcacacctgtaatcccagcactttgggaggctgaggcgggtggattacttgaggttaggagtttgagaccagcctggccaacacagtgaaaccccgtctctactaaaaaaatacaaaaaaaaaaaaattagccaagcatggtggcgggaggctgaggcaggagaatcacttgaattcgggagacagaggttgcagtgagccgagattgcgccattgcaatccagcccgggtaacagtgaaagactctgtctccaaaaaaaataaataaataaaatttaaaaaaattaaaaagggaaaaagtgggggaatgaagtgattaccaagtaattctgcttgtttaaaaaataagtaaaaataaaacttatttatgtgactttgatgcgattaattttcaactttttaatggatcatgttactctttaaagaaaaaaaatcatctataagagttcttgatgttattaatagttaccacttaaaaaagaatccagatttgaaagcttctcttttctctctttcaagtaaaatcatactgcaatgctaattccctatatacatatagctatttacatactcacacacatcgtactacacattgcagtatttcgaagaactgttgttcaggagtaggaaatcacagatctctttaactttcactttttaattcagatggcctgttatttataaagctttttaaaatattgtaagtattttttgacagggaagccaacattttcacaaatagaaacatccctcaagcacccagtctgactcagaatatgtatataaaccacagggacttccttcttttctcatggtaggaactcaggggaaattagtttatataatgatgttacagttatttttattttctgcttcaaatttccatcttccgtggcatatatcaacagtcacatttctgtactagcccagtgacagtgtgctgattgatttccttaaggcaggcatgacagtgtttcaaaggttgacaatttttgttgacagaacatgaagatcaactttttctcagattagtgatcctactcaaggccttcccttgtttctacccatcccataaggcatcctcatctgttccatgaatctcaaaagatcatttaaactggggtagtcttttaacatagtcaagatgtttgggcccttgtttttattttaagtaaacatcttccccattgatcaaaagctggactggatttatgaaactaaggttagaattagatttgttttgcgatctggggttagaaaatctaaattgtgaaaaatctcacctaccacaagatttagaaatcttgatttaaaattgccaagaatgagacatcaaataatacattgtgaagacaaagagcaagcaaactttgttgttctgaagaaattaatattttttaacattatgtaaccataactcaaagtgatgtgtaacattagaagtgagtaaagattcattgatgtcagtgcagagagaatatactataacaatgagtataacaattttagaaaacttacttagtttatttgcctccaagaggctcagaagagtttgaatataatgatttcctcattttttcaaatataaaatgaagtttcacttaaaatttctccatttcagctttaagtttacttgattttatagtctctgaattctataatttgcatattaatatttttgatctaatgttaaaaagcaaaagagatgacaatcaaatgctaacgactatgaggtttctgaaagctggggttattatcaaagtacacttccactggggaaaaaatgacaacataaaactcactgtcttcataaatgaatctttattaatgctgtcaggtcttaacaaatgagagtgtgacactaataggattaagtaacttttgacttcattactattatcagagtcttggttagtgttcatcgtccactaatgccttttgttaaatatatctgttattaaaaatcccacagtatggatggacacttatggaacataagttggacatcgtaaatagttcaattctggagtttataaattgaggctctgaagaacaaatgtgttcccaaatctgaatgatctactcacatcatgcctcttaacttaatattaccaactaactataagaagcaccactaaattttatgttattagatacagatttattgatctgttatttcattgtccactgtatctaagtaaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaactttgatcaatgctaataatctaagattataaatatcccaatgtgggtagttttcttggcataaattattctttttgtctacactgatttatattgattatataacaacactgctgtggagacactctcttagtgaactgaagtgtgatctttcaatcttagataaaataaattgatggattggtaagatttctgtatcagaggtgatgacaccttgtatgagaagtgatgataaaagcaataaggtcattctgcagaaaactttctgagtttgtttgagttttatctataaaataatgtatctatcttcatgattttaccagggtatgagtttggaccagtttttgatggaattggtctttagcaaaaactataaagtgcagatgaaaactaattctcacttaaaaatcaaatactgaagaaattaatattctcccttttgtatttatcagtgtacagtcatcttcacaaaactaatcaagaatgaataattaaataatctagtagcctaatagaccaaataaattgctttgaccacaaattaaattttagcagattgttgttcaagtgtctttcaatttcccagtgcaggtagatgtcactggaggaaggaaaatattgagtctaatttaattaaataacgcagaacttaattttcttaattatttttgaaatgtccttttttcattggtcttttgcttgcacaaattatatcttcaccaatctattctacaaataggtaataaagtgttttatccataaaatgttaaatatctattactagagcactaagggcatcaaaatagaatacatgtggacacacactttttagcaattaaaactataaaaatatcgctagttatctattttgtatttcctttgaaatagaagaggtacttctaggtgaacaatcataagaaacctattgcttattctttatacattggaagagtatttagtggtagcatgttttaattgctgcatgcacatatctctatacttgctggtaaactgaggaaagtagtataacgtcatatataggaaacatattttaaaagacatattttgcaaagtaagtgtgaattttgtttcattaagcaaaacaaaggattttaaaagttgaaaatcataaaatgaagttttggattttctaacctaatttacatttgtctttgcgatctcacttaatctggaattttattttatgtagagtattatcatgaatatttctcatccttttacttattttatatatagaatttcattattttaagcttcttcaatacaatgaagtgaaattctaaagaatgaaaggctgttctattaaattttgtctagatgtaacaactgactgctaactaatatcttagtctaattccagtaatctaaatttaacacatatttaatgagtgctcaatgtacaaagtcttgagggataaaaaatgtgtttggaaaacagtcagtgtccccaaggagattaataacaggcattatcaggattatatttttgctctaatgatagtaaagaggaaagaatatttattttatatatacatacatacttatgtgtgtgtgtgtgtgtgtgtgtgtgtgtgtgtgtgtatcttttttctttctttttctttgtgagacacagccttgctctgtcgcccaggctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccaggggctcaaactcctgacctccagtgatcctcccgcctcggcctcctgaaatgtcatggttacaggcatgagccatcacacttggccatatttattatgttataagaacattttatcttaaattgatcatgctgccattaagaaaatggaattatttaaagttttattgtctcagaaaagttaaaattttatatctatttttagtagatttttaccaagcactctcattaacttatgatatcttattttgttactaggtttgcaattatggcagttaatactttttgccaacatttatctgcacaatcattttgagactggaaataaaacgttttgatgacaatggtaattcttgtgctagttgtggtaattacctaagtctttctattatcttaattctcaaacttgttatctgtgcctacaattcctctcctatataatagagaaaattaaaattatccttatgtagcatgcagggatattataaaagctaatgatataagtaaaatctataaagtttgctgagtaccctgaagaaaactgttctgtaaacaatagttatgggttttactctgtaggttgaggttaattacagtctttcacaatttttctaagagttgatgcttcatactccttaaaaagcctattttacgacttaaacttagttttccatacatgttttatgtatgtatacagagaaaaatatgacaacattaatctatttcttgatcagtgccactggctctacatttttttctggacctagttcagtttttgttttgttttgttttgttttaagtcttccacttaccctctttggcttatctcttgaatcaaatgtctcctcttcatttgtctttgtctcctcgtggccctccatatgacagtgatactgctaatatgagtactttctcatatactgcctctaccatctggaattgctttatttacatctcattcatatgcccttatttttttaaaaaagatttcctctcttgtcttttgttttttcaagctgagaacttattttcctatcccctttctaagacaatcacgactgttttttttttccagtagattttgtagaacaggtgtgtaataacatacttgaacttttttatttttaattattctaaattaaataggtcttaaaatatcctttttcaagcagaagatttgctataacaagcctttcctggatgctagtatgtttttctggcttataagagagccaagatatcctctgaggacaagagttgtttagaagaattcatttaaaatagtttgaccagggaaatatagcagaataaacagcctgcatcctaaggacagtggaacaaggggagcattgctgtcagtaatgcaaataacaaagtaaatggttaacagaagaacgaagttgtgttctagataatcatacactgcctctacggtctggatgcatgaattctagagaaacaatttaatggactataaataaattaagaagtttaatactttatagattacttttagttgaacagagtgctttatttaagtcactgaatgattatatgcatgaattttagattgcatatagatatcaaaaagccaaagaatatgatcatgcttagctacaagctaatgcatattcaattaactcccattaaactaccttcaataaataagtaaatataaaatgaaggctacttacattgtttgaatacacaatataataagattctgatgctgattatttgattttgtgtttagtggtttcatactgcttttgcttggaggatgtaagtatttaacagatcctgtgtgtttcaggaggcatttaaatcttttaattttgctgtgaggaaagttattcctaagggatcagtcacagatagctatattacccccatcaaatgcatcattttcctagattccaaaccctatgtagaaatctccaagttgaagaagtaacaatgaccatgctatcaatgtttaatcctttggaaaccatagtaatggtataggaatgcacctttttaactagaagtactcatgggcctggaaaagtgaagatgacctcattggggaatggatatatggccctaaattggaaagtcattggctggcttctgtataggctatttatagcccatttattcatctgcagcttttaagattctaaacatttctctataatctattttccctatagtttgaggttaattatactctgtttatctatatgtttaagatcaattacctaactgctaaaatgaaagcattttcatatagctagagctctcacacagaaaactagtttacgtgtaaggtaaccagtttaataaaactgataatctctttagctcttagaaattggattttaattatttatctaatagacaagacttcttaagctatattttctactcaaatatactaatggaaatgtaagtaatttaaaatttttctccaactgttttgtggatgttttgtaaattgtaatctcattgtaactatgtctggtgttctacaatctagactataaaggtgtgaagcaaaaaaaaaatgatttctttctgaaataatgttttgcattactattttacaccacaaaatagtgactggccttatttaggtattgattaatgtaaaaaatggcattttacccaataaccttcctgttattaccaggcaactatgaaatttagtgacacaattatttttgtttctttttttcatcttaaggaacaagttcttaattagattcgatacagctataagtaaacataaactatgttcttatgtaacctcaagagttattttaggccgggcgcggtggctcatgcctgtaatcacagcactttcggaggccgaggcgggcggatcacgaggtcaggagattgagaccatcctggctaacatggtgaaaccaagtctctactaaaaatacaaaaaaattagccgggcgtggtcgcgggcgcctgtagtcccggctactccggaggctgagacaggagaatggcgtgaacccgggaggcggagcttgaagtgagcccagatcgcgccactgcactccagcctgggcgacagagtaagactccatctcaaaaaaaaaaaaaagaaaaaaaaaagttattttaaagtgtctccatgccttgttacacagttcattgacaattgtttaatctgttgctgctgttaagtttccttaaatttgtgattatttcaatgagttagtgatagtttattcacccatatttgtggtgcattgccacaaggaattattgacacttctttttactgacaacagcttttttgttttgtgtttacagtgtgatgttgagagttttgttgtttcctcacaaataactgactgcataactctatgctttcctacatggttagcaattgctatttcatgaaaaattggatttgctttcctagttgcagttatcagtcggtgcttcttaaaaagatagctgtttattttgatgactgcttaggcaatatttattattaagtattgctttctcaaatgatttttcacagaggcagtggacaaatggtttgacctgtacagtgtacagtgtacaaagattcattttgtagcttaaagaatgaattatctttgtgtcctctgtgtgtgtgtgtgtgtgtgtgtgtgtgtgtgtgtgtattatagagacagggtctcacagtgttacccaggctggagtgtagtggctttgcacaggcacaaccatggcatgctacagccttgaactcctgggctcaatcaattcccctgcctcagcctccttagaagctgagactacaggctagcactaccaggcccagcgttttttgtacattttttaatctgtattttatcctcatatgaatttttgttatctatttgccttgtataatattaggatgggtatatcatttatcctccaaattaagattaaacagggacattaaattaaattaaacagggacaaccagaatatatagtcacaatatttaaaaccccaaatttctacagtaattccttcttttccattttacatccttcttctcaaggtctggtctaccttgagccagagagctgccatcttctgcaaaacatcaatggggtcaactattatttgcacaaacttgaacttcactctgttttaatttagcagagcgactctcaggctgacttggttctgttggcaaaagactagcttctgaagaattgtctaacagcagaaacgctgtcatcaagcttgtacatagggtgaatttttttctgagctggcattgttcatctaatgtagtgttttctaaagctaaattttacacacacacaaaaaaaacagacatggaaaacgggcataattgcatttagaattatgttacttttggacataagatttctatttcctttgatactattcaaatagatgaagactatgtcgtttgcttctatgcactgatccacaaaatgtaggaggtattaaatgtcttgccaagttactaaacaagtaaagttttcagaagctcaatgtgtgaccgagtttctccttttctacacatatttccctaaatagccatttgtctacaggccatttgagtatagcctgaagacaggatgagatacagaaccacttaagcagctttccaaaatgaggttttagattgtggagccaaagctctgagtggtttttgtaagagaggaattttttttttgttttttttttttcttgagacagagtctcgctgttgcccaggctgaagtgcaatgatgcgatctcggctcactgcagactccgccccatgggggttcactctattctcctgccccagcctcccgagtagctgggactacaggcacattctttatgactgtatctccatggacatattcttcataaatatttagaacagcttatactgtcttctattatactggcttgaagataattgataccattgatgcaggatcaagtgttgtctgtctttgttcatctacattacaaaacatggtgtcaccaataatctaattatttttgttatactttcctgtgttactggtttgaagataatcgataccattgatttgggatcaaatttgtattttgctgtttttctccattcatcaacagtacaaaatgtgctgtcacccataatagtttatttttgcatcatatgttttggatttctacattcatttgcctgaatttttcactcagggttttggatattatatatttcatatgcagcatgtatcatttgttggtgacttaaatgcctgtatcctattataacagaactaatcacttttctaaagataagtataagtttggtccacaaaaaaatttctatgtgcattgactcattgaacctgctacgatgaagacttctactttacaattcaactatgcatatcaggattactgatttctttatatgacattacttatgaaaagaagtaattttatgaattactaaacactttccaagtatgtttattttgaaacttgcctttaattaatagagatagcttgaatatttagcatagtccctaataaaaataattgaattaaatttaagtatctagtcaatagaattaatagcaattgctataaacctaaataattatggtgataataaaaatcaagttaaatacaagatgtggtatagagttcagttagcttaataatctaatgttttactagtccacattcaattttagagtaatgatgttgaaaatgcaaattacttattattaggttccttaactttactatttacttactttttagtttttttaaagttttattttaggtttaggagtacatgtgcaggtttgttatataggtaaactcctgtcttgggggtttattgtacagattaattcatcacccaggtactaagacaggtaagtacccaatagttatttttttctgctcttctctctcctctcaccctccaccctaaagtaggcccaatatctgttgttcccttctttgtgtccatgagttatctttatattaattatttttatttcactacttggcagtttgccaaatcagaaacttgattttgataagagaaaaatgtctatttcagaagttaaaaatccgtatttaccaaatgtttaccagtctactatcattgatagggttcactatatttcaatatatatatcccagtgttgtcaaatttttgaggtattgtgattttattagtgtttgataatgaaaacataacttcaaagtctattacctgagcattgctttaatatccaggattctttgtacatgccattatgttcctgaaagtacatttagcataatatgtatagctaatttatttgaaaacatagccaattcttcattattcagaagttaataatcaaatttcatgaatcatatccctccccactacatcctactacatttcattttccttcaaaatactttaaaaatacttcctagaaattatctactttagcaaatgcatttcaagattctcagaaaatattttttaatagtccagaattattcataggattagataagctcaaatctccattagatgttcttttctgttattagtaaactcccctctttagtttagatcagtgttgtagcacccttattcttggtttctattacatttacagtatcttacaaggagcagcatctgttactgttctaagagattaagtcaaaccaaataggtgtgtctatttagaataatagggatttttaagagaattataattggatcttgtaggtgtcacaaacctcagtgtaataggcatcattgataagagattcctcttttaactgtttattttggcattgctacattcgttttgaagattttcttggtagccttgcatacatgtctttaaaccatttttcttacaattagatgctgtgataacatacagaggctgtggatacctacaattttaacttctgctttgactcccagaaggaaagtataaatattatactggctctgatatattacaactttacattaatttttagacaagataaaaagtatttttaacatattttctaccatattgctcaattatcatccttttatcatagtaacttatcaatgttacaaaacgtttttgtgggcattatagtttggaactcaattttgagaacattgtcttaaaaatcttatcaagatatgactttccaaatacaacatttgtattacaattagatgtataccttgttcttttttcacttttaaattaaaacatgtggctgctcacggattgaaaacaggtttacctatatatgtccttaccaattggtaagcattattcaaagtagatcataaaaaggagacaaaagccttgatattcccaattaaaaagatttaaactaaaaactccttctgctaactgtatactgttgaagcatttattgtataacccttaactgtcaagaactgccacatcttttgatatttgtgacagctattttaggagaataagggagatgcaatgttataataggtaagggatgaagatcagcttcctggtagattacaaagtagtgataattctgctttcatcctattgtgttttttttctgcactatagattgaattacatattattgctcaatgtgatgctgattaattaagatgtagggagctgtggaaaattatccatattttgtcataaacatgtttactgactgtacatcagaaaatcactaaataatgcatgaaattataaaaattacattaaaatattaaaattacctgtaaaacctaggtatttaaaccactgtagtttttcatatgatattgtcagatcaaatacacttgccactttcatttaagaaataattaccaatattagatgtaagttaaaataaacataaaataaaaagagttggacatttattcatatcaaataaatagactaatgtcttctatggatacctactcttttccatatttttagttgttcttccatttttaatttttatgactacatagtaggtgtacgtatttgtgcggtacatgagatattttgattcagtcatacaatgtgtaataatcacatcagggtaaatggggtgtcctcagttctttgtcacctgtggttttagctctgattaagaacttgtcttggaacctaagtcaaagtttgattttaaatttttcgttgaaattgacaggtcggctgaggaaatgaagatttctccagttctgtagtcaggtggtctgatcgttagactaattggatttacataaacccaagtattatattttacatatgcattgatttttatcacctctattttcaagctgttgtataaatgttgcagctttcaggccctacttccattggtaacaaatagaaactggtttgctgctattctgtcctggcatacaaataatctaagtcaaaagctttgcttttcatgtttttctaggatagtgagaggaaaaaaaaaatttctcctactcaaagcatttatttcatttctattttcataaaattaggaattctttttttttttttttcttttttgagacggagtttcactcttgttgcccaggctggagtgcaatggcacgatctcggctcactacaacctccgcctcccgggttcaagcaattctcctgccttagcctcctgagtagctgggcttacaggcgcccaccaccgcactcagctaatttcttgtatttttagtagagacggggtttcaccatgttggccaggctggtctagaacttctgacctcaggtgatcctcccgcctcggcctcccaaagtgctgggattacaggcatgagctaccatgcccagcccaaaattaggtattatttgttaatgacttacgggtttttaattagccacaagatacgaaagtctaaacaaaagtatgttttgttatagtcagtttaatgccctaaaaaaatgatgtttgcacaaatgattctaatgcacaaatgttattagtttctatacatttatattttctcagagtcttttctgattatttgctggaccctacatttataattccatttatgccgatttcagagtaaaatttctattggggtacaatttagtctttttcttctaggattgcaattttcattctgttggcctagggcttctcaaccttggcattattgacatttgaagctagataattcttccttgtggggtggtgtgagagctgtcttatgtactgcaggaagtttggcagcatctctggcctctaccaaatagatcttagtggcactctcttgcctaattgtgacaagcaaaaatgtctccagagtttgacaaatgttttctcgggttgcggtgggggccccaggaatttcaacaatagaaaaccattgctttagctcacccttacacatattcataagagaggattttgtattttatagaaagattttattaactccaaaaaggagtcagacttgaaaaccttcaaaaaccttcaaatgatgagcattctcagataaaatatttcagaaatgttgaaacaataaatgctatttgaataacacatactttagtggtcataggtgaaatagtattaggacatatatcaagtcctttgataaaaagatattttatgaagtaatagtgccttttaacaaattcataatatgttataatttatcgtaaatgtagaagttactttcttatctggtgtgactgaaggggaacacagtgctaaatgataaaacagagtagcctgaggtggttttcttctaatttcaggtcagatttacatttcactaattgcacaaaagtttttcaatattaattttgttttatatatacagaaaacatatttattattagcactagcaaaatcttatgtaatgaacccacttcataaatagaatatttatgttaatcaaatatgaatgttttgccaacctaatttcaaatcttaacataaaaaattggaatgagaaaattgatacatatgagtatattggtatatgtattataaatgattcaacctcagctagtaaaggaagttttattattttcaatagtaaaatcattatttttctaatttgatttcatagttatgtaagaattattagcaatgttaaaataataaactttgagcgaaactatttcctgattgttaatggataagaaaaagataaaaattgacatctagaattaggcaaaggaaaaactaatggaagattcaatatatgaatgagacacaaaagttgatagtggtgtgtgatagaactaattacaagcgttttttaagctaatgtttttagttatagatttatttatgaaaaattgttcttagctcttgaattttatagtgtttttaaatttttaatgtatttacttttttctttttaatttttgttagtacatcataggtgtatatattcatggggtacatgaaatactttgatacagacatgcaattgtcatgatcacatcgtggtaaatgggacatccattccctcaagcatttatcctttgtgttacacacaatccaatgatacttttagttattttaaaacatatgattaaattattattgactgtagccaccctgttgtgttagcaaacgctaggtcttattcattctttcttttttggtacccattaatcatccctacctcccctgcctaccaacaacccttgctagcctctggtaaccaccttctactctctgtcttcatgagttcaattgttgaaatttttagctcccacaaatatgtgagaacgtgtgaagtttctctttctgtgcctggcctacttcaattaacataatgatccatccatccatgttgttgcaaatgacaggatctcattctcttttctgaatagtactccattttgtatatgtaccagatttcctttacccattcatctgttgatgaacacttcagttgcttccaaatcttggctactgtgaatagtgctgcaaaaaagcctgggagtgcagatatcactttgatatacttatctcctttcttttgtgcgtatacccagcaatgggattgctggattgtaatggtagctcaattcttagttttttgaggaacctccaaactgttctccaagtgattgtactaatttacattcccacaaacactgtacaaggattcccttttctccacatcgttgccaacatttgttaccacccgtcttttagataaaagccagggggtgagataatatcttattgtagttttgatttgcatttctctgatgattaattatgtcaaacatcttttcatatgcctgtttgccatttgtatatcttatttcgagaaatgcctattcaaatcttttgcccattttttattacaatattagatttctttttctctagagtgatttgagctctccatatattcagattattaatcctttgtcagatgggtagtttgcaatattttctcccattctgtgggttgtctcttcactttgttgttgattgtgtcctttgctgtgcagaagctttgtaacttgatgtgatcccatttgcccatttttgctttggttgcctgtgcttgtgaggtattgctcaagaaatctttgcccagaccaatatcctggagattgtttccaatgttttcttgtatggtataatagcttgagatcttaaatttaagtatttactccgatttgatttgatttttctatatggtgagagataggggtttaatttcattcatctgcatgtggatatcaggtttttccagcaccatttattgaagagattgtattttccccaatgtatgtttttggcaacctcgtcaaacattatttcactgtagtagtgaggatttgtttctgggttatctgttctgttccattggtatatgtgtctgttcttatgccaataccatgctatttggttactatagctctgtagtataatttgaagtcaggtaatgtgattccttcagttttgttctttttgctcaggataactttgtctatactgggttttttgtgtggttctatacaaatctgaggattttttttctatttctgtgaagaatatcattggaatttttattgggattgcattgaacctgtagattgctttaggtagtatggacattttaacaattttgattcttctaatctatgaacatggaatattttttcccttttttggtgccctcttcaattgctttcatcagtgtttcatagttttcatgattgagattttttacttctttggataagttaattcctaggtatttaattttttgtgtggctattataaatggaaataatttttaaattctttgtcacattggtcactgttggcatatagaaatggtattgatttttgtatgttgattttggatcctgcatctttactgaaattgtttatcagttctaatagttttcttgtggagtctttagttttttccaaatataacatcatattatctgtaaacaatgataatttgaattcttcctttccaatttggataacctttatatctttctcttatctgatggctctagctaggactaccagtactatgttgaataatagtggtgacagggggcatccttgtcatgttccagatcttagagggaagaatttccatttttccacatttagtatgatactagctgtggatctttcatatgtgactttaattgtgtttagatatgttccttctatccccagttttttgagagtttttgtcatgaagggatgttgaattttataaaatgctttttcagcatcaattgaaatgatcatatggtttttatccttcattctattgatgatatctcacattgatttgcatatgttgaaccatccttgtttaccaggggtacatcccacttggttatgatgaatgatctttctaatgtattgttgaatttggtttgctagtatttttgttgaggatttttgcattaatagtcatcaaagatatttgcttgtagttttctctttttattatcatttttaagttccagggtacatgtgcaggatgtgcagttcattacataggtaaatgtgtgccgtggtgatttgctgcacctatcaacccatcatgtaggtattaaacacagcatgcattagctagttagctgatgctgtccttccctaactggcctcagtgtgtggtgttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattatgtatatgtaccaaattttctttatccagtctatcattgattggcatttgcgttgattccacatctttgctattgtgaatagtgctgcaatgaacatacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaacttatttcaacattaactcgaaagcccaagtccaaagtctcatgtgagataaggcaagccccttccacctatgagcctataaaatcaatagcaagttactttctagatacaatgggtgtacagggtaaatacacccattccagatgggagaaattggccaaaataaaggggctacaggccccataaaagtctgaaatccaatagggcagtcacatcttaaagttcaaaaatgatctcctttgacaccatgtctcatatccaggtcatgctgatgcaagaggtaggttcccatggtcttgggcagctccacccctgtggctttgcagggtacagcccctctcctggctgatttcataggctggcattgagtgtctgtggcttttccaggcacatggtgtaagttgtcaatggatctaccattctggggtctagatgacagtggccctcttctcacagttccactagatagtgcaccagtggggattctttgtggaggctcccaccccacatttcccttctgccatgcccttgcagaggttctccatgagtgctctgcccctgtagcacacttctgcctggacatccagttgtttccctacatcctctgaaatcttggtggaggttcccaaacctcagttcttgacttctgttcaccctcatgcccaacaccacgtataagccaccaaggcttggggcttccaccctctgaagcaacagcctgagctctacatcggacactttcagccatggctgggatgtaggtcatcaagtccccaaactgcacaaagcagcaaggccctggtcccagctcatgaaacaattatttttttctcctaggcctcccagcttgtgatggatgggagaggctgccatgaaatctgctgacatgtcctggagtcattttcccattgtcttctcgattgatatttggctccttgtttcctatgcaaacttttgcagtcagcttgaatttctcctcagaaaatggctttctcttttcaatcacattgtcagactgcaatttttccaaactttcatgctctgccttccttttaaacataaattccataagttccaaaccatattgtagtgaatacataacactgaatgcttttgacaataccgaagtcatttcttgaatgctttgctgcttagaaatttcttctgccggataccctaaatcatctctctcaaattcaaagttccacaaatctctagggcagggacaaaatgccaccagtctcttcactaaaacatagcaagagtcacctttgctccagttcccaacaagttcctcatctccatctgagaccacctcagcctggactttattgtccatttcactatcaacattttggtcaaagtcattcagcaagtctctaggaggttccaaactttcccacatcttcttgtttatttaggatccctctaaactgttacagtctctgcctgttactcagttgcaaagtcatttccaaattttggggtatctttacagcagcaccccactctaccagtaccagtttactgtatcagtccattctcacatggctagtacagacatacccgagactgggtaatttataaagaaaaagaggtttaatgaatccacagtttacaacaacagtgtaaaagcttttctatttctccacagcctggccggaatctgtattttgtggacattttaataatcgtcattctgactgtcctgagatagtatctcattgtgattttggtttacatttctctagtgatcagtgatattgagctttttttccatatgttttctggtcgcatgtatatcttcttttgagaattgtctgttcatgtcctttgcccactttttaatgtttttttttcttgtaaatttgtttaagttccttatagattctgtatatgagacctttatcatagggatagattgcaaaaattttctcacgttctgtaggttgtttgttcactctgatgattgtttcttttgttgtgcagaagctctttaattagatcccatttgtcaatttttccttttgttgcagttgcatttgacattttcatcatgatgcctttgcccttgcctatgtcctgaatggtattgcctagattttcttctagggtttttatagttttgggctttacatttaattcattcatctatcttgagttaattttggtaaaaggtgtaaggaaggggtccaatttcaattttctgcatatggctagccagttctcccagcaccatttattaaaaagggaaccctttccccattgcttgttttttttttttcaggtttgtcaaagatcagatggttgtaggtgtgcagtcttatttctgagttctctattctgttgcatttgtctatgtttctgtttttgtagcagtaccatgctattttggttactgtagccttgtagtatagtttgatgtccggtagtgtgatgcctccagctttgttgtttttgcttggaattgtcttaagtatatagtctcttttttgattctatatgaattttaaaatagtttttttgctaattatgtgaagaatgccaatggtagtttaatgggaataccatctataaattactttgggcagtgtggacattttgacaatattgactcttcctatccatgagcatggtaaggtatatttttccatttgtttgtgtcctctttgatttccttgagcagtcgtttgtagttcctcttgaagaggtccttcatttcccttgttagctgaattcctaggtatttgattctctttgtagcaattttgaattggagttcattcatgatttggctctctgcttatctgttgttggtgtttagggatgcttgtgatttttccacactgattttgtatcctgagactttgctaaagttgcttatcagcttaagaagcttttgggctgagacaatggggttttctagatttaggatcatctcatctgcaaagacaatttgacttcctctatttctatttgagtatattttatttctttctcttgcctgattgtcctggccagaacttccaatactatgttgaataggagtggtgagagagggcatccttgtcttgtgctggttttcaagggagatgcttccagcttttgcccattcaatatgatattggctatgggtttgtcataaatggctcttattattttgagatatgtttcttcaatagctagttcattgagagtttttaacttgaagtgttgttgaattttattgaaggccttttctgtgtctatttagataagcatgaggtttctgtctttagttctgcttatgtgatgaattatgtttatttatttgtgtatgttgaaccagccttgcatcttgaggataaagctgacttgatcgtggtggataagctttttgatttgctgctggattcagtttgccagtattttattcgggatttttgtattgatgttcattaaagatattggcctgaagtttcattatttatttttatttttttggttgcatctctgcgaggttttggtataagaatgatgctggcctcataaaatgaattagggaggagtccctccttttcagttgtttggaacaatttcagaagaaatggtatcagctcctctttgtacctctggtagaattcagctgtaaatccatctggtcctgtgctttgtttttttggtaagctatttattactccttcaatttcataactcattattggtctcttcggggattcgatttcttcctggttcagttttgggagggtgtatatttccaggaacttatcgatttcttctagattttctagtttatttgcatagaggtgtttatagtattctctggtggttgtttgtgtttctgtgggtaggtggtgatatcccgtttatcatttcagattgtgtctgccccagtgagatcagagttctgtccataaacccctgactggagttgctgatattcctgtagggaggccttgcccagtgaacagggatagatccaggtcccacccaaagaagcaatctggccacagtctgtcacagccactgtgctgcactgtggagaattcctcccagtcgaaaccttccagtctgtcaggccctggcagcagaaaatggctgtttggagccacagggatggctgccgcacctccccccaggaacttggtcatcttagtcagtctccagcctgctacctacctctgggtccaacccaaacggctgctgagattctgcacagttctgtgcttgggagccaaagtcctggtggcataggctcacaaaggaatctcctaatccctgagttgtgcagatgggttgaaaaagcatgatttcccgagcagagtagcacaataactccctcccttggctgagggtaggaacttcccttgccctgtgcaactagcagatgggccatcactccaccgtgcttttctctctgcatgggttgcatcaaccacctagtcagtcccaatgtgagaacctggataccttagttgatggtgcaggatgcactagctttttttgttcttcttggtgagagctgccaaccacacctgcatctaatcagctttctcggccccaccgccactcatcttggccccgccaacacccagttttctttttttgatgtgtcttagtctgatttttgtatctgggtaatgttggtctcatagaatgagtctggaaatattctctcctctattttttgcaatagtttcagtagaattggtattagttcttgtttgaatgtttggtagtattcagcagtaaagccatcgggtcccaggcttttctttactgagaggcttttttattacagctttgatctcactactagttattggcctgttcaggatttgaatttcttcctggtgaaatcttggttggttctatgtgtctaggaatttctctattttcttctaggttttccaatttattggcatatagttgctgatagtagccactaatgagcctttgcatttctgcagtgtcagttgtaaagtctcattttttcatttctgattttatttatttatatcctctctcttttttcttagttcatctggctaagagtttgtcaattttgtttaactattttaaaaagccgctttttgtttcttcaacaatcttttttcattttcttcatttcaatttcattttattctactctaatctttattatttatttccttctactaattttgggtttggcttgttcttgcttttctacttattaagatgaattgttagattctttatttgaaggttttcctcttttttgatgtaggcactaatagctataaacttccctcttggtactgcttttgctctaccccataggttttggtatgctgtgttttctttattatttgtttcaagaaacttttcaatttacctcttaatttctttattgacccactgatcattaagcagcatattatttaatttccgtgtatttgtatagtttccaaaattcctctctttattgatttctaggtttattctattgtgcttagagatgaggcttgatattatttcaattttttgaatgttttaagacttgctttgtgacttaacatatggtctattcttgacaatgatccatgtgctgaggaaaagaatgtgtattctgcagccgttggatgtaatgttctgtaaatatctattagatgcatgtggtgtatagtacagattaagtctgatgtttctttgttgattttctgttgggaagatctgtccagtgctaaaagtggggcattgaagtctctagctattattgtacttgggacaatctctttttagctctaataatattttctttatatatccaggagctccagtgttgggtgcatatatatttaaaattgttatatcctctgactgaattgaaacctttatcattatatactgactttctctcttcttaattgcttttgtcttgaaatttactctgtttgatataagtatagctacacctgctcttttttgttttccattggcatggaatatttttttctctttttcattttcagtctatgtgtgtcttcataagtgaaatgtgtttctcataagcaacagatcactggttctcagttttttcatccatttagccattctttgtcttttaattgaagatgttagttcatttacattgaataatattgataagtaaggacttactcctgccattttattatttgtttcctggttgttttgtggtcttctcttccttctttctgtccttcctgtcttcctctagtgaaggagattttctctggtgatatgttttagtctcttgcttgtcattttttgtgttttcattttatgttttttggtttgaggttattttgaggcttgcaaataccatcttataatgcagtattttaagctgataatagcttaacattgtttgcataaactgacaatcaaaaagaaaactaataaaaattctacaccttaacttgatccccaagatttttaactttttgttgccgtactatgtcttgaaaagcggttgtagttattacttttgattggttcattgtttattctttctacttaggataagagtagtttacacattacagttacagtgttataatattctatgtttttctgtgtacttgctgttaccagcgacttttgtacctccaggtgattacttattgctcattaatgtctttttctttgggtttgaagtactccctttagcatttcttgtagggcagatctcgtgttgatgaaatctctcagcttttgtctggggaaatgtttatttctccttcatgtttgaaggatattttcaccagatatactattttaaggtaaaagtttattttccttcagcactctaaatatgtcatgccactctcttctgatctgtaagatttacactgagaagcctgcttccagacgtattggagctccattgtgtgtgtgtgtgtgtgtgtgtgtgtgtgtgtattttccctctcttgctgtctttaggatcctttctatatcattgatctttaggagtttaattattaattacctgaagtagtctttgcattaaatcttcttggtgtaaaacttccttttactttgatattgatatatttttctaggtttggaaagttctctgttattattcttttgaaaaactttctacccctatctctttctctacctcctctttaaggccagtcactcttagatttgcccttttgaggctactaatatttcttagatcctgtgggcatgcttcgttgttttttattctttgttcttttgtctcctctgtgtattttcaaataccctgtcttcaagctcactaactttttcttttgctagattcattctgccattaaaagactctgacacattcttcagtatatctattgcattatttaacttcagaatttctgcttcattatttttagttatttcaatctctttgttaaatttctctgatagaattttgaattccttctccacattatcttgaatttctttgagtttcttcaacacagctattttgaactctgtttgaaaggttgcatatctctgtttatctaggctttgtcctgggtgacttatttagttcatttggtgcgatcacgttttcctggatggtgttagtgctaatagatgttcttcagtgtttaggcattgaagagttaggtatttattgtactcttcactgtctggaattatttatacccatcctttttgggaatgctttccaggtatttgaaagggctttggtattgtgatctaagctgtatgtgctttagggtacactccaagcccactaacactgtggttcttgcaaactcacagaggcaccacctcaatggtttggacaagatccaagggaattctctgtattaccaggcagagactgttgttctgttcccttatttttctcaagcagagtccctctctgttctgagccacctaaggttggggatatggtaacacaagcaccactgtggctttcaccactatgactgcacctggtcagacctaaagccagctcagcactgggtctcacccaagttcaagctcagcactgggtctcacccttgttcaaggacctgtggctctacagtcagccagtggcaaagccagctaggtctatgtctttcatttcagggtaacaaggtctctctgggaccaggtgggtacagaggtgccatctggaagtgagggactacagtcaaaaaccttagaagtctccctgctgttctattgtaccacgactgagttggcactcaaaccacaacatgcaatccttcccttgcttccctctactttccaaaggcagagaagcctcatcctgtagccactgccatcccaggccacagggagtcctgccaaactactgctgatattcccttaagacccaaaggctcttaagtcagcttgtggtgattgctgcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacctcctcactcttacctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagagttgtagtccttatggtctaggctgccttttaagtttacttagagacctagagcactttggcccttggtggcaaggtttgtgagaattcaaatttggaccactgggatcagtggttccccaccagatagggctggtttaaatgctccctctgtgggcgattgtcagctgcgtttggtctggtatttctttctgctctaacagaacagcactgagttcaatggctcacaattgctgtattcttcctcccccagtgcccagagaagctctctgtaccatgaggccactgcagcagttgggggaggagaagtggcttcggtgattcaactttttttttttcttttaatctcttcagtgcctcttttggggtatgaggttcaaactaagtactatgagtgctcacctgattttttcattcctatgaaggtgttttttctttgtagatagatgttaaatttgtgtccttgtggggaggatgatcaatggaagcttctattctgccatcttgctctgtctttcattatagtattttttttcttttagtattgtggcatatgaaaaaatatttctgaccaaccacccataatcatttttatctaaactgctatcagtcattaaaaatgtctgtgtttcattgagcaaaactgggaccagtgtctttaagcttgtcacttgctgggtctgtaaagaattggttaattggatattaatggaaattttagttattcgaatgacttacatggttgctgaatattgtgccataaaatactggttctgactttcaatacatcattttaattaattttggtgtaatttcatacatgttattaatctctggatggaggttagagattatattgtattgatgccctgattaaagtgtgttatattcactgcacttgaagaaaaaaatcactagtagtacaaaaatatcattgtttctcttaattcaacttgatcccaaacataacttaaatcactcctagcttcgttgctatggggcatagtatcttaactagaaatattaaatacttctagtaaatttgagtaggtaaagactccctaaatatataaacagtagttatgcttacagaaaattggtggcatttttcctatcaatgagttgttttaagatgagtcagagctaatgaagagtcagaaatcatctcagaagacatggtactttcttctaaaacagaaacagaaactattaggacaaatggcaatgaattctgcctccccctaaattaaagcaggaaagtatgagtcagaggtaaggcccttttaacatctccagatatatcccatggtgtcaggccaactggatagaccttataaatggacttacctgaagctttctttagcctctctgtgcatggcctcgtattttctgccctaaacttttctctttttacttcaattatcacttatcccggagacatatcacgactatcccatactccccattccttgactagtcttacctccaacaaagaagaatatgcactttagttaaaatccagatttataaaaaaagacacgtctatgattcccagtcctttgcctccactgggaaaaaattttttgatctgtttgaaatgttcaagggaaaaaagacccaagtttgctgcctctcccatgccatccttcagcttcacagccctgcctgtggaggtttgattctacttgggctacatcctacttctcaaaaaccaggtcactgagaaatctgggactttcattcatatatgtgtccaatgttttagtgaccaaaaataacaacaacaaaaaatctaccacaagattctgtcattcacccactatagcattaatgacttccaattattcaccaaggacttgattagaatgagccatctctgactagttactgccaatttgaaagtatttacattaaagagcaaaagatacgaactattcttacaatgcttacccatttccaaaagaatgtgatccacagacaaatttgtcatttaccaaacttctctcaccaaaatttgccaccatctttattatgacgtccatttaatcaatagtcagaggccatgagacacagaagaaatggccttctcatgtgatagagaaactgaaatcttcttttggagaaaaggagatttctggactttgatgatagtagatccaaaagaaactggttgaggtcttttatcaatttagaaggtagaaccaatcagagttagaagcacccaagaagtcctgagacttaaaagataaaacaccttcatatgatcttaaatttttagcactattttcccttcttgaagttgtattattactgacttcctttacctgaggttttctctgacatacaatgaaccagaagcaactttagttttattttcctgatattaataagcaatcagttaggtttacagcagtgtctattagtgaaagatcatattttcatttttgattactgatttttttaaagtttaacctaatcacaagttttcattaaaatttaccattagatcattaccctgcttctttaaaacaatagttcagataaagtacacctgcaacataaaaagcttttggacttttcttacaatgttcttaaaggacctttttacaagaaatttttaagaaaatcttctaagaaatgtaaaatactttataccagctattgaagaatagtaacggtgaattttgttttgagaacctgactcaatttatacatagaaataatagcactcaatatttattcatattcttaaatgagcaagttaaaattgtatttaattatatactcttaaaattttagatggtatttctttggtttcttttttcaataaacattacttttaggggtggtagttttgaagggagcagggaagaaatctttttatcagtagctcaatattctgggatcagaaaacacaatagtttttgttttgcttttgctctttttgggcagtaattacctgataagtttctcatactgagagctctgcagaatacagagttcttgccagcatcaaaaggacttccttttgagaagtaaccatatttcagtgaaaaaatccttgaactaaaaactaagagacttggctttcaaatcgggttctgtaataaaccagctgtgtgatcacgggcaagtcacctaaccttactgtgtcttagtgtccttttcataagaggagaagtaaggctagatgatatctgaagtcttttctagtactagtattcagtggttgaatatactatatttttgttatgaatgcagctcatctaacttaagcacaagagagcagctgctaaaaagagctgattagcaacaattaggagtggcatttcatttgtattgcatatcttcccaattaaaagcatttagtgattaaaattacatgcttgaaatacagtctttaaaaggaaatattttcaaataaatgaaatctctgggtcaaggccaatttgtattttaaacatttgcataatattaaagagttttgctgtagtataaggcatgcttagccattgcaggttttagaatctgaagcgagacagagatagagtcaaagagcgagatagagaatgcaagtgcacatgtgagcacaagcaaatgaaacaagtaaaaaagagaattctgaattattatgcatgctagtaaaaaatgattggttcctcctaggatgtttacagaattaatcagattatatcttgtgtttcatttctatacttcacattaagtcatatgtttaagattttcctttctctctgaaagccaaaagctgacttttcaaaatcaagggaagaatagactaaaaaaaatggacctgaaaaatagatgtgcttcactgttctcgtggatataacaaccctgatgtcttcaattaaatctcctttgttccagcttaaaacattgtgaatttaaattaacactttaagacatttcaatctgagtgcacattccaaataacgtaataaaatcatctgattgttctctcagatggagaaaccagagtagtgatagtgaacacaaggccagaaaaaatgaaatggtatttattatatattttcttataaaaacaaagttgggggaagtacacattaaaacagaacttagtacaaaaattctatcattttcaagaatcttcctgagtgcctactcttttgtcaaaagggaaaaacaaagactgttcttaattttgaaatctgacacaatagggaaaaaaaaatcaatgacagaaattcctattctttggactaacatttaaaaaaaagaaccacatgctatgaatagtactgttctacaaaataggttttgctaagtcctagtgggaaaaaaaatacatgtataatatcttaaaccttgtatgtggctttatcaaaattaacaatactattattaatattttaatgtaaacttatttcttcctaagagacatagtgttttcttacccaaagggagatggtgttttcttacccaaagggagatggtgttttcttacccaaagagagatggtgttttcttacccaaagggagatggtgttttcttacccaaagagagatggtgttttcttacacatcactctcctttccttagtatgactttaaagtagcgagggacttggtgacattagggttatcggcagatatgtgactaacggcttgggacattttattgtaatccgttttttattgtatttcccttgacaaggctacaaatgaattctgaaataaatgttctagaagtagtgcatagactctaaaaggtaccacagtattgaatatataagcaacagttgcttttccccctaatagttttagacagcctatagcaaaccaagaatttttagtggaatgaaagtgaatttatgataatacttattatatctgtattgagaatattcaatgtgtattaaagtatttccttagtgttttctaaaacagccattttattgtagtgttatccatttgaatctatgttcttgcattcctgtggcccaaagatgtatcagtaatactaagagaaaagtgaaaaaaaattaaatatcaggttagttattgataaatcaagcagtggtgaaagtcagaaataaattttgagtctttccaccagcattcctcgatctaaagagtaaatggcttttaatcagttttagaactagatctctttggaactatttttagtacttactggcactgtatgcattttctgggcaactgtaccagatttatagctctaaaagtgctgtgttatttattgccttccaataggcaatgaagtggtgtcttgcacatgcatgtgtcaaaaatgttaaagttttctccagttgtctcgttaattctttcccaggacaatagacaaaatatatggctctctatttggcaatgaatatcctttatcaattttttaaaagaaaaaaaaaacttctcttgcaaatttcacatccaacgtcaactttctcttttttgattttacaaatctccacaaagaattaaagtctcagaagggctttatcttgcttatttcagcagtttttgtcttgggtttgcaatcctaaagtttatttttgaatttaggaagaaatatcactcacaaatgaaggttattaggatgaggttattagaaagtccatgcatttttcatgacctcaacctgaattggcacttttgtatactagagatcaatgccatttcagatatcagaatccaaaaatcaacatatcatgtgtaaattattcttgcatgcagttcttatatattattttcttccctgatttttgttttctttgttgatcacacgtatccatgtttgacagatgtagggttttgcatcttttcaataatgcactggctacataccacacttagtatttgtcataatttattctgaaaatcaagttttacaactaggttgtaaaattttactagcaattgacactttggcttttattacatttttgaacagaaaagaagtagttgtttcaggaaataattttgaaattgttttctggacagttttattaaaataaaagacaaaaaaaaaaacccaagtcaacaattatagagtattcctgtgcctatacagactgagaattaacaacaaccaaattctgctcttcttttatcttttaaaataagagccactactttaattcatgcatttatttatctaacaaatgttttctgaatgtgttcacatatgccaggtgctatatctttagagattatacatttaaacaaagcttcatgccatattaccctacactcacattatttagtatatgaaggcgtacctagagatatacacatagagagtttgcccctatacacagaaataaataattttaagtggatttggaattcagggtagtgcaggtcaattcttccaaacttttaacttttttgtatataaggatgtgtcgatgctgaagatagggagatgatgaattaaggagccatatgttttatcttctttttcatttttctcactgtcctgctgtcatggtcaaacatatggcaaaaggcttcagttttttaattgctcatgtggatgtgagctcagttgaactaactacatttggggtaggactgatgttggattcatgtgttagttattctttattcctgaaggagattgaacagaaaacagtcttggaatcatcattcagtaataatagtaagctcatgttggtactatactttgacgtcaacttagatatctcaccaaaattttgttgaaaattatttatgtcttaacctgtgggcaactcctgttcaaatcccgtggacaatattaagtttaaatatgtttgctcagcaagtctttgtagaactctaaaaatctggaaaaatgggggttatgcatgcaatcacctggctaatcatagattctttttaaagaaaaacatgatgtcttaggatagtacagttcaatagaatttgtgcaataatgaaaatgttctacatctgcagtgtccaacgtagtagctactggccacatggagctgttgagaacttaaaatatgggtagtgcaagtaggaactgatgttttaaattaatctaattcatttaatttaaatctaaatttaaatgctcctttggggctaattaccatcatattgaacagagtagttgtgaaagacagaatagcaatggtgacattatccattaactaatatgtacatttcattatcaccttgagaattagaaaaatatatttttaagattattgccatttcacataaagtaattaaaagacagtgagtatgctgatcttggatttttcatctgacacaagcttgccttaatttgctttggaaagcaaaggccaactcaaaattcagacaaacacataaaagtaaaaactaaatatataaacaagaaatgcacaaacataaatacataaattttaaaattaaaacttacatattcgttttcccagatgtattgtattcataaattggataattggctccgaaacttaagaactttggaacattttccttgttctttttatattatattatctttgtttctgtttatgcaacctctaataataacttacaatttccccatatagctcttattaaaaatgtagtgattctcttaatgtaaatccgttagtgtcaataccatcattaaatccatagttattgatttttctttcaccttaactagaacttaccttttatcacattagtaaaatatgtttactcaccaccataaccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttagaatatcattacaaaaattaaattatcattaatcactaaatttgtttagatcaaattatagtagtatgttatggtatttacttacattcaatgttgtcatgaaattctattttttcttaaaatatgcagtatatcaaataatagattttgcttgctaattttcaaatataaatacgtataacatgaaaatgtttttcttactatataatcaaggaaaagccaggttgattattgctctatctgagtaaaataggaatagaatgctcacgtttattgtatgaattaaaaacaaaataactaatatactttggttagctcttgtgaaatgtttttttaaataacgttggaacaaactaatgattttaattaatatttctgaaatgccatcttaaattttgtaataaacatctaattcctccacaaagatatattatggcactgcatttgaataaaagtataagtgaatctcagcacccccccaaaatctgaaagtttgcagaaatatcttcaagtaattcataagaggaaaaaatgagatgcatttggatattgtttaagactatatataggcaattataagacaggtaaattttttaaagataatgtgattgaaatacatttataaactgatcatatattctagcagtctctgaaaacctggtattatttattaggttctaatttttaggatcttgttttagacagtggtatgacaaaactataacctcagatcttatcctgttcttttatgatacagcacataaatgagagatcaataaccaatccatgccacttgtccagaacatgtatgttaaaaatgtagtagagaattaaaaattatttagatgtacgtgtgtgtgtgtgtgtgtgtgtgtgtgtgtgtgtgtgtatctgttcataaatcacccatgaataggaatcttaaagtcctcctccgatcttttcttcataccctccagtacctttttatctcattcatctctgtcataatgctgcaagtaacactggacaggaatcctcctctctcatttctcctcggtgagctggcaagatcactacgtttgtgtgtagggatcatcttattgtagtacagggaggggattttttttttttttttttttttttttttttttttgagacgagtctcactctgtcgcccaggctggagtgcagtggcgccatctcggctcactgcaagctccgcctctggggttcatgccattctcctgcctcagcctcctgagcagctgggaccacaggcacccaccaccacgccaggctatttttttttttttttgtattttttaagtagagacggggtttccccgtgttagccaggatggtctcgatctcctgacctcgtgatccgcccgcctcggcctcccaaagtgctggaattacaggcgtgagccaccgctcccggccgaggggattgttttttaaatattcccatactgtgactttgtgggcatgaattgaaaataggtcctatccgaagctacctttttcaatttgagatcttgacctgtgaattttagttccttgtgcttgcatgttaaaaaaaaaaaaaaaaaaaagtaagaaaataacattgcattgttaatctctgagataatttcattttaactgtgtgttcctatgggaaatattgaaattctttgtattttatacaaatttatattttaaccagtttgtgtattttttttccatctgctaaaggttttagctgtatttattagatatgatacttatgatgttgtcttggaggaatatttttatttcggtgcttactttagtactgaaaaagcatcttaggcaactgaaatctacagtaaaaaatattttaattcatttggaataatcttggataattcgcttacagcttcatttatcttgcaaaaatttagtgacaattctttttaaaatatacttttttcttttgaaaacttaaatagttcgaaaaccaaacattgtgtgttctcactgatatatgggtgctaagttatgaggacgcaaaggcataagaatgatacgatggacattggggacttcggggaaagagaaggaaggtggcgagggataaaaaactacaaatatggtggagtgtatattgctccagtgatgggtgcaccaaaatctcacaaatcaccactaaagaatttactcatgtaaccaaataccacctgaaccccaataacttatggaaaaatgaaataaaaaattaattaattaaaaaaactgaaatagttcacataatttaaaaaaacttaaatagctcacataaataagttacatatattaccataaaatgctacaatctgaagcctcctgtccccagaacatcttctagtacagttctctaattttacaaatatcaagaaaagtaaagtaacttgtttgtaatcacgatatttgttataggcagagttgagacttagaactgaagtcttctggcacctatttctgaactgatcccattattttatgtggcttcaagaaactgaaaattgttctcattagataagctaacataagttaaattatattttattattcacattaatattaatatattaatttatattaacataagttaattctgtttcattgcatgttttccagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattcttaaaagataataacttttggaaaataaaatgtttgctttctctaataggcacaaagaaaactgtgggcatgttaagacccaagaaatctgtgcacaataacttaaaacccaatacatttatgaaagcaagagtttatccagtgccttttatcagtgttccatgaagaaatgaatacaaatttatccagaaactcttaaatgttgaatgatttaaatataattgttccctttaaaaatacaagcaatggaatttacccacatatttttctcgaagtcatgctacatgttgagtttattattttgtttgtgttaactcttaaaaaagtattaatcttagtttcagggaataaagtcttttgaacacctattcaggcttaacaaaatagtagcaatgtgaaaatcaaaactgattttctttcaccaaaagttcgagatattaaagaaggctactggattcaagatagcaatgcaaatagtttaccataactttggaaatgggtttaagaatggaggtcattcaagcataagcgcagttatataatacgataacattaacttttctctctgaatcacacagtgaacgtaaggtactaattcagatgtgggtgcatttttgttacagtaggtacacaattaaatgctgtttcaaaaggtaaactagaaccctagtgtctgtatagagagcttctgttagactttaaaagaatttacgctgcagttgttatttctacagtttagatgaatcccatattttacatagttagtggatctgggatgggcaacaaacgttaagagatgtcgaacatctccacagggtgtgtttttgtttatatttaaccattaaaaagggcactctcattttcaaattcttattgctattctgcttattggataagtttctcaacataaaagtatcttttatgactaacactacatgatttgggtataataacattttttcctgggtttaatttgtgactttctttaagaagtgtacaaagagtgggtttgtgaattacatatgtagatcatcatttttaatagatttaatgaagttaattaataaagcaagttctggtttcagtgctttttgaaggcacagagatattttatgagctagactgattttacttgagtttatgaacacatagcaaggagggcatggatgaagaacaaaaaactgaagtatttttcaaatatcctcacttttttgtttttttaaaaatattttgtaatcctaaaaagtcattaaaaataataaacctttttccatgacgcattttatatcatataactaagagacattttctgaatcataagaattagtcaaaatacaaaaaagtaaatgctaatgagaatcagttattggttgttattaggtttttattaactgaaaggactatcttagaatcattgaattagcagatgacttattatttcacagcttaaaaagtaaataaattatatattttattattggttcacagttgtttcatattcgttactaaatatcttcaagacatgaattggtgaacttaggcagactaatatgatactaaaaataatttgaatctttacattttgtgctacatttgcaatgttctttaccttttctatatgctcttcaatttgtgtttaatgttagggtgttcactgatgttgcagaatgctagcaaaataagtgagcactgaaaaagaaattatgtatttaaaaattcaaatgcagtaggtgtcttctttttaaagaaatatcatacaaaatgggagaagtgacagccaatacaatacaaattcattgttccttaaggaaatacttagagtggaataaaatattactgttagcagaaggcagaattattccaatttattttaaacagtgagaaatgcattttcaaaatgagggtttggggaatatttacatttagttcattactcgtctgaatagaaacaggaaagtggaaaataaaatgttctagtagactataagagacaagggaatt

SEQ ID NO: 691 - DNA, 55068 bp, Human
  misc_feature (1)...(55068): n = A,T,C or G
gttagactataggaagaacttccagcaaggcagggcagggcaggaattttgtgagagtcttttagttggagaagtctcagcctcagatgtccctggggtgggaggaggcacagcttacagagataccctctcctcctcccaccctggggggcccccatctccccctcaggcttgatggggccccaacccctcctcttcagggacacagagactctttgtctggggagtcagaggctgggagggaggcactgcttgcgtctccctcttcccctggggcggaggtgggggaagcagggttcggggagcagttcagggctcagaatacgcctcttggttcctcccctccctggggaaacaccctcacatcctgcgtgtctgcgcttgtccaattgcataaaagctctatttgacctcatgggggcctcttcatgctggaggtgggggtcccagcacggtgaggggggcctctgcctcatcccaagaatggcaagaatccaccccttcctccccagtggctgtgcgttgctttgcgacagggacagattcccaccacctcccaccaacgcgccggcctttttttttgagacagacagagtcttgctctgttgtccaggctggatcgcagtggcacaacctcagctcactgcaacctccacctcccgtgttcaagtgatcctcccacctcagcctcccaagtagctgggactacaggcgccagtcacaatgcctggctaatttttgtatttttagtagagatggggtttcgccatgttggccagctgatctctaactcctggactcaagcgatctgcccgccccagcctctcaaaatgctgggattacaggcatgagccaccgcacccagctcagactccctcatttggtggggatttgggattgaggccggggcatccactggagacctgagttggggcggggggagatgagggttagggatggagatgagaccctttatttgaggaatcaagaatttggggaaagtgaaaactgtgttttgggatctgtggtgagaatttgggaccaggacacgtgacttagggatttgagtggacagatgaaggtttggagtaaggctggggaccccattttgggatctggggtgagatttgaggtgggatgaggacccgttagggacttgaaggaaaggctttggggctgaggctggtacctcctattgtgcagctgagggactgaggataaagcaggtaggtgagtgagagttcagggtgaggttgggaccccagttgggggcctgagtgaggcagaaaggacttggtgccaggggcggtggctcatgcctgtaactccagcgctttgggagggcaaggccggaggatcgcttgagaccagaagttcaagaccggcctgggcagcatagcaagatcccggtctctacaaaatatacatattttaaaattagctgggtgtggcagtgtgtgcctgtggtacctgcttctcaggaggctgaggcaggtggatggcttgaacgcaggagttggaggctgcagtgagctatgattgcaccactgcactccagcttgggtgacagatcaagaccctgtctccaaaataaaatgtaaaaataatagaaaataaaaaagatttggtataaagctgcacctcctcctaattctagggcctggatggaggctgaagtcttgaatgaggttaaggtctcctttgaggggatctgctaggcggaaaaggtttggggtaagactggaaccctcgaactctagggctgggtgggagtgacccttctcctccacagtggggtggggcaggaacaacccagctcctggcgctgggctccaccccagccagccaatcagccctcagcacaaagtttcccaacttcccagtccagctgtcagcgctccccctccaaaaagccccgcctggccaggcgctggagcgcagggcgaggccagggcggggtctcgggcagtttcccgcggaccctgagaggagcggccgccgcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccggtgagccgggagggaagagatgggacccagggtccacgactcagagaggctctaaaagagcgaggggtggaggggggtggaggggcgtggaggggaagggcgtgggcgccgcgtgcggccccggtgtgatgtgggcgcatgagtatctgactctgggtgatttgtgggtgtgacagctcggggtgggggtggggatgtgtgagtgcgttttctggcgagcgcgtgggaatgcatgcaatgtgcaggtgtgtgcatgtgtgtatgtgtgtgtagcatgtgtgtgcatttggagtgaagttgcgtatgtgcttgcgtgtggaggttgatggtgatagtgtgactgtgagtgacagggcagtgctgggacggtgtgtattgcgacaggtgagtatgcacttgtgctcttgtctatgtgctgattttcgagggtaaccgtgtgagtggttatgcgtgtgattgtgtgtctctgagtgccgctatgaggggtgtagttatgatttttgggtgcaaataattgcccatgaggatgaaggtgggtggggacaagtattggggggtgctcttcgggaacccacagtttcctttgcgtctctttaaatggcttcacctcattctcccttttcctcctctgccccaaattggcgagcgcccatctcctcccctccctccctgttgccccctcccccaccccgcggtccccagagccgcgatcagcaccatggacagggcttcggggaggccgcggtgaggggcgagacggggcggggcgcagggcggggcaggagtggaagttgctccccccctccccaccccagctgctggagccttgggtgtttttcccgaggaatttctcaggagcccccaaggggtcccgggggccgccggatgggtgagtcagcgctgacgcacgcccagctgcgcgcatctggctgggcgccctgtcccgcccctcagggttcagagtggggggcgcttcgggagtcaggggatggcgtagcttctcaagtgttggagatggggcttccctgatctgagagaccctagactaggtcctcctggaaatccctttctaaggtgagctcagtctcccaacacacacacacacacacacacacacacacacacacacacacaccacagcacacttcttactttggagtccaggaaggtgcctgtccatatggttaatccctgattggactatgccgcattcccacgctcacacatccacatggtcatggaatcttaggcatccactctgaatataagtcccctgggactccaggaatgtgaaacaccgtgtccaggcaacccccttcagccacccgccaaatggtcccagcttttatgaccctcccacgtgctcaaattctcacacatgctgcccctgacatccgaacaaacactgtcaacattcacaacccatcacccactcacccactgggtcacactctcacacagaacggcactcccccatcagaagtccgaggtgttaaagtcacagacacacctgcaagctcacggcaagcgttgcatggccacacgtcaagcaagtgtatctaatccctccattagaagccaaatatttgcacacattgacacctggagaaacgacatatgcccagctattctctgcctgtctcactcagactcacccacgcttgtacaatctcatgcacatacacgtatttgcacacacatcgcacacctggggggttcccagccatgccctgactcagtccccgcctctgtccctccacatcccagaccccacccaacatccccgtgggggccctgaccagcacaggggagagtggcagggggcaggctgggcccctgacagacccccccaccccttgtcccctgtaggcaggactcaatgcagcttgtgtgcctttttgtcataatgccagctgtgaaaagaaagggcagtcagtttctgaaaggtcattccagaggggacacaagtttcaagcaggagagctttgagttggatgccgggaaggactttcttaatgtaaatgagtggtagttgagggaagaccctctttcctctgcagagaggttagggtgcgggtcaggggagagcctccaggctgggtgaggtcgtcggtctcaatcctgccctgggccccaggctgagatggggcagctgggatgattgttccgtggggaagtgactcttgtggtcagcagagcctgggagcccagatctcagccccaggggactgcaacccagatttctcttaatgacagcctagccacaaaacaggcaattagagatgggggctggggtgatgggttggggaaggcgggtggagagagagagagattgagaagagagagagagaatgagagaaagagagagagagagagaaagagacttggacacagatggaggcctggaaagacccggcacagaaagtgggacagagagagggcgggcagggatggggagagaaggagattggaggcaagaggaaacagaggctgaaacaggcctccgaggagtctggaaaatgagggttctgacctaggaagagtgggaatgggggtccttcatccaagcccgtgcctccccaacgtcttagcccccccgccccagctccccgtggtgagatcagcagagccgcccccaggggtgaggtcatggcagattctggagaatccagctcccgccaagaggctggggcagggggtcagtgggacagtttgctgagggttgggggatgggggaatcagacaggggctcggggcccaggggaagcccccacccgcccctgcccaagccatgtggttccacttagcactggctgggctgcctgctggggtggggctggtagcatggcctagattaggaactgttgggccagacaagtcctttccttagctgggatgaaagagggagagggtcagacaggggaggtctggaggttatcggagacagctggtcagaaggaggaagtcagagagatgaaatgaggaggtcatgggtcagatggaggagatcaggataggcagtgggagaaggtcagggggtagtcagagggaggaggtcagagggagttgatcagaagggaatgtcagagggaggaggtcagaggggaatgtcagagggaggaggtcagaggggaaagtcagaggagagatcagaggggaggctcagagggaggaggtcataggggagagtcagagggaggaggttagaggggaaagtcagaaggaagaggtcaaaggggaaagtcagagggaggaggtcagaggggaaagtcaggagaggagatcagaggagacattcagagggaggaggtcagagggcaaagtctgagagaggaagttcatagaggagggtcagagggaagaggttagaggtgaaagtcagagggaagaggtcaaaggggaaattcagaaggaggagtttgggatcagacagaaaaaggagatcagagggaataggctggggtcaggcagaagaagatcagaaggtcagagggggtaaccagaaaaagaagttagtgggcatggtcagaggcagatggtcagagggaggagatccaaaatggctgtagtcaaaaggaagaggttgtgggtgatggtggtcaaaggaggaggttagagagagggaggaggtgggggaagaaaacacactggaagcccctcctctccacgtgggtttcccctggcaagggggctccaggcctgggatatagccctagggagcctgcgcgggagagcagggagagggggaccgttccactctggggcttaggccaggaagttttgattcatcccagaactaggtcaactttttttctcaccaaaaaccaaggggaaaaaaaaaaacagagtcaacaagctgctgaggtcggaacatctgtggggtggtgaggaggcggggggtgctgggggcccaggccggctccttcttcctgagccacaaacatggtgggagggagggagaggctgagccccctaaaaaaaccctgagcctctatcctggagtcctgggcttattctagctgttccccacctctgcctgacacccccggcttctctctgctgcagatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccaggtgagttggagtaggaggcctgggtacctccccggagggaggcactgctgggccctctgagctgccttgttccctctgcccacccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtgagcatggggagagtgggcgggggtccgtggataaggggtggggtgagaagcacccgcactgaggccgtccccttgcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgaggtaggagttcagtgatgggggaaactgaggcagagggtgggatgttttgtctacagcctgaatctggagaggatattaaagaaggaagatgtcaagcttcaatctatccccaggaagctaagggaagcgagttcatgctttcgtgcaccgttgcagcgtgtgattgtgagattgcagagccacaagacaataatttttttttttttttgagatggagccttgctctgtcacccaggctggagtgcagtggcttgatctcagctcactgcaacctccacctcatgggttcaagcgattctcagcctcccaagtagctgagattacaggtgtgtgccaccacgcccagctaatttttgaatttttagtagagacaaggttttgacacgttggccaagctggtcctgaactcctggcctcaagtgatccacccgccttggcctcccaaagtgctgggattacaggtatgagccaccgcgcctggccaagaccataaattgtgacgatgcctacttggcttgttgtgggaagatccagttgtgccagtgcatgcttgtgtgtgtccgttgcagtgcatgactgtgagattgcagagccacaagaccataaattgtgacagcgcctacttggcttgttgtggaaagatctggtggtgtcgtgtgtctgagactgtgacctgagatggtgctggttgctgtgatagtgtgtgattgtgtgggggcggttatgactttgggagccagcaggcagctgtgttgtgtggttgtgtgatatgtgttctgggtgtggagacctttgttagctgtgtgtgaccgtgatgtgtgtcacctctgggaggccagggacctgatctatctcatgttcctccttatccccagtaccagctcttcccacaacaagccaagtaggcatcgtcacaatttatggtcttggccgggcgcggtggctcatacctgtaatcccagcactttgggaggccaaggcgggtggatcacttgaggccaggagttcgggaccagcctggccaacatggcaaaaccttgtctttactaaaaattcaaaaattaactgggcgtggtggcacacgcctgtaatctcagctacttgggaggctgagaatcacttgaaccggtgaaggaactgatgcacctctagtggggcagatgtgtgggatgtggcttgtggttgggatcgggtgtgcccctgataggatctttccttctcttagttacagggggtagagagatcactagggctgtgatggggtcatctcttccttatacttagcatgctctgggtgggggagcattgcaccctggtgccaggaggtgggcaggactgctgggggttagggggtcagagtaagcctatggctgtatggctgccctccttgactcctacacccccaacccccagggagacattcaggagctgctgataagcccagatcctcaggctgccttccaggcttgtgagcggtacctccccgactgtgacaacctggcaccggcagccacagtggtgagtgagggactccatgactcctaatctcaggacacaggctgggtccttcctggctccagatccctagaaagagtgaattctcatcccccagacatggggttaagtgacccgtgacctccaacacatcccaggcatgaatgactttgacctcaagtcatattcctgagccacccttgaccccaggttacatgaataacgttgactccaggtcacagggctgagtgaggacccacgggccatgagccagcctcaccccaggtgacctgaatgatggggtctctgctggtgggatgctctagacctgactggaacccttctcccaggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccaggtaagggccctgagacctctcacttccggttttgaccacctgacttccggtcttgactgtctgacttctggtcttggtgcttgacttctagtctcccatctctactaatctctggtccctcatctatgatctttttctctggtctcggatccatgagctctgacttctctcagctgactgatgactgtcagggtgactgataacaggctgggggtgggtcccatcttatgatctctcccatctctgaccccctcaatctccagtcctggggcactagagggaggggacagacccagataagttcctgattttaagggagttcttgatgagggctactgtttaaggggggatcattggctgggttgaatgacgtgttcattagttagtgtgtcattgtttggggttccctgcttggggtcactggggacagttattcattgggagagtcattaattgggggcattatttggcttccctgatagggattgctggatagtggggaatcattgagggagatattaattgaggtcagtgtttgggctgcacctagctggggatcacagtggaaggtcatggatagaaaccattattggtgttactgatgtccctagtttggggtcaatgactggggggttgttggtgggtggtcactgactggaagtcatagtggggtcactcattggggccacaagttggaagagtgattttcagggggtcgcagatggggtaattggtttgggagtccctgagggaattattagttaggaagtcattgatgggtggaattactatttgggggtcattggttaggacgcttttgttgcgctcatttatgggtattcactgttggagcatcactggttagaggaataattgattaggggtcaccgatgggggttattagttggagagtcactaattagtgctaatagccaagagatgtcactggttgaggtcactggttaggaaaatcactgaatggagcagtaacaggttgaggccattgatgggagtgggaggggttgtttgtgggtctctggttctagaatcactggggtctgttgatgtaggtcattcttggtgggtcactgggttggggggtccttggtgggggtcattgcttggggtctttggctggtgggggagtcactggttgcactacatctcagttccagatcttcttggccaagaatacaaacaccaggagtagtgggcccctcttcagccccttcctcagccttgtcccctcacctgggaccccaccaccctcttcccacacccccccaacccccaccttgacccagttcctctgcagctgtccaggccagaaggagccgccactccctctctgactgtggcctgctggccgctgaactctgccttgggagaggacatgtgggctaggcttccgggagcctggccctgaatgttggaccttgaccttgaccactgggcttcagggccagcctgactcagcacctcctccatccacggtggctccctctgctggcagccctggtccagctggcacacttttgtctccattggcctctggtgctctttggggagcctcctctgtccctgtccccggactgggagctcctggggacagtgggagggtgcctcccttttgtcttgattgccctcacccgagacccaaggctccctccatccctgctccagacctccactgacatccccaagacagagactccagctccaaatctgcctccgacccccacgcctttggtcgtcacctccactgtgactactggactcaatgccacgatcctagaggttggatggggatggaagaggggagaccccaagggttacgggggtggcagaaaataaggaggtcagggaaaactttggtctttcctaacgttctcaggggagcttggaccctgacagtggaaccgagctggggaccctggagaccaaggcagccagggaggatgaagaaggagatgattccaccatgggccctgacttccgggcagcagaatatccatctcggactcagttccagatctttcctgtgagtttctaggtggctggggttaggtgcaagagagtgggattcctattaaaatttttttaaaatttatttatttaggcagggcgcagtggctcccgcctgtaatccgaacactttgggagacctaggtgggcagatcatttgaggtcaggagattgagactagcctgaccaacgtggtgaaatcccatgtctactaaaaatacaaaaaattagctgggagcggtggcgcgcgcctgtgatcccagccactgggaaggctgaggcaggagaattgcttgaacccgggaggcagaggctgcaatgagccaagatcgtgccactgcactccagcctgggcaacaaagtgagactccatcttgaaaaaaaaaaccgaacaatttaaaaaaattatttaatttaattttttctttttttaaaaaaacttttatcttaagttcaggggtacaagtgcaggcttgttacataggtaagcttgtgtcatggggttttgttgtacagattatttatttcattactcaggtattaagcctagtacccattagttatttttcctgatcctctccctcctcccaccctccaccctccgataggtcccagtgtctgttgttcccctctatgtgtccatgtgttctcatttagctcccacttataagtgagaacatgtggtatatggtcttctgttcctgtgttattttatttacttacttttctcacatcttgaggtcttagaagggatttctacctggagccacgaaaggccagtctctcttttgacttctgcacctgcttgtgtcaggcactgtgctaatagttgactctgtgactagagagaggcgcttggcttttactccaagcaccaggagatgccacttgagcacttgtgaaggaacatgatctgacttggagctttaaaagctccccctgggccgggggcagtggctcacggctgtaatcccaatgctttgggcggctgaggcgggaggatcgcttgaggccaggagtttgaggccagcctgggcaacagtgagacccatctcttaaaaaaaaaaaaaaaaaaaaaaaaaaaaaagagctctctggctgctgaatggcacatggacagtagggggagccagaggggcagcagggaagcccgcaatctgcagtcgggacgtgacctggaggaagatgggagggacgcagagaagtggaccactttgggacatgctccattttggtcttggagaaagatggatacgcattcgatgtaaccgaacccaagctcggtggcttgatgtttgaaaggaaaacaagagagacgagaattggtggaaggaaaagcaggtttattccaagagacagcaaaccaagaagatggtggactgttgttccgaagcaccatcttaagtcagtacaaattttaggctttttttttatgttaagggcagggagaagagaagagggtagagatcaagaggtaactgaggccaggtatggtggctcacacctataatctcagcaatttggtaggttgaggcgggaagatcacctgagcccaagagtttgggacaagcctgggtaacatagcgagaccctatctttacaaaatatacaaaaaattaatcgaacgtggtggttcgtgcctctggtcccagctgaagcaggaggatcgcttgagcccaggaggtggaggcttcagggagccatgatcacaccactgcactgcagcccgggtggcagagcaagacctttctctagagaaaagaaaagaggcttgggccaggcgcggtggctcacgcctgtaatcccagcactttgggaggccgaggagggctgatcacgaggtcaggagattgagaccatcctggctaacatggtgaaacgctgtctgtactaaaaaatacaaaaaattagctgggcgtggtggcgggcgcctgtagtcccagcttctcgggaggctgaggcagaatggcgtgaacccgggaggcggagcttgcagcaagccgagaccacgccactgcacttcagcctgggcgcgagagggagactctgtctcaaaaaaaaaaaaaaaagaaaaaagaaaaaaagaaaagaaaaaaggccaggtgcagtggctcccagtttgagttcagcctgggcaacatagcaagaccctgtctctacaaaaaaataaaataaaaaatagctgggcatggtgctgtgtgcacctgtggtcccagctactcaggaggctgaggagggaggatcacctgagtctgaggagatcgaggttgcagtgagccatgattgtacccctgcattctagcctgggcaatagagtgaccctgtgtcaaaaaaaaaatgccaagcaaagcaagcaagcaagagaaggaaggaaggaaggaaggaaggaaggaaggaaggaaaaaagagagagaaaaaaggaaaagcctgcctgggcaatagagtgactctgaaaaaaaagaaaaaagaaagaagaaagaaaaagagaaagaaagagaaagaaaaagaaagagaaagaaagaaagaaagaaaagaaagaaaggaaggaaggaaggagccaagcatggtggctcacgcctgtaatcccagcactttgggaggatgaggcgggtggatcacctaagtcaggagttcgagaccagcctaaccaacatggtgaaacctggtctctactaaaaatacaaaaattagccaggcgtgttggcgggcacctgtagtcccagctactggggaggctgaggcaggagaatcgctagaacccaggaggtagaaggtgcagtgagctgagatcacaccactgcactccagcctgggggacagagcaagactccatttaaaaaaaaaaaaagaagaaagaaaaagaagaaggaaagaaagaaagggagaaaggaaaagcctaggtgttccacaggggaggcgcatagacacatagttgtaactaacttgcccttgctaccttgttacctggagtgcttgttgtgtgccaagcattgttttaattcattcatctttgcatgatatatacacaggcgtcattcatccactgactttacaggttgaccggttacctgtaagtggccataggggttgactaagtttcccaacttagttagatcactcagttagtaagaggcagatgcaggatcagtattgggcagcagtctctggatttcacgctcttcattcaccttggcatggcattgcccggtggatgcggggggctgagcttctcagtgcatattggttacagtagaggagaaggggctctgagggtggactccgtgtgtgtgtgtgtgtgtgtgtgtgcaagtgtgtgtgatcagataactgaagggcttatgtccaagttcacatctcttttctctccatctcccctgaccccaccccagggtgctggagagaaaggagcaaaaggagagcccgcagtgattgaaaaggtgaggggtctggattgtgagggggttgagaggcttcatgatgacagcggtcaccgacactcacttctcccttcaggggcagcagtttgagggacctccaggagccccaggaccccaagtaagtcatggctgtgtttccttcttccagtctttcccttccagctgaggggtgtttaatcccctggagtgaggagttggggtgtaatgttgcctggccaagtggagggtagtggacatttgaggcttaaagggtgagtcaaaatagggaggatgaacaatatagagactgggcaacatagcaagaccccatctctttaaaaatagccatatatttttttaaaaaatagtggcacccaactgtagtcccaactacttgggaggccaaggtgggaggattgcttgagcctaggagttggaggctgcagtgagctatgatcacgccactgcactccagcatgggtgacagagtgagaccgtctctaaaaaaagaagaggggtccgagagtagcgttgggggtgagtgggggtcagtattgcattaggggagttggagtggctctgtagtggggtagggaggtcagcctgaggttagagtcagtggtaggttgaaagtcagcctagctcaaactttgcacttcctgtgactcctgtttctctgtccccaacagggggtggttggcccctcaggccctcccggccccccaggattccctggcgaccctggtccaccggtaagagactcccactggggtgtacacttctcagaggagtgaggtttggggctgggagcgtgacagtctgaacatagatatgagggtgtggcactcgggaacaccatcccggggctggcactgacctcttctgttctctgtctcccatctgtgaactatttctctggttcaccttgtgttgctggggcctactctttgcttttcttcttttgcctgtctctgtttctgagtgtcttttatctctgtctttctcctgttgtgactctgtctctgtctctcttctgtctctctctgttggtctctgtccctctccctccgtccatctctctatgttcgcctctctctctatttctccatctctgtctgtctttcactggcttttctgtctctgtctatctctctctgtctctctgtttctgtctctgtatgtctctccatctgcccccatccttctccatccctctctccccttctctttgtctctgttccatctctgtcttttcctttccacttctctctacttctctctctttccttgccatgatccctctttgattctgtgtctctctccatctctccctctctctctctttctgactcatccttctgtgcctcccctgtcctcgctctctctctccctctctccctgtctccacctctcttcccccatccctctctcagggccctgctggcctcccaggaatccccggcattgatgggatccgaggcccaccgggcactgtgatcatgatgccggtaagaaggagatggagtggcccagccttggggagtggagtcctgatccaggagggggcctctcctgggggcttccctcaccactaaattcctcccagttccagtttgcaggcggctcctttaaaggccccccagtctcattccagcaggcccaggctcaggcagttctgcagcagactcaggtgagtgggaggtgtggacatagtgggaggaaccccagagagtgatagagcctcggcgtaaggaggggctgggcaggagaagggggttatttttctcctgaagatgcctctgtggggaatgttgggggtcttgtgggaggccccaagctctgactcctctgtctttccagctctctatgaaaggcccccctggtccagtggggctcactgggcgcccaggccctgtggtgagtaaggcgactgcgtggagggggcggtgcatgcattagtgaagaatcatctacccacactcctccatctctcctcccccaagggtctccccgggcatccaggtctgaaaggagaggagggagcagaagggccacaggtgagacttgtggagatagggcaggataggatgggaatagccttcccccaggaccacaagatacagtgctggatggggaaagtgccaaaggggctggggatacccttgcaattgatgactttcctagagaatggtggctcacatctggaatcccagaactttgggaggccgaggtgggaggattgcttgaggccaggagttcaagaccagtctgggcaacatagggaggccctgtctatacaataaataaatatgtccttccaagctgggtacagtggcacacacttgtctcagctacttgggaggctgaggagggagtattgcttgagcccaggtgtctggcctgggcaatacagcaagaccccatctctaattttttttaatacaatagaataagtccctctttcttcttattttcctttccttcctcctttttgctttcttctagggtccccgaggcctgcagggacctcatggaccccctggccgagtgggcaagatggtgagtgacagctaggtccccagaccaccccttatccatccctcaacacccaacatgagccttggctttgtgaccttggggtctgctggtgtcgttagtgggaaaagagtgctgaaggcagggaatggcagctccactgagtgtgtgtcaaaggaatccggccaggccgtagagtcaggaaggacttgcctgcaggagtgatgcttgccctgagatctgaaatagaaccagatgaacagatggggaagtggaagaaacagcacggcaaaaaagaggcctgtcacatggaaggaaatgacaaacaagtcaacttcagatagagtcatgcaccacataatgatgcttataagatgattggctgcgcgcagtggctcatgcctataataccagcacttagggaggccgaggcaggtggatcatttgaggtcaggagtttgagatcaacctggccaacatggggaaaccccgtctctactaaaaatacaaaaattagccgggcatggcagcgtgcgcctgtaatcccagctactcgggaggctgaggcatgagaatggcttgaatccaggaagcagaggttgcagtgagccagtgcacaccagcttgggtggcagagtgagattgtgtctcaaaaaataataataataataataaataaataagatgctggtcccatgagattataatactgtatttttactgtaccatttctatgtttggatgtgtttagacatacaaatacttactatagtgttacaattgcctgtgatattcagtacagtcgcacattgttcaggtttgtagtctgagagcactaggttataccgcatagcctgggtgtttggtaggttgtaccatccagagttgtgtaagtgcattctatcttgttcacacaatgacaaaattgcccactgatgcatttctcagaatgtatccctgttgttcagtgacatgtgaccatatatatatatatatatatatatatatatatatatatatatatatatgtaaaacatatatgtaactccagcctgggcaacagagcaagacgccatctcaaaaaaataaaataaaataaaatcagccatggcatagcaactggtatctctaatcccagcactttgggaggctgaggtgaaaggatggcttgagcccaggagtttgagaccagcttgtgcaacatggcaaaacccggtctctacacaaaatacaaataaaaaattagccaggtgtggtggtgtgcacttgtagtcccagctacttgggaggctgaggtgggaggattgcttgagccaggaattcgaagctgcattgagccatgatcatgccactgcactccagcctgggcaagagagcaagacctcagctctaaaatacataaataaattaaaaaaaataatatcttagccttggcatggtggctcatgcctgtaatcccagcagtttgggaggctgaggtgggtggatcgcttgcattcaggagtttgagactagcctgagcaacagggtgaaacccccaccatctctaccaaaaatataaaaaattagccaggcctggtggcatgcacctgtggtcccagctactcaggaggctgaggttgcagtgagctgagaacgtgccactgcactccaacctgagtgacagaaggagaccctgtcaaaaaaaaaatcttgatgttgatgatgaagttgggttcctaatttggtggaggggtacagggaaggctcatccttgactcttgggcttactttctccatagggccgccctggagcagatggagctcggggcctcccaggggacactggacctaaggtaggtgatgggggctgagataagacttggtgggagctgtcaggcttatggggtcaaggctcactggtgtctctggacagggtgatcgtggcttcgatggcctccctgggctgcctggtgagaagggccaaagggtgagtgtgtgaggtccctcccccaagtctaagccctcctcccaatattcaagcccccccaacttctccctcagtatcagagtcatgatccctgtgtccctcctcacaccccatctgccttcccagggggctggtctctccgcccacacccttccactctgaactcccctctgttccctctccagggtgactttggccatgtggggcaacccggtcccccaggagaggatggtgagagggtaagtttggaagagagttagggcctggtttggaaagtaagtttggaagcctgagtgagaatcagagaggaagatctggaggtctcagtggccagcttgagagctagggacaaattgtggggtgaggaggtgagacttgcaggtctaggattggagtcaggggcctgaatggaatcccatgaacttagtctgcaggttcccagggatcctggtctaattccgagaccccctggaaggggctgcccagatgaggggaggtggctctccgagggttgtaccttcctgttcccaagtaatgacgcttttccacagggagcagagggacctccagggcccactggccaggctggggagccggtgagtatcagggatccctgggccccttgcttggtgcaggggagggagtcaggactcccagggccccaggactcataggacccctagagctcacatggccacacagaggtgatgtggaaataattcgcctgctcccttgcagggtccacgaggactgcttggccccagaggctctcctggccccacgggtcgcccggtgagtgtcactggctctctgcatccctgtctgtctttttgtttgttttgagattagggtctcgctctgtcgcccaggctggagtgcggtggcgagatctcagctctctgcaacctccggctcctgggttcaggtgattctcatgcttcagcctcctgagtagctgggactacagggacccaccagcacacctggctaatttttgtatttttagtagagacagggtttcaccatgttagttaggttggtctcgaactcctggcctcaagtggtcctcccaaagtgctgggattacaggcctgagccactgttcctggcccctgtctgtcttttttttctcgcttttctgccttctgcatgtccatatctgttgctggcttctctgcctgctcacatttctttctttctttttttttttagacagagttttgctcttgttgcccaggctggagtgcaatggcacgatctctgctcactgcaaactccgccttccacgttcaagctattctcctgcctcagcctcctgagtagctgagattacatgcctggctaatttttgtgtttttagtaaagacggggtttcacaatgttggccaggctggtcttaaactcccgacctcaggtgatccacctgcctcagcctcccaaaatgctgggattacaagcatgagccacagtgcccggccctgctcacctttccacctgcatctctcggtgtctcagactcaggctcccagcttgttgctctgtcttggtctcacatcctcttttcccctagggtgtgactggaattgatggtgctcctggtgccaaaggcaatgtggtatgtgccctgtgccctttgacctctgacccttctgacactctgaccccgattgtccacatccctattcccttccatgactgaccccccccaagtcaatttcactaacgccccaacaccatgacccctcttagcttcactgaaaccccactttctccccagggtcctccaggagaaccaggccctccgggacagcagggaaaccatgggtcccaggtttgaactgtctttcccaataatggggcatgggagtggtcagttaagaccttagaccgtgaccaggcttcccaacctccacactcaccgcttctttcttatgccttctctcatcttctttttctgtctccagggactccccggtccccagggactcattggcactcctggggagaaggtgagtgacagctccacctaccgcgacctcctcaagtcttcttccttcaactctgttgccaggaaaatcttcccaccaagacccctctgttagctctggatagtgatagactgcaacattccctaagccagcccggagatacaaagtgtccttgttggggaaggattggttgcaagaaacagaaacccaccaaggctagctcacataagggatattgtcaggatacagagagcccacagaagcctgtcacagaagatattaccaagaggcacaggccctgtgggtctcatctttgttccctggcacatctgcttccgccttccctggcagacacacttctttctgcacatatctttttttggggggtgtggacagggtctcactctgtcgcccaggctggagtgcagtggctcaataatgcctcactgcagccttgacttccccaggcgaggtggttctcccacctcatccacccgagtagctgggactatcagcgcatgccactgtgcctggctaatttttcttttcttttcttattttctttttttgtagagatggggtctgcctgtgttgcccaggctggtcttgaactcctgggctcatgcagttcatctgccttggccccccaaaatgctgggattacaggcgagagccatcatgcccggctgggcatttttaaagaaaggggtgtggctgtgaagcttctatttcaacatgtctcttgcactgttttaatttaattttattggtcaggtgcggtggttcacacctgtaatcctagcactttgggaggctgagatggggggatcacgaggtcaggagatcgagaccatcctggctaacatggtgaaaccctgtctctactaaaaataccaaaaaattagccgggcgtggtggcgcgcgcctgtagtcccagctactcgggaggctgagtcaggagaatggcatgaacctgggaggcggagcttgcagtgagccgagatcttgccactgcactccagcctgggcgacagagcgagactccacctcaaaaaaaaaattaattttatttattatctttgtgggtacatagtaggtatatacttatggagtacatgagatgttttgatacaggcatgcgcataagaatcatgtcatgtagtatccatcccctcaagtatttattctttgtgttacaaacaatccagttatactattttagttttttttttttttttgacagaatttcactcttgttgtccaggctggagtgcaatggcatgatctcagctcactgcaacctccacctcccgggttcaagtgattctgccacctcagcctcccaggtagctgggattacaggtgcccaccactacgcccagctaatttttgtattttcagtagaaacggggtttcactatgttggccaggctggtcttgaactcctgacctcaggtgatccaccctcctcggccttctaaagtgctgggattacaggtatgagccaccacgcccggcctcttttagttatttttaaatgtacaagtaaattatcacacagaagtgtgtctgccagggtaaggcgggcacagtggctcacgcctgtaatctcagcactttgggaggccgaggtgggtggatcacttgaggtcaggagtttgagaccagcctggccagcatagtgaaactccatctctaataaaattacaaaaattagccgggtgctgtagtcccagctactggagaagctgaggcaggagaatcacttgaacctgggaagaggttgcagtgagctgagatcatgctactgcactccaacctgggcgacatataattgactatagttaccctgttgtgctatcaatcttgtactgtttttatgttcttccttgcaaccttcccagaggcagtggatttctgaggatcagagagggaaatgggcttgcctggggtcacacagcaagtttgggcagagctgggatagatttcctggccagtgaggtctgcttatttcttaaccttgaggcggctgcatgtctgcgtagatcctagtggtgctccagggctctgagcacctctgtctctcccctgctgttcatcttctttcagggtccccctggaaacccaggaattccaggcctcccaggatccgatggccctctggtgagaaccatgagctgggaaaaggaggaaggagaaaggggagccttgggaattggaatggcaagttttggtctctgacaactgagaatgtttcttccccagggtcacccaggacatgagggccccacgggagagaaaggggctcaggtgagtgaccaggaggttaggctgggttggggacgagggtcgggaggcagggcctgcagtcaggggccacagaggagagagatgagggctcttagaatgtggaagggactgtctagaatggcactgaccttattttcctcccagggtccaccagggtcggcaggccctccgggctatcctggacctcggggagtgaaggtaggtgatacgcttgcaggtatgagtgatttaccagctttgggttcaggcatgcgatgcagctccatcagaaacttctggatgtgtggagaggggaatcagttggccaggccaaatgtagtgggactggggtttggagctgcacagccaaggacagccttacagtgtggttgtcaccttgttgttagaacagctaagcccattagaggccaaacacatttctttcttttctcttttcctttttccttttcttttctttactttctttttttttttttttttttttttttgagacagagtctcgctttgtcgcccaggctggagtgcagtggagcgatctccactcactgcaacctctgcctcctcccggattcaagcgattctactgcctcagcttcctgagtagctgggactgcaggcatgcaccaccactcctgggtaatttttgtatttttattagagacagggtttcaccatgttggccaggctggtctcgaactcctgacctcaggtgatccaccctccttggcttcccaaagtgctgggattacaggcatgagccactgtgcctggcccgagggttgtgttctaacccaagctcagaatcacataagcacagtatgctgggttaagccaagagctgcaacctggctaaatagaggtgcaggggcattagagttcatatccatatggaagctgagtccagtgacattgtagccaaatacagatgtaatttacctgaacatgtgtgcattagacaagcttagacacactataatcaaggaattggctatactgtagcaggcacagagtctggcaagcatcaccctcagagttacattgtagccaagcataattacatttttaatctttttttgtttttgtttttgagacctggttctgctcttgttgcccaggctagagtgcaatgatgccacctgggctcaccgcaacctctgcctcccaggttcaagcgattctcccgcctcagcctctcgagtagtggtattacaggcatgtgccaccacgtctggctaatttttgtatttttaatagagacaggatttctccatgttggtcaggctggtcttgaacgcctgacctcaggtgatccggccgcctcggcctctcaaagtgctgggattacaggcatgagccaccacacccggccctaaatgttttattttttagagacagggtcttctctgttgcccaggctggaatatagcagcataatgatggctcactgcagccttgaactcccgtgctcaagtaatcccctcactttagcctcctgaatagctaggactataggcgtatcccaccaggcttggcagttttttcatttgattattattattattattcttgagacagggtctcactctgttacccacgctggagtgcagtaccaccatcacagttcactcactgcagcctagagctcccaggctcaatcaatcctcccacctcaccctcccaggtagctgggactataggtgcacgtcaccacatccggctaccttttttcttttttttttgtactttttgtatagatgaggttttcctgtgttgcccaggctggtctggaactcctgggctcaagcaatcctccagcctctgcctcccaaaatgttgggattacaggtgtaagccaccatgcccagcctttagaaacattaactgacccctatgttgtagttgagtctagttacattgtagccaacccctatgttgtagttgagtctagttacattgtagccaaagctagagaacaacttgtagccaagctcagttacattgtgatcaagtgaatttctctgtagctggagactaaccacatgggctgtattgtatccaagcgcaatttcattgtagcccgctgagctcagagatgttgtagccaagtgcagttttcagagtttggtgtgagcagcatccagacttgaactaagcgctctctccatagccaagcacagaggtcatcttgttgccaagcacagagtcgccttgtagctggcacaatggggaacattcctttgcctttaaaatgaggtccgggcctggaatgttcatcctctttctcctgccagaaggaactgtggacaaagcgtctccaggagatgggaatcgcttacttggaaatttggccttccctgcacacccccgcacagatgaccttgagaggcctccagtggggagggaggggcctctggggaaagatcatttcttctgaagctgcccctcccagcttctgcctagcctcctcttgggactatcctggctgctttagagcaggggactgagtctgggtcacttcttaagcagggaagaggcttgagagctttttttttttattttccagggcacttcaggcaaccggggcctccagggggagaaaggcgagaaggtgaggagagaaggaactcatcagaggagagggagtcccaatcatggggtcctggttgtgtcccttccccgaggccctcacttctggcctctgtctctcccacccagggagaggacggcttcccaggcttcaagggcgatgtggggctcaaaggtgatcaggtaagaccagctccagatgaggggtggtgtgggtctgggggctcggggaagatagggaggggatgagctggggctagacagagcaggaaggacaaaagatggatattaaatactctcctttttcttccaggggaaacccggagctccaggtccccggggagaggatggtcctgaggggccgaaggggcaggcggggcaggctggcgaggaggggcccccaggctcagctggggagaaggtaaatgactctccaccctctagcctcccacagtcaaggtgtccccaatcttttccctctgccctttgcccttttattataccttcgacctcaggaggttgctaccaaccttgtcatctttaattcctcagctcagcattacagagcaatttaatgcatgcaacttatgtgttcatatccataaccaccacatgcaataggcattttcatcccattttacagacaaggaaaactgagacttggaatggctgaatgacctgcccaaggacatgcccctagcaggcaggagcaaggacttgaaccttgtttccccaactcccatcccattagcccattcaccatgccccagccagcctgacctttccgcctctgacctccaggttgcaatttctgacctttgtcccataacctttctgcagggcaagcttggggtgccaggcctcccaggttatccaggacgccctggacctaaggtaggaagctgggggtggggggtggagatggatatgggcaggattcagagactaacatctgggggtccaggctgtggtcttgggggatgagctgcccaccccaagggtcactgagagaatgtaaaatgtgggctttggccaggcatagtggctcttggctataatcccagcaccctgagaggctgaggtgagaggattgcttgagcccaggagttcgagaccagactgggcaacgtggcaaaacgtggtccctatgaaaacatacaaaaattagccagatgtggctgggcgcagtggctcatggctgtaatcccaacactttgggcggcagacgcaggcggatcacttgaggtcaggagttagagaccagcctggccaacatggaggaaaccccatctctactaaaaatacaaaattagctgggtgtggtggtgcatacctgtgatcctagccactcgggaggctgaggcaggagaatcgcttgaacccaggaggcagaggttgtggtgagctgagattgcaccattgcactccagcctgggcaacaagaacgaaactccatctaaaaaaaaaaaaaaaattagccagatgtggccgggggcagtggctcacacctgtaatcccaacgctttgggaggcagaggcaggcggatcacttgaggtcaggagtttgagaccagcctggccaacatggtaaaaccctgtcactaccaaaaatacaaaaaaattagctgggcatagtagcatgcacctgtaatcccagctacccaagaggctgagacaggagaattgtttgaccccaggaggcagaggttgcagtgagccaagatctcaccactgaactccagcctggtgacaaagcaagattccatctcaaaaaaaaaaaaaaaaaaaaaaaattagccagatgtggtcccagctacttgggaggctgagatgggaggatcacctgagcccaaggagattgagcctgcagtgagctatgatcgagccactgcaccccagcgtgggtgacagagggggactctgtctcaaaaatttttttaaaaagtgagctttgacatcagacagacttggggtcaaatgccctcttacccgctatgtgatcttgggaaagtttcttgagcctgttttctctgcggtgaaacagacatcccagtaatttccacctcatcaatttgattataataatgttgataatgctgatgatgacaatgattataaaactgtaggatccttttatttggtgtgattaagtttcattcaccaacaaagtcagttaaaggggagaatcatagaatcataaaatacacatcttacatatcttgaattaattataacttatagtcaaatgtacttatgcaaaaacgtacttatatgaaaacataacatttgtttgccaatgttttgatgggtgaggacactgatgagattcatttttctgcctaaactattcccatattatatcactgatgagttctgtttctctagagtagagcaggaacctaaagacatttggggctgggcgcagtggctcatggctgtaatcccagcactttgggaggccgaggcgagtggatcacctgaggtcgagagttcaccaccagcctggccaacatggcagaaccccatctctactaaaaatacaagaattagctgggtgcagtggcgggtgcctgtaatcccaggtacatggaggctgaggcaggagaattgcttgagcccgggaagcagaggatgcagtgagctgagatcgtgccacttactccaccctgggcaacagagtgagactctgtctcaaaagaaaaaaaaaatagacatttgggaagataattgagtgcagaatcctcctagagtttcacatttttgcgctgttgagctgatagttatcttgcctacgttggatttgacagtggttttttttttttattttttcagtgatttccctttacattgactccttttcctttaacttagattttttttttctttttaacgattgagaaaaaaactttgaagcttagttttgatggacaactttattctccttccttccttcctcctttcttccttccttcctttcttccctccctccctcactgcgtccccctcttttttcttttcttttccttcttttttctctttctttccttctttctttcttcttttttctttctttctttctgtctgtctttctttctctctctctcttctttctttctttctctctctctctctttctttctttctttctttctttctttctttctttctttctttctttctttctttctttctttctttctttcttctttctttttgcttgcttgcttgctttcctttcagacagggtgtcactctgtcattcaggctggagtgcaatagtgcgatcatagcttattacagcccccaattcttggactcaagcagtcctcctgcctcagcctcctgagtagctgggaacgacaggtgcgcaccacctgatgaattttttaattttttacagagacagggtctcgctatgctgcccaggctgatctcaaactcccagcttcaagtgattctcctaccttggcctcccaaagtgctgggattacaagcataagccactgtacctgacatagactaagattttagaaagtccttgtgtgcatgtgttcaggatccttgaagagtgttggggccaggttggtggctcacacctgtaatctcagcactttcagaggctgaggtaggagaatcactagaggccgggagttcaagaccagcctgggcaacatagtgagaccccatatctactaaaaatttatttcaaaaattagctggacatggtggcgtgaacctgtagtcccagctattcaggaggttgaggtaggaggatcacttgagcccaaaaggttgaagctgcagtgagctatgattgcaccactgcactccagcctgggtgacaaagtgagactctgtctcttaaaaataaaacaaacaaaaaaagagtatagagaccatggaacccccagatgggaagggagagtagagggagcctgaaatgggctttgaggcgggatgccaccacagactgtgtaacttgggcaactgtcttttctgatctgaactcagtctgcacagtgaggtgtgggagaggatatcagagcctgtgatgtcttcccccaggtggaggaagggttcctccagcatggactggagtcagttaacaaatattaaaaagcactcaccgtgtgccaggcagtggggaataagaccaatgagctatgtcacagtgggggaaaacaggcattgaataaataagtcaataagggtcatttcaacgcaagtgttcttgggaaaacaaaatagcataatgtgacagacagagggtgacttgggcaatgtggaagccaggatggtggtagaaaggcattctaaggaggtgacatctgaatgagatctaaatggtcaggagtggctgactttgtggaggcctaggagacaagcatttcagccaaagacagcagccagtgcaaagggctgcagtgaaatgagaagggaggagaggaggggagaggagagaagagggctgccttgtaggaggctggggctgtagagaccaaggaagcttctggaatcagtgacctggaaatgcctcaaaggatggtatgaggggccaattccacccaccactcactcctcaccctcatgtcttctttctaattctctccactcagggatctattggatttcccggtcccctgggacccataggagagaaagggaagtcggtgagtcatgaccgggggtaagggagaggggagaacttgtctgaggggaacagcatgtgtggttgtgtctgatgatgggtggaccctgggtgtttgtgtctatgcctggaacatttgtgtgcacacatgctattatatgcaatgcatgacacatgtaggtgattacacatggtattatcatgaatatgactgtaagcacatgtatatgtgtttcatgtatctttcaatatcgatgagacagggtttgaatgccgcagcctgcaggcctgtgcctgggtgaacaagggcatgaatctgcgtgcactttgcatgatggtgggcataaatgtgtgcaagaagcttgtacatatgcgtgaaaggacatgtgtatacacatgtgtgtgtttctgtgcacactgagtgatgggtatacatgcatgtattgtatttgtgttgctatgtgtgtattgtaacagtgttaatgaacattgtatgtacgtacatgagtgtatgtatactgctgtgcttaccaagacaaagtcctcagctgaatccaggccttcatgtgtttacagtgggtatacatgtgtgcaagagatgtattgcatgatgagttctgtgtcatcttcaggctgtggattgccaaatgcatgccatgattacatgcaatcatgtatgcatactgcacagctgtgatcaatatatgtcttgtgggcaaacatgcttgcacgtttgtactctgtagatgcaatcatagttgtaattgtgtgtttgagatctttgtgtggttttgagtataagttgtatttgtgtgtatgtgtatgactgaaaagcttgtgaataaatatgtggcagacagctttctgggtctgtgactgggtgtctttttgtgtttgcgtcatacctttgcaccctaactctcttctgctttctctcttacaattcattttcagggaaagacagggcagccaggcctggaaggagagcggggaccaccagtaagaaaatagacagtgccccctaccctgctgggacttggggacagggctgggaaggaaaggtagtggagaggtcatctgtgggcagggaaagggtttgggttatatcaatgtccctggtcgggcaggagagggagtcacaaggggaggggacctggaagacttggtctcatctcccaggctcccccaccccctcatatctgatctttgccttttttttttgttcagggttcccgtggagagagggggcaaccgggtgccacagggcaaccaggccccaaggtatgggatgggtgggcaatcaaggccccccatgccccaggctcagccagtccctccaaattcttcccagttgagtttgttctggggcctgagtctcattcactctgtcctagggcgatgtgggccaggatggagcccctgggatccctggagaaaaggtgagtgtgtgtgtgtgtgtgtgtgtgtgaatgtgtgtgtgtgtgagagagagagagagattctgagtggaggacaaacccaagagatgaagagacattataatgcagtggtaagagcacagcttaattgggtgtggtggtgcacgcctgtagtcccacctatgctggaagctgagatgagagaattgcttgagcccaggagttggaagctgaagtgagctaatcacaccactgcactccagcttgggtgacagagcaagactccatctttaagaaaagaaaaaaagaaggagcacagcctgtgaagtcagagagccatgagttcaagtcctggctctgccactcacctactgtgtgaccttgggcaagtcacttaaccactctgtgccttagttttctcctctgtaaaatgggagtaacctcagtctccaacccaaagggctacagtggtgaataaaatgactgacttgtggagaatgccctgcccatgcctggcatgcagtaagcactcaatatgtgctcgatcctgttgtcattatgtggggctcagggagtgggcagggaggcaggggggatgagatcatgatttctgtttccatttcagggcctccctggtctgcaaggccctccaggattccctgggccaaagggcccccctgtgagtgaggtcaccctcattgggggttgggtgggtggaggatgtgggaagggaggaagccctgtatctgtgccccaactttttcccacctcatcccccagggtcaccaaggtaaagatgggcgaccagggcaccctggacagagaggagaactggtgagtaacccctcaacctttgattcctgatccttttttttttttttctttttgagacagagtctcactctgtcacctgggctagagtgcagtggggcaatctcggctcactgcaacctttgcctcccaggttcaagcaattctcctgcctcagcctcccgagtggcactacaggcgcgtgccaccacgcccggctaatttttgtatttttagtagagacggggcttcatcatgttgaccaggctgctctcaaactcctggcttcaagtgacccacctgcctctgcctcccaaagtgctgggattacaggcgtgagccaccggaccggccagattcctgatcctatcaggccttccctgtctcctgctcctccatcccttccccatgtaacaccgcccccacatttaatttttctctctagggcttccaaggtcagacaggcccgcctggaccagctggtgtcttaggccctcaggtcagagtggactccataaacctcccttgttttgtaccagttgggggatatttaggggaaagctggactcctgagcgactcccctaggccacccccactcaacaggagccttcttcctcaccagggaaagacaggagaagtgggacctctaggtgaaagggggcctccaggcccccctggacctcctggtgaacaaggtcttcctggcctggaaggcagagagggggccaaggtgagacactgtccactggagatcttggttgaacatccaagatcaaccaaggactcagaatcagtctcatgggggagggggccctgagtcacagattggagggagacatcccctccctggagcttgacttccctcctttgcactcctgtagggggaactgggaccaccaggaccccttgggaaagaagggccagctggactcaggggctttcccggccccaaagggggccctggggacccggtgagtatctttggagaccctcctgcatgtcccttagagaaggaaaggatgggggggtcaggggagggatggggaatagcatttggggtgcgggaaatgatgaaagcaaaaaaaatggtggagggaactggggaaggcagacccctcaaagctcagtgtccagtcccaggagagaggtggggactgtgagctccccacagaggaagacaggacctggggacacctttgggagtctcttaactgtgaattatctcctccttcagggacctactggcttaaagggtgataagggccccccagggcctgtgggggccaatgtaagtataaccccatgtgctgggtgggggcagggtggaggggactcaaggtgtcttggaagcttgacattgtcatgataaaacccatgatggaggctgaggcaggcagatcacttgaggtcaggagttcaagatcagcctggccaacatggtggaaccccgtctctactaaaaatacaaaaattagccaggcatggaggcagatgcctgtaatcccagctactctagaggctgaggcaggagaatcgcttgaacctgggaggtggaggttgcaatgagccaaggtcagttctgttgctcactggctgggccgttgtattccttggcaagcctcagtttccttgtctgtaaaatagccatgatgggaagccttatctcatgtatgatcacaaacctcattgagatcatttatccagtaaatacttacctgtgcattggccatcaacatataaaaaccccttttcttgggccaggtgtagttgctcatgcctataatcccagctctttgggaggctgaggctggagaatcgcttgagcccaggagtttgagaccagcctgggcaacatagccaggtcctgtctctacaaatatatatatatatatatatatatatatatatatatatgtataggctgccaggaggactatggcttttgttctaagtgagatgggagccatggagtgttcttgagcaggagaagaatatgccctgcccctcaggtgctcacaggcaccctctggctgctgcaggaggggaacaggttagatacaatcctggtaacctcagaactcagtgcctggtggcttaaaaaccctccataaaggacagctactactggtattatacctgattcatcacccctgttctcagggctcccctggtgagcgcggtcctttgggcccagcaggaggcattggacttcctggccaaagtggcagcgaaggccccgttggccctgcaggcaagaaggggtcccgggtaagtgacttgcccatcccattcctagggcctcctcagggtctggccctgccacatcccaggacatggctcctgcaggacattcctgccctgacatccccctttccattccccacaacagggagaacgtggcccccctggccccactggcaaagatgggatcccagggcccctggggcctctgggaccccctggagctgctgggccttctggcgaggaaggggacaaggtgaggggttcacagagaggaagggtccaggggaggatgggggtgaatggaagctgggtccttcatcccatttcctctgcagggggatgtgggtgcccccggacacaaggggagtaaaggcgataaaggagacgcggtgagtgaaggtccccagtggggcagggtggggtgggtagcggaagaaagaggaggccagggatgtagagatcattctccatggggtaggagaggccatggagttttctgccttctcgggtaccatcttgacaattacatgcaacagaaggtacttgagctgcctggagcgatgggtccacagaacccaactgcagacaggatagggacagctggggctcccaaagaactggaaaggcactggggtgcgggtaaccttctccattgttagtgacacatccttccctctgcctgtgactctgcgtggcaggcactgaagcatctgatacccaacttccccccaccccgaatgtcagctccagtggcttgcatcattgagccagcttcgtccctgggtcttggtggaacttgtggccagggctgggcttaggacagacgtctgtctgatcccatctgttggtggctgagaagacaggatttggggggatgtagctgttgctgcctggtaggggaagttgttctcataaagggggtgtgggaggcagtgattgatagctccagtgccctctctaatcttaaacctgagggaatttttgattctgtttcctgttctcccagggcccacctggacaaccagggatacggggtcctgcaggacacccaggtcccccggtgagtgcccccatcttttcagtccttctctgggtccttgaagggagggatagtgggagcaaacgacagtggaagcacactgacttaatccaaacctcaaacccaaccctgatcttccctcagtactgacacccaatgtgaactcaatccaagaatcggagtcaatcccaacccaaccatgttgtcccctcaataccgacactcaatatgaactcaccctcagaatctgattcaatcccaacccaaccatgtcttcccctcagtacaaacacccagtatgaacccaatcccaaattcggagtcaaccccaacccaatcatgtcttcttctcaataccaacatccaatgtgaactcaaccccagaatttggcccaatctcaacccaactatgtcttcccctcaatgccaacacccaatgtgaactcaaccccagaatttggctcaatcccagtcgaaccatgtcttcccctcaatgctgacacccaatgtgaactcaaccccagaatctgattcaatcccaacccaaccatgtcttcccctcaataccgacacccaatatgaactcacccccagaatctgattcaatcccgacccaaccgtgtcttcccctcaatgccaacacccaatgggaactcaaccccagaatctggcccaatcccaacccaaccatgtatttccctcaataccgacacccaatatgaactcaaccctagaatttgtctcaatcccaatccaaccatgtcttcccctcaatgctgacacccaatgtgaactcaaccccagaatctgattcaatcccaacccaaccatgtgttccccctcaataccagcacccaatgtgaactcaactccagaatcctgcccagtcccaacccaaccatgtctttccctcaataccaaaatccaatatgaactcacccccagaatttggctcaatctcaactccaaccatgtcttcccctcaatgccaacatccaatatggactcaaccccagaatctggttcaatctcaacctcatgctcaactttgatctgcccctctatatcgatgtccaatatacactcaaccttaaaatcagactaaattccaacctaaacccagctctgaacccccacttcagccccagtctcaactctactcatgaccttaacctcagttctactcaaaccttatctccagccaggtgcggtggctcatgcctgtaatcctagtactttgggaggccaaggcgggtggatcacctgaggtcaggagttcaatatcagcctggccaaaatggtgaaaccccatctctactaaaaatacaaaaaaaaaatttgctgggcatggtggcgggcccctgtaatcccagctacttgggaggctgtgccaggagaattgcttgaacccaggaggcagaggttgcagtgagccaagatagcaccactgcactccagcctgtgcgatagagggagactccgtctcaaaagagggaaaagaaaaaaaaaaaaaaaagccaggcacagtggcacacacttgtaatcccagctattcaggagactgaagcaggagaattgcttgaaccagggaggcagaggttgcagtgagcagagattacgccactgcactccagcctgggtgacagagtgagactccttctcaaaacaaaacaaaaaacaaaaacaaacaaacaaaaacaaacaaacaaacaaaagccttatcttcaaatctcttaaccaagccctgacccagacctgtccttttttgtttattaccatacaataggaacatacggccctatccttaaccccaactctgacccactcttccaatgctgaccccagacctgaactcaatctttgaatatgaccctgggcccaacctcaaacccaaccctaaattccatctcaaccccagttgaaccctgcccaagaactgaacctcaactgcaaatccgactcactgtttaacactttgactcaacccttgacttcattcccaagccctgttccttaacctagaccccaactccaactcaacactgaccctctctaaacttaatctgaaccctgactccaacccttaacctcagtcttgacccttgagcctcactctgccctaatcactgacccagaccttaaatgtgcccctgtttgtgttcttccagggagcagacggggctcaggggcgccggggacccccaggcctctttgggcagaaaggagatgacggagtcagaggctttgtgggggtgattggccctcctggactgcaggtgggtgtctgggtttgggggtggcacttctgattctccctacctggtgccccaatcttgcttctttgttccacaggggctgccaggccctccgggagagaaaggggaggtcggagacgtcgggtccatggtatgcactcccagaggaaggtgggagggggaggatggtggggttataggttggcggcaggcattagattcatttgagggacattgtcattttaagggccctgagggtcaccagcattgacagtggtatctgtggtcaatgtggccttttggggagaggggcctggggtcactgggtactaattctgaccttccacagggtccccatggagctccaggtcctcggggtccccaaggccccactggatcagaggtgagaactcttggggggccaggaaggctcagagatggggacaaccatttcctaagaagaggatgttgggattccacagtcccactcttaccccttgctgtctctccagggcactccagggctgcctggaggagttggtcagccaggcgccgtgggtgagaaggtgagtgagggaaggcaggggctgcacggggggaagagataaatctagtcctattgggcagggacattctggggagcccctccctgtctgctaggatgggacctctccccactctcactttgcctcctgcagggtgagcgaggggacgctggagacccagggcctccaggagccccaggcatcccggtgagtgactgtgtgatgtggtccctgcacccaactcagggaacccctgacccctgggcatcttgggccactttgacctctggacagtgcaagatcatccactcacccctgtcctgtggccgtccctgattaccttgaggaaggacacctggaagttctcagatagggctgctatgtacagttctgcaggttgcacactacacaagactacatgacccaggggataggtgagggctcaaatctgagtcatgagtcctgacttgaggatgagttgcccagatggggcccctcttctaattcactcaagggcagcacatgggctaggccaaccttgcacatgaccaatgggcacctagaccatccagacctttcactgtcttaagtcctagctccttctgacctttgacccttggacaacctaggctactctgaaccctgaccccagaaaagtcccagaccaccccaatgcctgaatccaagtatgctaatccttgatccctggagagtccaggccactctgacctctgacctctttctgtaaaggggcccaagggagacattggtgaaaagggggactcaggcccatctggagctgctggacccccaggcaagaaaggtccccctggagaggatggagccaaagggagcgtggtgagtcctggggggaagtgggggcagacatgggagggggcacttgaatgtacttgaagctctcccaaactttttttttttttgagatggagtcttgctctgtcaccaggctggagtgcagtggcacgatctcagctcactgcaacctccgtcttccgggttcaagcgattcttctgcctcagcctcccaagtagccaggactacaggcacgcgccaccacacccagctaatttttgtatttttagtagagatgggtgttcactatgttggccaggatggtctcgatctcctgacctcgtgatcagcatgcctcagcctcccaaagtgctgggattacaggcatgagccaccgcgctcggccaaaactctcccagacttctagccagggattgcatcctctaatttactgatctcatgagtaacccccagaacacggatgaatgaatgaatgggtggatggatggattaatgaatgagtggatgaatgtatgaatgagtgaattaatgaatggacaagtgaataactcagtggatggatgaatacgtgaatgaataaatggatgaataaatgagtgaatggatgaacgagtgagtgaatggatgaacgagtgaatgaatggatgaacgagggaatgaatgggtgaatgagtgaattaatggaaaaatgaataaatcagtggatatatgaatatgtgaatgaataaatgtgcacgaataaatgagtgaatgaatggatgaatgagtaaattaatggatgaataagtaaattaatggatgcatgaatatgaatgaatggatgaatgaatgagtggccgaatggacaaatgagtgagtgaatgagtgaatggatgcatgaatgaatggacagaggcgcaagtgaacaaaatgactgaagagatgagtgaataaacgaatggatggatggatgagtgaattagtgagtaaatgtgtgaatgaaacataaacgtgcagtggttatacatcattgaatggcaagaaagttgatttcatggcagatcattctaacacttgaattagtgagtaaatgtgtgaatgaaacataaacgtgcagtggttatacatcattgaatggcaagaaagttgatttcacggcagatcattctaacactgttgcaaagattaaggttgaattgggtcagatttggggtggatgtgggatttggctttgaggtgaaggttgaggcccttctgtcaccacagtagaggttggggcgggtggaggtcaggaaggggctttagcatctgtgggacctcgacttgaatggcattgtttggcgtgtcccttctctgagtgtatgaatgaatggatggatggatgaatgaatgaatgaatgagtgaatgaatgaatagacgaatcaatgaatgaatagacaaatgaatggccagttttctctgtgagtcccgagctgagaggctgtgaggacgctgcagtgagaccatgcgtgcggcattcttagctcagcgtctgcacccatgaaacacgagaatgttcgctctaccaagccagggattttatgttttgttcactaatgtgtccccagaaaccaaactgttcctggatacagttgatctgttccataaatgcatgattgctccacaattcagagatgtgattattaatcattctgtgttccagggccccacggggctgcccggagatctagggcccccaggagaccctggagtttcagtgagtgtgaccccctccccaatcctggcatatttcctaattctgtccccatctccctacccccacagacctgggcactgacagtggaaccaaaaacgttcttttgcctcccagccccatcccaaattctcacgtaccctcatcacccctcccaactctgtcttccccccatgcagggcatagatggttccccaggggagaagggagaccctggtgatgttgggggaccggtgagtgggaaaacagagggtgtggtgctgaggcgggggttggggagctaatgagtgagtgaattgggggggcaggggagtgggctagtggggtacccaaggcccctgcagatgctcccgcttcacctctctggggacccccaggaatgtgagcagcttgagggagtaggtgggaggtgggagtacccggtgctggggtgaggcttggggaagggtgtcctctggtccaaggcgtcctaaaacagtcaggctcaaacaatgttagctgagaccacagctggtgtccttgtctcctccagggtccgcctggagcttctggggagcccggcgcccccgggccccccggcaagagggtaagtgataagccacctcctgggtcctcagcttatctacagcccccactcaccttacagacctcactcatcccacagcctcaatcaccccacagaccccacacacccacagaccccactcactccacagcccccactcaccccacagaccccacacacccacagaccccactcacccacagaccccactcaccttacagcccccactcaccccacagaccccactcaccccacagccccgcttaccccacagaccccatcagccacagacacactcacccacagaccccactcacccacagattccactcaccccacagaccccagtcaaccacagaccccactcacccacagaccccactcaccccacagcccccgcttaccccacagaccccactcagccacagaacacactcacccacagaccccactcacctacagaccccactcaccccacagcacccagtcaaccacagaccccactcacggggagaccccactcaccttacaggccccactcaccccacagaccccactcaccccacagcccccgcttaccccacagcccccactcaccccacagaccccactcaccccacagcccccactcacccacagaccccactcaccccacagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactcacccacagccccccactcacccagacctcattcaccccacagaccccactcaccttacagaccccactcatccataaccccccagtcacccagaccccactcacccctctgaccctcagtcagcccctagacccccctcactgtctttcccttccaagggtccttcaggccacatgggtcgagaaggcagagaaggggagaaaggtgccaaggtgagtccccctggcaaggggaagggtccctgcactactctaggccaacagtggggccatcaggagagggtggacctatgaccactctgtgcacctactccctcccgatcccagatgcttcttggcaggggtcaggaggcaggaaccctctgactctggcccctcccttgcctgtgtccatttcagggggagccaggtcctgatgggcccccagggaggacgggtccaatgggggctagagggccccctggacgtgtggggcctgagggtcttcgagggatccctggccctgtggtgagtggagcggggcaggggtgggacagggtggatccagctcctctctgtctgctcccagcttgtgatcccatcaccgtttggaggggctgcccctggtgcatggtcgggggggggtccacactgtgttctgacagggtgcagcccaccccatgttctgttccattctcagggtgaaccaggcctcctgggagcccctggacagatgggccctcctggccccctggtaagagacttgttcatccttgaggttctggctctgaggaccactctgggcacctagtgaccacctagtgagcattggtgcaggctagccctcactgaccatccatctgagtgtccatactgcctgtctctactaaccatctgctctgaccttccaccctgatggtctacactgcccatctctataaccctctgctctaacactccaccttgatgatctacactgcccatctctataaccccctgctctgaccttccaccttgatggtctacactgcccatctctataaccctctgctctaatactccaccttgatggtctacactgaccacactgacccttcatcttgatgcctgcactgactctccatcttaatggtctacactgatcacccacgctgaccttggccactgaccactcacgttgtccatcctccagtcaacccctcattagctctcatcatcccaccttggtggcctactctgaccatcccttgacctcatccctggtaattcccatttgaaatctgcataatttcccatttgaccatcccctaaccacccacacagacctcgagttcacatttgagaatccctaactgacccttgctcttctcccaggggccctctggcctcccagggctgaagggagacactggccccaagggggaaaaggtaaggacatcattccattattctcttccccatctcctcccctctttccctccctccctggctggggggctgggagattggtgcatcctctgctcccaaactcatcaccctaaggctctaggagaaaaacctccctgaatcctcccacgtcctcccctgtctgtgcctcttttgtccttcagggccacattggattgatcggtctcattggccccccgggagaagctggtgagaaaggagatcaggggttgccaggcgtgcagggaccccctggtcccaagggagaccctgtgagtgtcctgacctgagcgggaagaatgcatttgaaggagggggtcggttgagagactgtgggtgtggggtctgggaaacgtgggtctggattaatgagggtgtgtgtggggaaaatagggggatgtatctgggaactggcaagttggaggctgcgtctggggtttggggtctctctgtgggggaactggaggcttgtctagggttcggggtcttcctttggtaggattgaaggcttgtctgggggatgtgtcagggcaatagggtgtaccccaccaatactgacccgatgtccttttcctagggtccccctggtcccattggctctctgggccaccctgggcccccaggtgtggcggtgagtatgcagggaatcttttgtgggatgaggtcactgtggtggtccaggccaggacctcagctctccctgtctgtaccctacagggccctctaggacagaaaggctcaaaagggtctccggtgagtacaccctgcttccgtgggcttacacatcccagctccccacccccttcactgcaccagaaccctccacgtctctgccttcatttatttatttattcatgcaatcgtgcgttcgacaaatatttattcaacacctacggttgtatttcatcagatccaaaatgccatcaattataagatgtaccattattttacaaactgctaggaaagaaaacagttctgccaagtaaactatgacttgccaaagatgttaagaagctgatttcagagacattaaaacatgaaaagaaaatttgtgtctgatgcctaatgctgaaaactgcatgtctcttccccaaggctgtatgtgtgtgtgtgagtgtgtgagtgagtgtgtatgtgagtgtgtgagactgtgtgtgtgtgagtgtgtgtgtgagtgtgtgtgtgtgtttgtgtgtatgttggtgggaagggtctccatagacagggttcattctccaagtgacttctccctacaggggtccatgggcccccgtggagacactggacctgcaggcccaccaggccccccggtgagttccccggggggcgggggaatggacaccaaaacctggggggagagcaaggactatgtctgggtgtccccagagggtccttccgtgcgcagcactgggccaggcacacactaggtgttcagaggatgtaggtgaagagggtagttccctgtaaaaccccaaggaaggtctggcctgggaggggggacttggggggacacccatgggggctctgacctgggtcttgtctcttggaccccatctctccctccctgtctctgtccatctcccttatctgtctctgtctatactggcgccactatttcatcttctgtctctctccctgctctctctccctgtctctgctattcttgcgctttctcttttgtcctcttacaacttggcttctccccatctctgaatctgtctctctctttcctgtgtgtctctccctgtctgcttatctctcctttctctatctctgccccttgtttatctctctccctcctctttctcatttgtgtctgtctgcctcttcatctctgcctgtctctctttctccctctctctccctcccccatctcccctctcttctccgtccccatcccctacgcccagggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggtgaggtccggtccccccgccacttggatgggcggagtgggggtgtggggggggttggggtccgtcgggtcccatccggactcacccaccctgcctggctctgcggcaggggaatactggattgaccccaaccagggctgcgcgcgggactcgttcagggttttttgcaacttcacggcgggaggagagacctgcctctatcccgacaagaagtttgagatcgtgagtaacccaaacctctcatcgcctcccccaggaagtgctgtcccctgctccccacacccacaaccaccttgtctgggacgttatccttccttcaaccggcatttattgagcacttactgtatgccaagtcctgcctcaagagctgggactacagcagaggatcaaaaagaaaaaaaatcaggccagcctggtggcacatgcctataatctcagcattttgggaggctgaggcgggaggatcgcttgaggtcaggagttcgagaccagcctgagcaacatagcaaaaccccatttctacaagaattaaaaaactggcgggcatggtggtgcgagcctgtagtcccagctactctggagactgaggcgggaggatcctttgagccctagaggcagaggttagtgtgagccgagattgtgccactgcactccagcctgggagacagagcaagtctccttctcagaaaaaagaaaggaaagaaaacaaactatctctgcttttatggaactcataccttccatgggaagacagacaaggaaaactccaaaagaaatcaataggctggatgtggtagctcacgcctgtaatcccagcactttgggaggccaagcgggggcagatcacctgaggtcaggagttcgagacaaggctgaccaacatggtgaaaccccgtctctactaaaaataaaaaaatcagctgagcgtgatggcgggcgcctgtaatcccagctactcgggggctgaagcagcagaatcacttgaacttgggagacggaggttgcaatgagccaagattgcaccatggcactccagcctgggtgacagagtgagactccacctagaaaaaaaaaaaagaaggccgggcgcggtggctcactcctgtaatcccagcactttgggaggccgaggcgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgtaattacaggcatgcgccaccatgcccagctgatttttttatttttttttttttttttttttttttttttcttttttttagtagagatggggtttcactacgttggttaggctggtcttgacctcaggtgatctgcccaccttggcctcccaaagtgctgggattacaggcatgagccaccgcacctggcctgcagggaacatttactaaaccctgactacatgtagtgctgggctaatacctctatctgcaggtaaagcacttagcaagaacctggccggtataagtgtgaaataatatttattgttattgttatttttgtctgtttttcagacagggtctcactctgtcacccaggctagagcacagtggtgggatcacagctcactgcagccttaacctcctgggttcaatgatcctcctgtctcagcctcttgagtagctgtgcatcacacaggtgtgcatcaccatgcctggctaattttttaaatttcttatagagatgagggtcacactatgttgcccaggctggtcttgaactcctggcctcaagagatcctcctgcattggcctcccaaggtattgtgattataggcataaaccaccacacccggtctattctaatttttatagacagggtctttctctatcacccaggctggagtgcagtggcatcatcatagctcactgtaacctaaagcactgggattaagcagtgggagaaagccactgtgcccagccccatattgttttgttcttttgagacatagtctcactctgttgcccaggctggagtgcagtggcgtgatcttggttcactgcaacttccacctccccagttcaagcaattctcctgccttagcctcccgagtagctgagattacaggtgcctgtcaccacacctggctcattttgtattgtatttttagcagagacggggtttcaccatgttggccaggctggtctcaaactcatggcctcgagtgatccacccatctcggcctcccaaagtgctgagattacaggtttgagccaccgtgcctggccccatgttgttatttttaactggtttattttctcctggtttagtgggagctcagatgcccagtggatgggaatttagacaagcttggacttcccactgggcccggagtgcaagacttgatccctaaacaattactaacatctgaggacctcctcttcactcacctgcttagcctaaagggagaggctgaggctgggcacagtggctcatacctgtaatcccagcactttgggaggctgaggctgaggtgggaggatcgcttgagcccaggagttcaagaccagcctgggcaacatagaaagaccccctccacccgcccccccccccaaaaaaaacaggcatggtggcacactcctattatcccagctacttaggaggctgaggtcagaggattgcttgaactttggaagtcgaggctgcagtgagccagtgatcacaccactgcactccaagaccctgtgacagaacaagactctgtctcaaaaaataaaaatttaaaaaagctgggcatgggggtacatgcctgtagttctagctacttgggaggctgcagtgggaggattgcttgagcccaggagtttgaggctgcagtgaactatgattatgtcactgcacttcagcctgggtgacagagtgagatcctgtctcaaaaattaattaattaattaattaaaataaaatggtgccattggagacccagagctcaatcccactggggagccctgggagactgtgtagcacaggcacctgagagttatcccccttggaggtgagggagctggggtatttatccaccaactcccattagtcattgggtgagggctgcctcaggggcatgaacctccttcccccattgtgcactggcagagctcgtccatcccagaagccagagaacatcctgacatagtcacaacagcctactgtgtgaggagggaaatgcagatgagatctagatggcaccaagggcgtcagctacagtgaccctcccttttctcttccaggtgaaattggcctcctggtccaaggaaaagcctggaggctggtatagcacattccgtcgagggaagaaggtgagtcaccgaggccgagatggggagtgacatgaaaattgatgggaaccagcaggggggtttgaggggtgggttctgagaggtgagatgaagaggataggctttcctctaccttcctagggatcgcaagctggaggtggggtggcagcagcatcagatgtgtaacaggcagtcaattgccatacagaatgatggtgccaggataggggaagcacagggcatggtggaaatttagaggcagtgttggaaagaccagaaggcttcctagtagagatcacagctcatctgaagcctaaagaatgcactgtgttagcaagctaggaaggacaaggacaagtgttccagggagagggaaaggcatatgcaaaggctcagtcaagacagggtctggtgaatttgaagaagaaaaagccacatggctgggtacagtggcctgtaattccagcactttgggaggccaaggtaggcggatcacctgaggtcaggagttcaagaccagcctggccaacattgtaaaaccccatctctgctaaaaatacaaaaaattagccagacatggtgatgtgtgcctgtaatcccagctactcaggaggctgaggcaggaaaatcacttgagccctggaggaagaggttgcagtgagccaaaaccgtgccactgcactccagcctgggcaacagagcgagattccgtctcaaaaaaaaaaaaagcattattaagatattttgtatttttttcagattagctcttcaaaatctgatggagattttacatttatagtacatcacaatttgaatgctaaattttattgggaatatttgctctatatttagatttcataaaaccattgaacaacagttcaaaaagtagattcagactcaagttgttccaagcataagctttctgataactggattgaagctcagtcattagttgtgaatttttttaagtaaaagaattcagggccaggcacagtggctcacgcctgtaatcccagcactttgggaggccaaggtgggcggatcacgaggtcaggagatcgagaccatcctggctaacatggtgaaaccccgtctctactaaaaatacaaaaaattagccgggcgtggtggcaggcgcccgtagtcccagttacttgggaggctgaggcaggagaaaggcgtgaacccgggaggcggagcttgcagtgagctgagaccatgccactgcactccagcctgggcgacagagcaagactccgtctcaaaaaaaaaaaaaaaaattaaatgaagttaaaaaaaaaaaaagtcccagccaggcatggtggtgtgcacctatagtcccagctacttgggaggctgagatgggaggatgacttgagctcaggagatggaggctggaatgagccaggattgtgccagtgcaccccaacttgcgcgaaagagcaagatcccaacccttaccccccaaaaaaggaaaaaaaattaaataaagtaaaaaaaaatccctccttcaaatcagccacatttcaagtgctcaaaagccacgtggctattagacatgtggctgccatattggacagggcagaaatctggtatcagggacagtgagctctgtagatccagcgactcacaagagtggaggcagagttgtgtcttctgggtggggatgagtgtgttaaaaccctggattggtggatgaagcaatcagaatttgggaggtcagatggagtgggcatggaggcctactggatggagaggtggacagagtggatgttcaggtgactcttgggattctgccagggatctctaggtggctggtgggacctcctcagagatggtgacatggggggggtggcttgtctgccagtggatggagattccggggggtggcttctgcagaaagaggctcatggagcccctcatcctctgccttgccctcctctcaccagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccgggtaagagggtggggcagtggccagctagagaggggaggcaagatgtcggccaccttcccggtaactcaccgtctctgtcttctctggggacagctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccatgagggagccccagaatggggtgcatttggtgctgaggctttgaagccaccgtatttttcgttacctgtgactatggagccaatgggatgtgacttcgctcatcacggacagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcctggccccccaccgccaggccatagggcataatttgcatctcaaatctgagaataaactgatgaactgtgtttctgtctctgtgtatttcttttttaaatttttttgtttgtttgtttgttttatttatttatccttgagacgcagtcttgctctgtcgcccaggctggagtgcagtggtgcaagcttggctcactgcaacctccgcctcccgggttcaaacaattctcctgcctcagcctccctagaagctggggttgcagatatgcaccaccacacccggctaatttttataattttagtagagatgggatttcaccttgttggccaggctggtcttgaactcctgacttcaggtgatccgcccgccttgatctcccaaagtgctgggattacagatgtgagccaccacgctcagcccttgtttgctcgtttttagagactgggtctcactctgtcgcccagtctggagtgcaagggcatgatcatggctcactgcagcctccaactctgggactcgagtgatcctccttcttcagcctcctgagtacctgggaccacaggcatgcaccatcacacccagctgggttgttttgtgtgtgtgtgtgtgtgtgtgtgtttgtgtacagatggtgtctttctttgttgcccaggcttgtctcaaactactagcctcaagcaatcctcccacctcagcctcctgagctgctgagattacaggtacgagccacctcacccagctcttgatctctttcatctgatgtggcccatatctgtcttgggatctggctcttgtctcatctgaggtacctgtcaccacctgtattaattaggtatgtcttttgggaatgcaattataatgagactcactggagattataggcctatttattcacccaggctcctagaggaaaagttgaaaattgtcagcttgggctgggaggcccaagtcagcttaaaccagaagtttggcctctttacaaaaaaattttttttaattagctaggcatggaggagcatgcctgtggtttcagctactcaggaggctgaggtgggagaatgacttgagcctgggaggcggaggttgcagtaagctgagattgcaccactgtgctccagcctgggtgacaccacagcaagaacttgtctcaaaaaaaaaaaaaaatttggtttgggatgatttgaattaggagtaagatgttggtttgaggtatatttttaactgatttattgagatagaattcatttacccattaccatataattcattaccattcattaccatataattcacccatttaagctgtgtaattaaaagaaatcctatacccattagtggtcactcatgtctttccaacctcccagctgtaggcaaccacgaatctgctttctgtctctaaggatttgcctattctggacagaaatatccatttcatataaatggaatcacgctaggtgaggtggctcactcctgcaaccccagcattttgggaggccaaggcaggaggatcgcttgaggccaggagttccagaccagcctaggcaacatagcaagaccccatctctacaaaaatgaaaataaaaacattagccaggtacagtggtgcatatctgtagtcccagctacccaagaggctgaggcgggagaatcactggaggccaggagttggaggctgcagtgagctgtgatctcaccactgcactccagcctgggaaacagagtgagaccttgtctctaaaaaaaaaaaaaaaaaaggaataaatacaaataaatgatataatgatatatggccctttgtatctggcattttcagcaaaacggtttccaggagttttttgttttgtgggcagagtctcgctctgtcacccaggctggagtgcagtagcacaatctcggctcactgcaacctccccctccagggttcaagcaattctcctttctcagcctcccgagtagctgggactacaggcacgcaccaccatccctggctaatttttgtatttttagtagaaacggagtttcaccatgtcggccaggctggtctcgaacccctggcctcaagtgattcac

SEQ ID NO: 692 - DNA, 12276 bp, Human
  misc_feature (1)...(12276): n = A,T,C or G
hctnmgakrbcngthrntsndstartsndndchrgarntgastartgandtgaagtttgaagtttaatcactgagaaatggcacagaaataaagctggtttctttgggttccatcaggcaatgtgaaatatcgtgaagcgaggtggtatcacggagttccatccggggcaaatgtagaatggcagcagcttcactacatttttctgagaaaaacagaggcatagacagtgcatctcataaaaaagagcaaaacctggagtgcttacgacatccttaaacaggattacaggaaaaaatgatggatgtgaatgtgtttagcacaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgccttagcctcccaagtagctgggattacaggcgcctgccaccacacccggctaattttttttgtatttttagtagagacggggtttcaccatgttggccagggtggtctcgaactcctgacctcaggtgatccacccgcctcacctcccaaacttctggaattacaggcttgagtcaccgtgcttggccttgtgattttttaaaatacatttttttcttacttttgttcccattatctgatggaggaaaaaaatgaacaaatctatcaaccaacttacctgggagcctggtgctcatttcctattggttccacattcactccctagtcctcctgcaaccactctgaaatcccttcctcgttttacccagctggaaatgccaccactttagccatactgaagttcttctacattcttcatttctgcatgtgcaggcaagtaaaatgatagggatttctgtgggcgttgtcaggagctgaaagattgggaatgcttttgaaaactccttctccattgagtttaagaggaaacgggtgagttttcccattatttcggtaggatagcagatgcctcttcatttacccctttattttaccctcccatgcccagttctgtcctaccactaagagtgagtacgtcggttgccgcattctggccttgtcctaagaagtgtttcacaatctaacaccaccaatactcccctcacccccggtgccttaagtaaggaaggactgggctgctgagtggcaggtgggggctgtctgaggatgggagggggaaataagatggaacggggtggacagaaaaaaaatcaggagaaaaattattatttgagaaatggaaatcttggattaggattttttttgcaagatgattaagccattttagaaacatgactcatattgtcttctgccctttcttcctctaagtaattatgaagaacacatacttggaagattttaataaaattatgagtaatattagatcactttaattcctgtttacggaggacagcagtcaagtacctaactgtgagaggaaaatgaatctttgcttctaggaggcaccatcatttacgaaaaccaaagagggccaatttgactgtttttacttgtacccctctccttcttgacttgtctcattttttcttaagattttgtcaaagtgatatatgcatctagaccaaagagccaggtatttctgcttaaagggacatttctttgtttgtttttttaaaaatagaggctttcgtttccatcctcttccaattcctgtttcccaaggcaactactttcaactcttttacctggtgtgtgtgtgtgtgtgtgtgtgtatgtgtgtgtgcatgtgcacgtgtatgtgcatgtgtgtgtgtgtgctttccgctatggaatatgaacctttagttcttcctcaccctcattcccctggcaaacaccttctgtctcccacttttcaatatagttttattgtaatggtaaaatcaatatttagtgtttaaaatattatgccaatgcaaatgctattcatggtgaaaccatgtattaaactgcaattaatttttctttcctgtacacatttttgtttccattgatttaacaattaccttgttttgtttgctttttgttctcaattccatcatcaagtatcctcaaattttatttgcctgagaaaatttctcctggggcttcatatcctgctccagtctggacttatgctcaggcctgatgtacctccctccatcctgggtctgcctttacagtcctcctggtggcctcctccgcctgtctctcacctttcacctcatgttgcctggactcatgtcttcctttatcatgcctactctcccactttggagggacacattttccagtatcctccagaaaaagagaacataaaaaattaactttatttggagactttgcttgcctgaaaagcctttattttgtccttgtacttgagtatccagatagagaattccaaggtagagataattttccttctgtatattgaagacattgctctgttgccttctagcttccaaaattactatggaaaagtctaaaataaaattcctaatattatattttgaatttagtatttttcctctccttttcctctctaaaagcttgtaggaacttctctttgtgctcagttttctaaaagtgtatgaaatgagacagatacttggtgagtctttctaatatgaagagtcgcgtcctttagctttgggaactttgcatctattttgttgatttttttcccaccatttatgacatctctctgtttagaactcctatttcttggttattagacatcccagattggcattctgttttgtttttaacctatgggtttatttgctctcttttctgagatatttaataaattttagctttcagctcttctattgacatttaatctcagatattgtcattttaattccaagaactttcttttaaaaaattttgagtattttaaacagtaacctgttgttttgtatgttattattatattctcataactctgagaatactgatatcattttggcaaagctttcttctccttgcattgttttcttcctccaaatacctgttttgttttggtcttattttccatgctaggtgccattctcagatgtcccaagctcctcgttgtctgctcctgtgcaaaagagatggaaaggctgattggaaactctgaactcatgaatgggacttgttaattatgggcttcactgtaaagtgattggctggactaattatttgaggaatatctgatattgtctttatgtcttccttttagaatgtttgagttcttggaaaagacgatactcatctgcctgtagggtaaaagcctgggttccggagttctaaaaaccatgtgagaggagagcatttgctcacctaatgtccctgtctcagtatagtacccttgtctcaactgtgctatagatacatccagctcagtgatcccattttatcctttccagacaatactagggtgagagagtggtggttgcccaggtatacaaagtgatttgggaatctgaatcttaaactgacttttaactagtttttctctagaggaacctggtatggcaaatcttgggtaaaagtcggttcattcttgacttttccttctgcttggatagaattctgttttcttagggctgttgtatctttgatcactcttctatctattttatttggatttatgccttaatttcaatttttttttttttttttttttttttgagatggagtctctctgtaggccaggctggaatgcagtggcgtgatctcggctcactgcaacctccacctcccgggttccggttcaagcaattctcctgcctcagcctcccgagtagctaggattacaggcacatgccatcatgcccagctgatttttttttgtatttttagtagagacgggatttcactatgttggccaggctggtcttgaacacctgaccttgtgatctgcccgccttgccctcccaaagtgttgggattacaggggtgagccactgcacttggcctcaaaaatctttcacagttaatttagaagagttttggggagcaaaggaaagaaggtgggttgatgcaatctgtccttacccctcttgttgactttggatctatctatggtagcggtttaaaatttgtttcttgcaatggagttctttctttgaaatagtatgtagaagctcagtatataaaatacatataagcaggactgctgtgtttgaaaaggaaatgagggtttatggttctactttctcagttctcctcttaccctttccctaccatgagaactccctggaaagcataatttgtaaaccactgatttagaaattatcgaacataacttatccctccagtagatgttagacattgagtgaagttcatggcattatgggaagaacgtttgatttattcctttagagattaattttattgcttctaaatgctcgaatggagcaaggcaaagagaaagattcattctaaagatcttttagttgaaatagaattggactcaacttccttgcaggctaactttataattacaaaaataactatcaaatgctattttttatttgagaggaaagtctgtagatttacctgaatattaaacgatattcaactgtacattcacattttgataatggaagatgttagaaattcccaaatttactttcagaaagctaaaattctctattatgccggattgctattacagccaatgtttattctaaattacttacttaaatataagagtcagaggaagtcttcagggtgagaaaaaatatttagggcttatcttgcagggaaatcattattaaatttgtgcatagtttagcttaacatttatgtgcagtctagccattaaaaacattgttatttcctttttcctccacctttccctggagtgggccatcagttacccgataaagccatggaaatacgtggaagtatttatgcaatgcacgtcactcaaaggttcagttgggaatgggcaccaagattgagaaacctgtcaaatgaaatgtatttttgtatgtctctaagatgaaccaagaattcattatctaagaattcaagaatgtattcttgaatgtgataagaaaaagaaaataaaaacaaaaaacaaacgaatcaacagaaaccaaaaagcactttactggtgtagaggactaacgtgagggaagtgccagtagctctttgcagaatcttccattttaatccagtcttctgctgttacctgtttaccattactaccatttcacagaagactcagacttcatcctaaaaaactatctccagtcatgctgcagaaaataattcgttagcttcagctgcaggaatgagacacctttaaaaaagagaaatgtgacccaaacttttgtgagaaacaccttgtattttgattgctatttcacattcgaaggactcttgaaaaacagaaaaaacctaaaacatcatcttgcttatggtatcttttggtggcagactatgaatgggacatgggacccccataagatatatctagtgaagcactgagagatggataaacaggtgcctgcgggaaaggtactctttcagccttcttatagaagagtattgaaacaggagaaaatgtttactttctagagctatcaactgtagaaaggaaaagtcctggggaggacttgttctggcaaagtgcacgctttggcacctctgcagagaacatgaagtttgcccgcaaacattagatgtctacttggttacacgtgaccgcaacagggcgtgtgtaccatggcctcagctcgcttcttgatgacatcatgaatctgggctccggccaaaggattttgagacgagccaaaatgctgtggagcatgcagaagccactcattgctgttgtcttcaagaagccagaggaagacatgcaaagaattaaagaaagacgctgaagctgtgttacaaaacagttgatcaggttgaattatccgctctctaacaatcttttgagagttcaataaaaactagcagctcttcaattagccgggcgtggtggcgggcgcctgtagtcccagctactccggaggctgaggcaggagaatggcgtgaacccgggaggtggagcttgcagtgagccaagatcaaaccactgcactccagcctgggcgacagagcgagactccgtctcaaaacaaacaaacaaacaaacaaacaagcagctcttcaagcaattgctatattcgagagctgaacctctttttcttgaagtcgccaccacaagtgtttgtccttgtttttatttctctttaatctttcacacacaggcctctctcacctgtagaatcttgagtgagaccatgggaagtaggcaaggctattttctgtgactcatcttggtggagagccctgactccaagatctgagacatttgccaggggattcccttccctgtttttctatccacacctctgctttcttctaccctccttctctctcttccctcttaacccttttgtttttactttttccacattcataggcattctttcctcagttgaacctgtcctcatggctccctgagcctgggttggctgatctgaaccagtgtcattttgtgtggttggcggtaaaggccaaatgtaagatgtgtgaaatcactttaaaaatgacaaggtggggccctatgcagtggctcacacctgtaatccaagcactttgggaggccaaggcgggcagatcacaaggtcaagagatcaagatcatcctggccaacatgatgaaaccccttctctactaaaaatccaaaaattagcggggcatggtggcacatgcctgtagtcccagctacttgggaggctgaggcaggagagttgcttgaacctgggaggcagaggttgcagtgagccgagatcacatcaccgcactccagcctggcgacagagtgagactgtcaaaaaaaaaaaaaaaaaagacaaggtgtttcagcagggtggtttttactattatatattcagtattgttataggacagggctcactccacataaagcaaaacttccctgtggcccagctttgccctgagctcctcttgtcattccaccaactcttgcttcccccagctcctatggtgatgtcccctctgggtcagtttcccttctctgtctttctcgtcttctcattatgatttatctactctctctcatttcctcagaggcttcttaggaactgattacttttggttgatcaagcactctggagccaaggggataacagttaacagatgatggtaacatatcagagaaatccacattttaactggagattccatgaactccaatatggagcttgacagtgaaattttaggcagcatgagaggccagtggttagggggccttttcttggtaatgtgaagccttgtgcatgcgaatgatttttctgttccacccattcgggaagtgagctaaggcagtgtatagaggctactgaataaaatattaaggcaggacgtgaagggaaggtttttggtttggggagggcaataagagtaacaatgtcttttaaagaagagttaggaaagaaatagtacagttaagacatcatgtacaaaatgtgggtattttcagtcaccccagcagcctctattctgttaatgtttctctgcatctggctctgagaaaggacaggcaaatacaggttatgcaaatagagatggtgtcattgagctgggagtgatttgcatgccaaaggagattgcagaaattatcttttcaaattctggggactgggggtgtttgctggtggctgggattttctatgaatccagggacaagggcttctgagtctctggtgtcaacaaggtggcttgactcagccagagaggctgtttttccctgaagatgtgtcccagccctctgcagtaggagctgagacttagcagaacctccctggagaagatgccctccttgcccacgttgatcttcatagccatcttttgcctggagtcattggctgcaatgctgcagaatggattcttggtcacaatgctgggcagggagtgggtaaggtgccagatgctgtccacaagtgacatgattgtggcctgtctcgctgcctcccgtttctgcctgcatggggtagccatggtgaacaacctcctggcctccttagatttttcgcgtgcagttccctatatgaacatcttctgggaccttttcaatgccctcactttgtggtttactgccttgcttgctgctttctactgtgtgaagatctcatctttctcccaccccaccttcgcctggctgaagtggaggaactctcggttagtgcccaagctgatcaagggctccctgatcatctgtggcctggaagtcatctcatcagccactgggaacatcctgtttggtcagaggaaggtctccctgagttcctacagaaacgaaactctagtttatagagtgcaggcttcatttcagctctactttttcctttatgaagggtttgtgtggtcgattctgttcctcctgttcctagtgtccactgtcttgctcatagtctcactgtgctggcagttggggtagatgagggacctcaggcccggcccctgtgatcccagcacccaggcttacactatggctttaaagtcactcaccttttccctcatcttctgtacattgtacttcctgtccttgtttgcttctgctttgaaaatcataaactttcagaatcactggcactgggcctggtaagtgctaatctatgccaacatctgtctgcactctaccgtcctggtgctgaggagccccaaactgaaaaagggcctgaagacatggcctcagctccagtgcccacgtgctgctggctcacagggctttggaaggtgctggccatagggtggttctgctcctgagttatctgtgtcagtaaccagtcctgggatgaatgatcctggtaggaatgtataaggtttgggtactgtctttctctttccagtttcttctttctctccccctctgtccatgcctcagaatcccttttccatcttgctgtctgtgttcttaccatcccctccactgctgtgagtctctagtcctagccgtcaatcaccttgacttttgctggtggcctcatttcctcatggggccccaagaatctataggtaagcaaccctaatatttgccaagcatcattttggtctgtatgccctttatagagaactgtagctgtcgtcagttgtctctgtgggcaaactgaagcttattttttatatattttattttaattttaagatggagtcttgctctgttgcccaggctggagtgcagtggcgtgatctcggttcactgcagcctccacctcccgtgttcaagcaattctcctgcctcagcctcccgagtagctgggactacaggcgtgtgccaccatgcctggctaatttttgtatttttagtagagatggggtttcaccgtgttggccaggctggtctcaaatctcctcacctcaagtgatccacccacctgtgggattacaggtgtgagccaccgcaccccaccttgaagcttatttttttatagtgacataggttgtccagcaccatccacttgacatcgcctgcccttctgctccacacctgttctcttggcctcgtctctccacttcagcccaataaatcttcttcccctcttcccccaagtccttttcttcttcatgtgcttcttgggcccacccaatacttccttctttcctttctctgccaatctccgtcattttcttcctttgtgctctgcttaagactgattccactcagggagtttttccagcctgatctcacagaaggctaaagacacataggagtttggtgccactgtatgtcacatccataacttcatgtgctcatgtcgaatgaataggaattgtctgatgtgaaaatgcttttaggttttggccaacagaagatagatggaaaacaaaggaaatgtcctacacttcttaattttgatgatcctactcttcctgtctgctcacccaggaggtggatcccagatgctgctgctgaggatgggaatctccagattgggatgtctgcatcccagagcttgtgcaagatgatccactaggcctgtagcaatttcagtttccatttatttttatctttttcttttaatcccctttttttgggtattttatgatgcatatgacgtattagtaaaatgtacatgcatataattaaaaataaatatgcatatggtagtatcttagtcagcctaggctgctgtgacagaataccataaactgggtgtttatgcagcagatatttatttctcacagttctggagcctgaaactgagggtgccagcatggttgggttctggtgggggccctcttctgagttgcagacagataccttcttcttgtgtcctcacgtggcagagagatttatctttcttgtgtttcttcttataaggacactaatcccattcatgagggcttcacccttatgaactaattacctcctgaaagcgttatctctaaatgttatcacattgagggttaaggtttcagtgtatgaattttgggaggacacaaatattcaattcatagctggtgggttgcatgttcatatatatatattttactgatggaattcatgataaagtatggagaccgatagactaaaagagattgggaaaaacactgcacacagttaagagagattcatatgtttgaactagtcaaaatagaagcagtaaataacaggacagaacagaggttacaaagaattttcaaatagataaatgcgtgtaaggtcaaatgtccaataataccaggaagctgaggccccaaaacattatgctacaatgctagctggaggccaggatatggcaagagaagagagagggatgactagaggcaagataacaagatcaggaattttctcttgcaagaggatgattaaaggtttaaaagaggagattctcaagttgctgttgaggaacccagggggatttccccagggggtagagcaagggtgaggcaggatggaggaacctgtggggagctggcactgtggccaggctttaaattaaatagacacctaaagtctgtgaattatcccacctagagaacatgtattatcctcatcatcaatcacgaagaatttttctttttctttgtagcaacatgagtgagctaatgacttcctacaggtagattaataataaattatgagactgagccttgcggctcaagccacaagttggttggaggcaggaaagacaggagcatggcgggagtggggagatctttctcctctatcccttctactcaactgtgagcacctggaagactcttcccttgggcggagctccagaagtttactgaaggtgtttgggtggggagtgggtggtgattcaactctcatgttctgctccatcttcacagtccttcgagtgataccaggttaagtggacttgtctcaggagttcctaattgatgttctcaatctcctttttaaaactctagctcataaaagccccaaaacacttggtggctctgtcttgactaaagatacaatctaatatctcatcaaggcttccaaaattttctgtgatctctctccagcctacctttttggcttgatatgccatcttctctatgtaagtcctctgttgtagctaaatgtatctaattgttctggatataatcacgtatccccctcctttactgatgcctcatctttttccttccaacatgcaagacagcatctttattgtctcacaattatggggctgttacttctcaactcttctgagagatcttgggatgggaatagcaagatccctaacacatagagccacagactgggagtcacttgttgagagtactgagttgaaggttttccatatagagagctaactcaggatccctatcctactaccctcatgattacatttataaagactggttatgaaaagttaaaaactctcagacttgacttttacctaagaagataaatctagacatgagaaagccaaatgcaacaaacaaacaaacaaacaacaaacaacaaaagaatcaccacgaaacacattgcatatttaaattcaaatgattattccctcttttggattaacttactctgcacatagtatatgtccagtaaatgtttgtggtttatgtttagcccataaaagtgctttgaaggcagatatctaattcactgttgtagcccaatgtctttcaaagggttatcatggcatatagg

SEQ ID NO: 693 - DNA, 63467 bp, Human
tgactgattttttgtatttttagtagagacggagtttctccctgtcagtcacgctggtctcgaactcccgacctcaggtgatctgcccgcctcagcctcccaaagtgctaggattacaggcgtgagccactgctcttggcctaatttttgtatttttagtagagatggggttttgccatgccgaccaggctggtctcaacctcctgacctcaagtgataagaccaccttggcctcctaaagtgctggaattacatgcgtaagccaccatgccaggccacctttgcaggtcttttcctgatcctgagggtctaggaatttttaacggtctgaataaacaatatttgcgaaaacatttgccatctattacctgtaagggtggtcatctatgagacttcctctacataataagaaccttggtcttcacaacctgttttttgtttgtttgtttgtttgtttgttttgagacagggtgtggctctcttgcccaagctggagttcaatggcacgaacttggctcactgcaacctctccctcctgggcttaagcaatccacccacctcagcctcccttgtagctgggattacaggcctccgccaccacatccggtacaggtatgtttggtacagacagggtctcaccatgttgcccacgctgctctccaactcctgacctcaagcaattcgcccacctcggcatcccaaagtgttgggattacaggtgtgagtcaccgtgctcgtgcccacaaccccttatcttcacccagacactctttttattgattccaggtctgtataactcaactcttttttttcttttttttgttttcttttttttttttttttgagacggagtcacagctctgtcgcccaggctgcagtgcaagtggcacgatctcggctcactgcaaccgcagcctcccgggttcacgctattcttccgcctcagcctccccaggagctgggactacaggcacgtgccaccttgcccagctaattttttgtatcttagtagagatgatgggttttcaccatgttggccaggctggtctcggactcctgaccgcaggcagtccgcccacctcagcctcccaaagtgctaggattacaggcgtgagccaccgcgcccaaccagaactcaactcttttaaccaattgccaatcagaaagtatctgaatccacctatgacctctaagtatttcaccctttgagttgtcctgcctttccacacggaaccaacctatgtcttacatgcattgactgatgtcttatgtctctctaaaatgtataaaaccaagcaagctgtaacccaagcaccttgggccaagttctcaggaccttttgagactgtgcctccctccatgcacactcatatttggctcagaataaccttctaaatactttagagtttgactcttctcgacaaggacaagagaagtggaataaacgaataaccgcagttttcctggtggtattggtcactgggttcaggttttggagtagtagccagtcaagcctggaatccccttcctcattcgctttagctttttgtccagtcttggtttgcaagagacttgcagcggcctagacggatggccgggattcacaaaggtcgcagacacgggaactgcttcttccccagcgtcgcctccacaccctcgcgtggatactgacatccgccccattccaggaatgcgcacagctaggcgcagccggccagcgtgggccgggggcggcggggccacctcccccacctccgcgcgcaaggcccgtcgcccttgacaacgcgatccaaggtcacggaggtcccacccccaggcccgaccgtccacgagacgggtagtaccccgccacgcgcccgagcaggcagctgcccggacagcccggcgcccgccgtgacgtcaccgccccgcgcccgaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggtgagggcgtcctggctggacgggcagcgggcgggccgggccacggagacggcagggacgtccctgtgctccggggagcgaggcgccggcacctgcttcacaggcgtgggaggtccggcgaggccaagcgcggcagacgcgtttactttcgctccgctcctcgccagctccagcttggctgccttttcctcggctggactcccctcgccacccgcccatgggagccctgaaggaggctgggtcttggggggtcgcggggtcgggcggagcggctgcggggtcgtccctcctggagcttcggtccagtcaggtagcgcacgtgcaggtggagccgctgcggagcgcggagtctttgcgggtgcatgttgcggggaatggactcactcggggtgatcgtgctagttccatggatcgtgctttacccctccccgcctcccagtagcgcactgagggttcatttgttaattcgttcattggacgcacatgtgagcgcccgctcagtgcccggcgccgtgcaggttctggggacgccacagtgaacaaaacctatagcagtcatccgggtccccagagcaggtggactcgatgtcgttgacgcagctgtgtcctcggggcctggaattgatggatgcgccaataaatgtttgtaaaacagagagaacgaccctaacctctgctttcccagtccccactcggaggtaacaacagtgaaagtttcggcattgcttcggggctgtacacagtgttatacgtgtaaatataaatgtctgcgtataagtattttttattctaaaaagcctaaaccatgtatgcattgtgctacgttgtacttcagaaaattttaacgctcccagcattctttccacatcttttcatgtcagtgtatacaggtccatgtgccttccagtgaccacacagtattctgtatgatggacgtgtcatttgtttaaacattgtcctattagtggacgcaataaaggttatttcaggttttactttttattacaatgctgcatagaatgggtgagtacttaaatatttgttcacgtgcggtatttctttagccttacataattagaattttagaattgatatttcagagcctatgcatttttgaaatgttagcagatactgccaaattgtccaaaaaggccttatcaatttatatcccctttagcaggcatcaagactgcctattccaaaggtattttcttcaacgctgaatcttatgtcttttcaaaaccagtggtctataaaagataccttgtggccgggcgcagtggctcacgcctgtaatcctagcactttgggagcctgaggtgggcagatcaggagttcaagaccagcctggccaacatggtgaaaccctgtctctactaaaaatacaaaaattagctgggtgtggtggcgcgcgcctgtaatcccagcttcttgggaggctgaggcaggagaatcgcttgaacccaggaggcagagattgcagtgagctgagattgcaccactgcactccagcctgggcgacagagtgagacttcatctcaacaacaaaaataataataattttccctcagaaagtgatgctgttgctctcttctagcaccagtgtctgatcaattatttatttatttttttgtctttatgaggtggggtttcactatgttggccaggctggtctccagtgcctgacctcaagtgatctgcctgccttgccctccaaaatgctgggattgcaggcgtgtgtcaccgtgcctggccaactgttctgttaatttggttctcgtttcttttgtagctgactcgggttttttcccccttggaggttaagattttttctctttgtcgtttgtggtctcgcgtccacaggtgtttgtgattcatgctttgtatcatgcactgtcccttccatttggaaaatatgtcagttttcagcccagggacattttaattctgtttctttatctctttttctttttctttttttttgagatggagtcttgctctgtcacccaggctggagtgcagtggcgcgatcttggctcactgcaagctccgcctcccgggttcaggccattctcctgcctcagcctcccgagtagctgggactttaggcgcccaccaccatgcctggctaattttttgtatttttagtagagacggggtttcaccctgttagccaggatggtctcgatctcctgacctcgtgatccgcccacttcggcctcccaaagtgctgggattacaagcgtgagccgctgtgcccagccctttatctctttttcttaaaaattgtctctctcctctcgtcctccatcttctggtgcggtggttcaagcattcctctgcctgagtctaagaaatggaacatgttcttggcagccttctgcgtggcaggtgcccttgtcattgtcacctgtgtggatgaatgggaaggtaaattgtttggattgattgaacgatgagagaatttagctaagaaaatacatgtcttgtgcaacaggggagaaagaatagtttaggcagatccacctatgtagaaaatccagacctcttgaaatttttttcttttcttgggaaagtatttccaggttgtagcatgtgcctggcttcaggtgtgcgtgtcttatgtctgtggaatcctctcgcccatgctacgctgcctcagtcacccatgagctcagccctcttaccctttcagacctcactgacccctgacactgccagccctgtcacttgccctcagaatatcttatttgattttttttgagccggagtcttgctctgttgcccaggctggagtgcagtggtgcaacctcagctcaccacaccctccgcctcctgggttcgagtgattctcctgacttcgcctcccacgtagctgggactacaggcgcatgccaccacacccagctaggttttgtatttttaatagagatggggtttcactatgctggccagggtggtctcgaactcctgacctcatgatccactagccttggcctcccaaaatgctgggattacaggcgtgagccactgcgcctggcctaccctcagaatatttctgtgaggggtgggctaggatatccgcttgtggactttatatttgtcatttttgcccataacagtttattcagcaaatacatttccaatgcccccgagtcttcaaagaaaatgtgaccctgctgtctggagtcataggtggctgctgagcagtgtaccagggccatcttggtggcctggacagcacattagagaaacaagagctgcttgccccagggtaagtttcacagatgaggagcgatttgggccgagtgtccaaggctgttttcactggaggggagggaggaacgttccatgtctggaaagctgcaggtgcaagggtaaggagatagctctgaataattggtttgatgaaagacttgcgggagtgtgcaggagtgatggtgaatgaggctagcagttgtgtcttttctgtcagatataagcttgtgcgtaggagcctcatcctgcattcctcaggacagtcacagagccagccctgggcctggtgtgtggggagcccagccacgtggcccaccatgagagcttttcgtcagagctccaactgtcagaagtgtcagatgtgccagtagaaggatgaggccgcctcctaaaggagagggaagacctggaaagatcaacagcagacgcagtctcccaaagcaaacgtgattctgtggtcaggcaggtacggtgacgggttggtcattttgcatgacgaggtgactgccacaatcaccaagggtgccgagtccagtctcctggtcatgccagatgctcttgttttcgtgaaattgccagaacatgactgaggcaaccacgataggactggttggtgcaggcgttaagatcttgggcctttttgttctctgtaagctggagcctttgctggaacttcctgtcttggaaatcagagttgtgagagtaggtcccctgccagcaccaggaaggtcgggagagctggtttcctcactttgctcagggctcaagtactagctagtttgtttcatcttccaaaaagagcctcacctggaccccgctcctgtaggtggtgcctgcctgctgcgccctccccttcagtacttcgttttgttgacgggttttgcctcctccctctgctctccctttgtttggagcctgtgctgtttgatttccgtgtcttgtgtgctgcacccttcaggagaattcaggtgaatttctggtgctctccggctgttcttttcagagtggaggggagtagtacttgctggtcagttgcgactctgtctgtgaaacagctctttgtgttgctgagatgacgctagaggtgtagcgtccatgacatgtttgtcgtctgattaagctgtggtgctggcacttagacggcagaggaaggtgtggcccagctgtccaaggccaccaggaggaccttcagcttagttaggaccaagggaactgagttatctgagtgcctgaaaaagaacacatcaggccgggcgcggtggctctcgtctgtaatcccagcactttgggaggccgaggtgggtggatcacttgagttcaggaatttgagaccaacctggccaacatggcgaaaccccgtctctactaaaaatacaaagaaattagccagggtggtggcaggcgcctgtaatcccagatacttgggaggctgaggcacgagaattgcttgaacctgggaggtggaggttggaggttgcagtgagccaagattgtgccactgcactccctcctgggcgacagtgcaagactctgtcttggaaacaaacacatcaatccgaatgtaagagattagcaaagcgtttattggttactgggtgagtagttggcctaagctaagacaaaagaggaatctccaagtattttgctaccccttggcaggaagagagggaatgcagcttgcggggtggggatgggggtgtcaggttgataagaaaactgtgggaaaataaacatttactcctgccccccatgtcagtaaataccatgtgacaaaggtgagttccatgaaagaggctgttactgaggcctgtgatacttgcttgtctcaaaatgctgacatatcttttttttttttttttttttttttttttttttttgagacagattctttctgtcgccaggctgaagtgcagtggcatgacctcagctcactgcaacttccgcctcctgaattcaggcagttctcctgcctcagcctcctgagtagctgggactacaggtgcatgccaccatggccagccaatttttgtatttttagtagagacgaggtttcaccgtgttgggcaagatggtctcaatcttttgaccttttgatctgcctgctttggcctcccaaagtgctgggattacagacatgagctaccacgtcgggcctgacaaagaatcttgatagcgattgaaaatgtatccattcatactcaaatgaagtaaaaagtgcttttgggttcaaagccagagaatgttcatggatggcgtttttggtgcctcaagtgtagccagctagaacttttcttaccaccgtcctgcttagtcctactgaagacctgccttctactaggaagctgctcttagtccacaaagtggcttccctgtagttccacagcatttaacaaaatagatttcagggagtttatttgtggtgtggctggttatttctgctaaaaccactaggaattaccataaaagctgtagcttggagaaacagtatctacttgcgggagtattactgccacctgtgttttttttgtttttgttttggtttttgttttttttttgtttttttcaagatggagtcttgctctgtttcccaggctggagtgcagtggcacgaactcggctcactgcaatctccacctcccgggttcaagcagttctcctgcctcagcctcccaagtagctggggctacaggcatgcactaccgtgcccggctaatttttgtatttttagttgaggtagagtttcaccatgttggccaggctggtcttgaacttctgaccttgtgatctgcctgcctcggcctcccaaagtgctgggattacaggtgtgcgccaccgttcccagccctgccattggctttttaaccaggtgaattcctgtagattgggtagattgaaaggacatgtagctgaatcattggttttaaaaggaatggctcagttacttcatagccatataattaagaaatgtggctagaaggtaaaaaattggccaggcctggtagctcatgcttgtaatcccagcactttgggggctgcggcgggaggatcctgtgagtttaggagtttgagaccagcctgggcaacctagagagacccccatctctaccaaaaaacccttttttttttttttccaattagctgggtgtgcctgtggtcccagctacccaagaggctgaagtgggaggctcccttaagccttgagaagtcgaggctgcagtgagctgtgatcacgccactgcactacagtctgggtgacagagtgacagtgtctcaaaaaaaaatatatatatatatatatatatatacacacacacatataaaagaaattaattttgagatagctaaattaaatgccatattaagagcaggaggctattcagcaatgctgctgagaagaagacagaaggacgtgggtccttctaatgtaactatgtgtgtcgggttagtgatatgcacctcgaaggagaaattaagacagcacattgccatgttagttcacacttgccagtatttcagcatttgtcaggcaatggaatgttcaagcgaattttccacgaggctgactttaaaacatttcattttaaccattatgatgagaagtctttctagaacactccatcatttgatggcccatgactgaacctctcttggatgttttcagggtcattattacgggtgttaatgtttggtcttctgttttaatatgtaggctcccgtagggccattgaaatgtgaagaatccttcgtctatgaagtgtccccacatcaaaactgcattgtgagtgtttatatttttggcctctcttactgtggccttaacttgcaggtctgtctggagccctgttctctcctttcctagtttgcagatgtggctgggaaacttgttagcatcaaattgttagaatgagatggatttcatatggggccagtagtcttccatgagcaaagctcagggtgagggcttcaggcccatattttgactattccgaggtgccctttcgctttttgttctttttctttatgttcaaggagttatgtttcctgatgaatgaagtatcagtatatcatagtagagaacgattagaccaggttctggaacacaggaaacctcaagaaacagtgagtgttgagaatgccagagctaagaactcagacatttgtgagggaatacaggtctttctgttcagaatgttcatgtacttaagaatcttctcgccaggcgcggtggctcacgcctgtaatcccagcactttggcaggctgaggcgggtggatcacctgaggttaggagtttgagaccagcctgaccaacatggagaaaccctgtctctacgaaaaatacaaaactagccgggcgtggtggcgcatgcctgtaatcccagctacttaggaggctgaggcaggagaatcgcttgaatctgggaggtggaggttgtggtgtgccgagatggcgccactgcactccagcctggcaacaagagcgaaaactccgtctcacacacacacacaaaaaaaagggaaacaaaggtaaactgggaaggaaccgtgtgtaatcttccgtaccttgcattttccacttatattctggggtttgtttcctgtcgccacagagctctggtattccatagcgaggatgttttgtaatttatgtaaccctctcatggcggacatttaggttgttgctgagtttccccaagataacagacggcattgccaacagtttctcacaccttcaccagtgctagaatgacagtatttaaaacatctgtcaatctggtagtgaaaatgctatctcgttttaaagtgcatttccttagttatgagtgtggtaaaacatcttttactaggacgtaaagccattgatgtttcttgtttttgtgaatggccatttttctcttgaaccaatggcctttttcttttttttttttttttttttgagatggagttttgcacttggtgcccaggctggagtgcagtggcgtgatcttggctcaccgtaacctctgcgctagcccttttaaataacttttaaaaattgagacagtgtcgggccaggcacggtggctcacgcctgtaatcccagcactgtgggaggccgaggcgggcggatcatgaggtcaggagatcgagaccatcctggctaacacggtgaaaccccatctctactaaaaatacaaaaaattatctgggcatggtggcgggcgcctgtagtcccagctacttgggaagctgaggcaggagaatgccgtgaacccaggaagcggagcttgcagtgagccgcgatcgcaccactgcactccagcctcggcaacagagcaaaactccatctcaaaaaaaaaaaaaaaattgagacagagtctgactctgttgcccaggctggagtgcagtggcgccatctcaccttactgtaacctccgcctcccgaggttaagcagtcctctcgcctcagcctcacaagtagccgggattacaggcacgcgccaccatgcccggctcatttatttttatttatttatttatttattttgagatggagtctcgctccgtcgcccaggctggagtgcagtggtacaatcttggctcactgcaacctccgtctcccaggttgaagcatttctcctgcctcagcctccctagtagctgggactacaggcacccgtcaccacgcccggctaatttttgtatttttagtagagatggaatttcaccatgttgatcaggctggtcttgaactcctgacctcatgatccatccgcctcagcctcccaaagtgttggcattacaggtgtgagccactgctcctggctttctggctaatttttgtttttttttgtatttttagtagagacagggttttgccatgttggccaggctagtctcaaactcttgacctcgggatctgcccgcccccacctcccaaagtgctgtgattacaggcgtgagccacggcactaaattttattttagaggcagggtcttgctttgtcatccgggctggagtgcagttgtgcgatcctggctcgctgcaggcctgacctcctggactcaagtgatactcctgcctcatcctcccaagtggctgtgacctcttcctcccaaggagcatgtgccaccatgcctggctaattaaaaaacattttttttagagatggggtcccactatattgccccggcttgtcttgaactcctggtctcaagtgatcctcctacttctgcctgccaaagtactgggattacacgcaggagccgtcgtgcctggcccccagtttttttcttaatgtgtttgtcttttttttttttttttttgagttagagtctcgctctgtctgttgcccaggctggagtgcagtggcacgatcttggctcactgcagccttcgcttcccgagtgcaagcaagtctcctgcctcagcctctggagtagctgggattacagatgcccgctgcgactcccagctaatttttgtatttttggtagagacggggtttcaccatgttggccaggctggtctcgaactcctgacctcaggcgatccacccacctcagcctcccaaagtgctgggattacaggcatgagccacctcacccgggtgtttgtcttttgacttaaatttttatgtggtccttatatttatggccttttgggttatatattttgtttagaaacatttcctcttaaggccgggcgcggtggctcacgcttgtaatcctagcactttgggaggctgaggcaggtggatcacgagttcaggagtttgagaccatcctggccaacatggtgaaaccccgtctctactaaaaatacaaaacattagccgggtgtggtggtgggcgcctgtagtcccagctacttgggaggctgaggcaggagaatggtgtgaacccgggaggcggagcttgcagtgagccgagatcccgccactgcactccagcctgggcgacagagcgagactccgcctcaaaaaaaaaaaaaaaaaaagatttcctcttaaatcattttttttaaaaactcaagatgcctggcagtttaggaactgcaaagcaaaactacagtgagttagcacttcctactcactagggtggctataattaaaaattaaagaaacaacaacaaaaaaacaggtgatacaaaatggataactaggatgtggaaaaatcagaaccctcccacactgctggtgagaatgtaaaacggtgcgacctctgcaggaaaacattcttgcagctcctcacacagtcaaaccgaattaccatatgaccccacagttctaccctgaggcacataccttgtagacatgaaaacatgtccacagaacagcctacacatgaatgttcatagcagcattattcataataacccgaaaatgaaaacaatctgaaggtccatcagaaggtggaaacgaggctgggtgcggttggtcatgcctgtaattgcagcacttcaggaggccaaggcaggaggattgcttgaggccaagagttgaatgccagcctggacaacatagtgagactccatctcgaaaaaaaatttttaaaaattgctgggtgtggtggcacatgcctgtggtcccagccatttgggaggctgaggtgggagaattgctcgagcccaggagtttgaggctacattgagctgtgattgtgccactgcacttcagcctggtcaaagagcaagaacctatctcaaaaaaaaaaaaaaaaaaaaaagagtgcaaataggccaggagtggtggtgcgcccttctaatcccacctgcttgggaggctgaggtgggaggatcgcttaagcctgccagttggaggctaccatgcaccatgacagtgcctgtaaacagccactgcactccaggcaacatagtgagacccccaccccaccccaaaacaaaagttacagtaaaaagttggaagctgggcctggtgcagtggctcatgtctacaatctcagcacttcgggaggctaacgtgggtggattacttgaggtcaggagtttgagactagcctggccaacatggcaaaacccgtctctactaaaaatacaaaaattaactgggcgtggtggcgggtgcctcagcaggagaatcacttgaccctgggaattggaggttgcagtgagcggagattacaccactgcagagtgagactccgtctcaaaaaaaaaaaaagaaaaaaagggccgggactggtggctcacgcctgtaatcccagcactttgggaggccgaggtgggccgatcacctgaggtcaggagtttgagaccagcctgaccaacatggagaaaccccgtctctactaaaaaaaaatatatatatatataaaattagccgggtgtggtggcacatgcctgtaatctcagctactcgggaggctgaggcaggagaatcacttgaacccgggaggcagaggttgcagtgagccaagatcatgtcattgcactccagcctggcaacgagagtgaaactctgtctcacaaaaaatttggaagcaacccagttgcccatcatttgatgaatggaaaaaaataatctatacagcggagtgctcttcagttataaaaaggaatgaggtgctgatacatgctatatgtggatgaaccccaaagactttatgctaagtcaaagaagccagacaaaaaaccatatattgtatgatttcatttctgtgaagtgcccagaaaaggcaaatccatagagacagacatagatgagtagttgccaagagctggtgggagagggaaaagagagtgaacatgagtggctgtagggcttcttttggggtgataaaaatgttctgtagttgtccgggcatggtggctcatgcctgtaatcccagcactttgggaggccgatgcgggcggatcacgaggtcaggagatcgagaccatcctggctaacatggtgaaaccctgtgtctactaaaaaaaaaatacaaaaaattagccgggtgtggtggcgggcgcctgtagtcccagctactcgggacgctgaggcaggagaatggcatgaacccaggacgcagagcttacagtgagcccagatggctccactgcactccagcctgggcgacagagcgagactccgtctcaaaaaaaaaaatgttctgtggttagtggtcgtggctgtacaactttgtgaatatactaaaaccactgaattgtgcacttgggtgaattatatggcagatgtgttacatctcaataaagttactaaatctttcatgttttctttcagtacttttagcttttatttttacttctatggtccatctggaattcattttgacttaataagtgacagcggaaattaaaaaaaaaaaaataagaggttggtcttgctatgttgcccaggctggtctagaactcctggcctcaagtgttcctcccaacttggccttccaaagcactggggttacaaacatgagcccctgtgccctgctggaaattaatttaacctttttttgtgtgtgtttactttttgagagttgggggggtctccctatgttacctaggctggcctcgagctcctgagctcgagggagcctcctcctgcctggatctccctcccaaagtgctgggattacaggtgtgagcagccatgcctggtctggaaatttattttaatattgtagctttatattaatgttctttaatatttgatgaatttcctcagttttttcaaaatttctttggctatttatgtacactaacttttccacatgaattttagaatgagaatagtttaaaaatgtgtttgaaattttgtaaatgtgtttatgtttctcgtaagtttttaagtgttttttataatgcaacgttttgtttgttttgagacagagtcgtgctgtcgcctaggctcgagtgcagagatgcaatttcagctcactgaacctctgcctcccaggttcaagcgattctagtgcgttggtctcgcgagtagctaagattacaggtgtgcatccccatgcccagctaatttttgtatttttagtagagacgggttttcaccattttggccaggctgttctcaaacccctgacctcagctgatctgcctaccttggcttctcaaagtgctgggattacaggcgtgaggcacctcacctggcctgtaatgtaacttttgtaaatagttttgttttttgatttttttttttgagacggggtctcgctctgtcgcccaggctggagtgcagtggcgcgatctcggctcactgcacgctccgcctcccgcgttcactccattctcctgcctcagcctcccgagtagctgggaccacaggcacccgccaccacgcccggctaattttttgtattttcaatagagactggctttcaccgtgttagccaggatgatcttgatctcctgacctcgtgatctgcccgcctcggcctcccaaagtgctgggattacaggcgtaagccaccgcgcccagcctaacttttgtaaatagttttataagtagggtatttattttgtagattattgatatatgtagtccaatatgcaaacgatacagaggtatatctgatgaaaaactcgtctcccactgacatgcctcagacaacacccctcctggtggcaagtccattagccagtttttgggtgtccttgcagagatctgcgtggcatatgagaatagctatgcatgcatgtatcacataacatgtatatgcatttgaacaccatggtagtgtgtgcaaaccgctgttctacctctagtgttttttctttgtgttagaggtaattcagcatcagcacacattacacagcattgtcccatttctctataatcccatgctttccaagtgttaccttacgtctgtagtttacttgttagtcctccgcttgtgagtatgtagcatatgtaacagtcttaagtgggttatttaatgacagtctttggccctagtagtgtttcagagttttcttaaaagatcttgccaaaaaagaaaaaaaaggaaagattttgctttcttggtaaatgcattcttaattgtttagtttttgttcctggggtctcttatgtcatattttctaactagttttctgtatataggacgtccgggtgttgatttttgtattctaccatcttactgaatgctttttttttttttttttttttttcaagacggagtttcactcttgttctccaggctggagtgcaatggcagcatcttggcttaccacaacctccacctcctgggttcaagcgattctcctacctcggcctcccaagtagctgggattacaggcatccacgacaacacctggctaattttgtatttttagtagagatggagtttctccatgttggtcaggctggtctcaaactcccaacctcaggtgatccgcctaccacagcctcccaaagtgccaggattacaggtgtgagccaccgcacccagctttttaaatttctcttaaagacagggtctcactttgtcacccaggctagagtgcagtggtgtgatctcggctcactgcagcctttaccctctggtctcaagtgatccttccgcctcaagtaccccaagtagctggaactacaggtgcgtgtcaccatgtccacctaagtttttgtatttttggtagggacggggtttcaccagtttgcccatgctggtctcaaactcctgggctcaagcgatctgcctgcctcagcctcctagagtgctgggattacaggtgtgagccactgccctaggccttattctttaaaatgatctgcctcttgaaaaatgaaagtcttttctcaaaaaacttcttcccaggtctgtgaagcagcacagtggccccttctggctctcaccttgtacctcgtccttgtttgcctcgagcataggaccttgtctgtgtttgtgcctcaggccccctccctctgtgtttgctgggtccacttagtctagtcattgggccttggctcctaagaggcccctagactgaattcctcatccgatgtgtccataccagctttcaagtgacctcaacatcgacagcagggaaaacattagcacttttgtgacagcctcatattttcccccgcccgagatggagtctcactgtgtcgcccaggctgggattacaggtgcacgccaccacacccagctaatttttgtatttttagtagagacagggttcaccatgttggccacgctggtctcgaactcctgactttgtgatccacctgccttggcctcccaaagtgctgggataacaggtgtgagccaccgtgccgggcagcctcatatttttaataatttaatatctgttttgaataaataaatatggtttgattaaccaaaaccatgtgaacaggtaaagcttgagaagtcttgctgctgttcagagcacctgctgtcttcataaccactattagttgcctgtgggtcctgccactacttacttgtatgactgtagtaagtgcagatgtacatattccctcagggacgcacccttctctgtgttctgttactcactacatagctcgtggagagcttgctgtgttcatatatagtttggtgctccttcgctttctgtagccactgtgaaatgccgttcatatcttttgccccaggtttttcttctggactgtctggctattttttttttttttttttgggacagggtcttactctgtcacccagactggagtgcaggggcgcgatctcagctcactgcaacctctgcctcgggttcaagcgattctcctgtttcagcctcccaaagtgctgggattacaggcgtgagctactgtgcccggcttctgttttattttttggtttgattctgtcagttattgagagaggagtgttaagatctccagctgtgattgtggaattgttttgtctttaattctttccgttttaacttcatatatgttgaagctctgttattaggcaaatacacacttgtgattacattttcctgatgaattgtttgttgtagtattctgaaatatccttcttttttcctaataatattttttattttgaaatgtattttacttgatattaatagagccactccagctttcttaaacacactttttggatggtatgtatttttccattcatttgtcttaagtgtatctttttctttatgtttaaagtgtcttgtagatagcatgtaattaggtcttcctttaccaattctgacaatccttgccttataattagagttcagtctgttaatgtaagagtaaatatcgatgtggctggatttattgctaccattttattatttgccttttatttgtccttttggattttttccctgtttttcctttccttatcaatgaaatgtatttgagatttccattgtggtttatctaatgctttttaaagctattcttctttgaattattattttagtggttactctggtgtttgaaatatgcacccttggccaggtgcggtggctcacttctgtaatcccaccactttgggaggctgaggcaggaggatcccttgagccccagagtttgagaccagcctgggcaacatggagaaaccccatctctactaaaaatataaaaattagcctggcgtggtgatgtgcatctgtagtcccagctactcgggcggctgaggcccgagaatggcttgaactgggaggcggagtttgcagtgagccgagattgtgccagtgcactccagcctgggcaacagagtgagactgcatctcaaacaaacaaacaaaaaagtctgggcgtggtggctcacacctgtaatcctagcactttgggaggccgatgtgggcggatcacctgaggtcaggagttagagagcagcctgaccaacatggagaaaccccgtctctacaaaaaatgcaaaattagccaggcgtggtggcacatgcctgtaatctcagctactcgggaggctgaggcaggagaatcgcttgaacccgggaggaggaggatggggtgagctgagatcgcgccattgcactccagcctgggcaacaagagggaaactccatctcaaaaaaaaaagtttgtaaagagtagcttttgtgatagatactttggcataccaagaaatatggatgttcctgtcttcaaagagtgttactgagaaatacaagctttttcctgccctaatttggtgagataaattatacattaaccaaaaaattaacagtgggaaatgtcatatgctggcatatagcagcagtttcaaatgagcagcacaggctgggcgtggtggctcagacctgtaatcccagcagctttgggaggctaaggtaggaagattgcttgagaccaggagcttaagaccagcctggtcaacatggaaacaccctatctctaggaaaaaaaaaaaaaaaagaatttagtcctgtgtgatggtgcttacctgcagtcccagctgttcaggagagtaaagcaggaaggtcccttgagcccaggagttcaagactgcagtgagccatgactgtaccactgcactccagcctgggtgacagagcaatctcttttctaagaaagaaagaaatagtaaatacatgaataaatctttttttttttttttttttttgagacggagtttcactcttgtcacccaggctgctggagtgcaatggcacaatctcggctcaccgcaacctctgcctcgtgggttcaagtgattctcctgcctcagcctcccgagtagcggggattacaggcacccagtgctaattttgtatttttagtagagatggggtttcaccctgttggtcacgctggtcttgaactcctgacctcaggtgatccacccgcctcggcctcccaaagtgctgggattatggtgtgagccactgcgcctggccagtataaaatttttttaaatgggcagcataaaaagttaagtgcagtgaactcataggaagagattattgtgaactgctggggccagggaggcctgaatgggagagagggcctgcagccaggccctgcagcaactcggatgggaaggagtcccagctactgagactgcagctgcagagtggaggagctgcatgggcactggcagtagtgggtagggatgtggggggtggaaggggaggggtgtgtggtgtcacattcaaactatcagtgcttcccattttgtgcgaccccaaaccaccagatagtttaacagtaagatcttgtagcctgacattgaggtttgtggtttttcctttagggtgtaggagaaacacaaagacggaaattgtacagctagcgtgtttggtatctggttcaggcagatttattcctctaatggtttattttttttttaatttttaattttttttttgagacagggcctggctgcatctcccaccctgaaatgcagtggcgtgatcttggctcactgcaacctctgccttgcaggctcaagtgatcctcccaagtagctgagactacaggcatgcaccaccacacctggctgtttttttgtagagatggggttttgccatgttacccaggctaatttcaaactcctgagctgaagcgaccccccggccttggcctcccaaagtgctgggattacaggcatgagccactgcacctgagttagtgattaaaagttgttgtagaagccgggcgcggtggctcacgcctgtaatcccagcactttgggaggctgaggcgggcagatcacgaggtcaggagatcaagaccatcctggctaacacggtgaaaccccatctctactaaaaatacaaaaaattagccgggcatggtggcgggcgcctgtagtcttgggaggctgaggcaggagaatggcatgaatccgggaggcggagcttgcagtgagccgagatggcgccctgcactgcagcctgggcaacagagtgagactctaaaaaaaaaaaaaaaagttgttgtggaaagtttacataacctgaaatcaaatctgcttttaagaatgctgtcaattcaattaatgtaatcttggcgttatgatactaagtcttgcaattctggctggaaatatagatttcttatttttttctttttcccaattgtgaggacttctatatactcctcccataatgaatattatattaaatcctttcaaaaatataggctgggtgtagtggtttgtgcctgtaatcccagcactttgggagactgaggcagacggatcacgaggtcaggagttcgagaccatcctggccaacatggtgaaaccctgtctctacttaaaaaagaaaaacaaaaaaacaaaaaaacacaaaagttagccgggcatggtggtgcacacctgcaatcccagctacttgggaggctgaggcaggagaattgcttgaacctgggaggcagaggttgcagtgagccgagatcacgccatttcactccagctctgggcaacagagcaagaccttctcgaggaaaaaaaaaaaaaattctgcatattaattggggaaaaaccaaaaagactagaaaaatgaaacatggggaaatcatgtttaatcttagagtgaggaaggcttttacaaccaaaagactaatttccttttttttttttttttgagacagagtcttgctctgttgcccagggtggagtgcagtggcgccatctcagctcgctgcaaactccgtctcccgggttcatgccattctcctgcctcagcctcccaagtagctgggactacaggcgcccaccactacgcctggctaattttttgtatttttagtagagacggggtttcaccgtgttagccaggatggtctcaatctcctgacctcgtgatcctcccgcctcggcctcccaaagtgctgggattacaggtgtgagccaccgctcctggcgactaatttccttaatatataaaaagctcttacaaatcaataagaagaagatttaaaatgtagtagaaaaattatcagaggataccaacagtcccttaacaaaaaaggaaataggaaatatttaaaaatacgggacagtgctcagttttgcttataataagagaaatgtaagtgaaaactacagtgaaaattttatctgaccaataggcaaagatccaagagtttcatctcaacactgacttggcaggaatgtaggatgatatgcactttagtacattgctgtgggaacgtaaactgataggatctctgtggagtgtgacttggcagtatctaccactgcttaaaatacataaccttaggctgggcgtggtgtcttacggctctaatcccagcgcttgggaggcagaggccgggggatcacttgagctcaggagtttgagaccagcctgggcaacatggtgaatccctgtctctacagaaaacacaaaaattagccgggtatggtggcatgagcctgtagtctcagctactcggaaggttgaggtgggaggatcacttgaatccggagggttgaggctgctgtgagccaagatcactctactgcacttcagcctgggcgacagagtgagacccagtcaaaaaaaaaaagaaaaaaaaaattagctaggagtggtaatacacggcctatagtcccagctactcaggaggctgaggtgggaggatcacctgagcccgggaaggtcgaggctgcagtgagctgtgattgtgccattgtgatccagcctgggcaacagagtgagaccctgtctcaaaatagtagtaacttacaccagccagttattgctgtggtgtttcctgatggtgtgctttctgttttctgccattccttgtgtttattcattggaattctgctgtgatgaagagctgctgctcctcctctgtttaagtgtgcaccgatgtttgcttgatttgccgggtcacagcttacaatccattattgtcgttcgttattttgccgcacagattgtcctagattctgccactgggagcccttctggctgggctgtgtgttctcctgacacaccccgtcctttctcgtccttctgcacaccactgggtgtcctaggctcctctgtgtgctccgcagggatctctggttcctgtttttggagagaggtattcacaaaccaagatctggctgccaggtagggtgaccagccgtcctagtttgccaggacaaaggctttccctgggacgtgggactttagagtgctgaaactggaacagcttttggactttgctctctgtagcctaagtggggggtcatcgcgcctgggccctgtcacgcgtcagtggacagagctgggaaatgtgtgtgtgtaaatgttccggtattgatttctgcatccagtctgtacacatggcaaaggttgtgagcctgtactgatgcctgtacctccagtgccgccccgcagggtttattcctgccccttccttatcagtgacttttcttcaactgtgaggaccccaactcagtagccacaatcagcttttccgcttgatcttggcacatgcgtaaatcgggctcagacctgctgactccgcaggggacacatctcctgcccgagcctggtgatggtgtgctgtcctctgaggttagttttacagtaacagtcaaagtgctattttctgaagtctcttaggttagttcttctttcagagtggtgatgtcatcgtcacagctctgcatatttgctgtttgtatttcattttgtgttcatgtgcgccctgttttgttttcacggtttctttttctttttctttttcttttctttttttttttttttcgagacagagtctcactctgtcgccaagtctggagtacagtggtgcgacctcggctcactgcaacctccacctcctgtgttcgagcagtccttccacctcggcctcccgagtagctgataactagaagtgcgccaccacgtctggctaagtaatggtttgttttttgagtatgagaaacctgaccatggttctaagagagacatacgaaaagatgtatgtggaagtgtcatgttccctcagctctgccagccctctccccttcccgctttctttgcattctctgtacatatgctggttgggggttgaattgtgtctccccacgaaagatgttgaagtcccagctctcagtacctgtgaatgtgaccatatttggaaatagggtctttgcaggtgatcaagttaagatgagttcacttgggtgggccctaatccagtatgactgtgtccttataaaatggggacatttgaacagacagacatgtgtagagggagaagggcagacgtcctgaagggaagacacagggagaagatgaccacccacaagccaagcaacgccagaggctgcagaggctggaagaggcgcaaacagaccctccctcccagcctcaggaggaaccagccctagtggcaccttgatcttggacttcttgcttccaggactgtgagagaataagtgtctgttactgtaagctaccgggtttgtgccacggggagtttaatacacacctcctgtaggtaaccaagctgtggggtttgaaggccgggtacagtggctcatacctgtcatcctagtgctttaagaggccaaagtgggagggttacttgagtccaggagttcaagaccaggctgggcaacaaagagaaaccttgtctctatttttattcttttttaaaaagaggccaggtatggtggctcacgtctgtaatcccagcactttgggaggccaaggtgggcagatcacttgaggtcaggagttggagaccagcctggccaacatggtgaaaccatgtctcttttaaaaataaaagccaggcatggtggtgcgtgcctgtaatcccagctactagggaggctgaggcaggacaatcgcctgaacccaggaggcagaggttgcagtgagctgagatcatgcccctgcactccagcctggatgacagagcgagactctgtctcaaaaaaaaaagagaaagatacgttcgcgtcctcatccctggtacttgtgagtgtgagcttatttgggtcatttcagatgtatcaggttgtgatgaggtcacactgcatgggggtggggcctaactccagtattcctggtatccgtataagaagagggaaatctggacacagccaggactcacatagagaagagcttgccatgtgacaagagacagagcctggagggtctgcaaagcatgaaacaccaaggatgccggctactgccagaagctggggagaggtgcgggatggactctccctcggcacctccagtgggaagcacccctgcccagaacctgggacctttttttttttttttgagacagagtctcgctgtctcacccagcctgaagtgcagaagtgcggtagtgtgatcttggctcactacagcctcaacatcctgggctcaagtgatcttcccacctcagcctcacaagtagctgggactacaggtgcacaccactacacctgcctagtttttgtgttttttgcagagatggagtctcactttcttgcccaggctggtcttaaacccctgggctcaagcgattctcctgccttggcctcccaaagtgctgggattacaggtgtgaggttgtgtgcctggctcagaactgtggacctttttgaaactgcctagtttgtggtgctgtgtttcagtagtcctaggaaacaaaatacacagtcacatcagtttctggtttatcctttttgtgtttcttttacacaaatggtgagaaacactgatatgctctgtgggcaggtgttggcacttggacacttccctcctgtgcccccagggctggctgtgctttggaaggaggcacagagacttcagcaccctggtttgatgtagactgttcgcgaactcctctaatgccaaataccatttaattccagaagaaatgtcccgggattttttttttttttttaactgtacgaataaagtgaacaatgcaattacatgggcccaaataactggatgtttacatggtttggaatttgaatactttctgaattgtggtagatgtttttaaggtatctgcatagagataaagacaggctagggttggccgggcatggtggctcacgcctgtaatcccagcactttgggaggcctaggtgggtggatcacctgaggtcaatagttcgagagcagcctgaccaataaggtgaaacctcgtctctactaaaaatacaaaaattaggcatggtggctggtgcctgtagtcccagctactttggaggctgagacaggagaatcgcttgaacccggaagatggaggttgcagtgagccgagatcactgcactccagcctgggcgacagagcgagactccatctcaaaaaaaaacaaaaacaaaaggccaggtttgtgctgtttgtaagtccaggaataagcctaaagaataggcaagttttggctgggcacggtggctcatgcctgtaatcctagcactttgggaggctgaggtgggcagatcgcctgaggtcaagagttcgagaccagcctggccaacatggtgaaaccctgtctctactaaaactacaaaaattagctgggtgtggtggcaggcgcctgtaaacccagctactcgggaggctgaggcaggagaatcgcttgaacccgggaggtggaggttgcaatgagccgagattgcaccattgcactgcagcctgggcaacaagagtgagacttcatctcaaaaaaaaaaaaaaaaaaaaggcaagtttttgtaccttttaggagtatgaaagttgatatgttaatttttttttttttttgagacagaatgttgctctgtcacccagcctgtagtgcagcggcacgatctcggctcactgcaacctccacttcccaagttcaagccattcccctgcctcagtctcccgagtagctgggattacaggtgcctgccaccatgcccggctaacttttgtatttttagtacagatggggtttctccatgttggccaggctggtctcgaactcctgacctcatgtgatccgcctacctcagcctcccaaagtgctgggtttacgggcgtgagccaccgcacccctggctgatatgctgatttttaaaaccttgattcctggatattctgttgtctttcctttctacttgttacaaatttgtgaagaacaggagaggctcccagttagatgcggttcatttaggcttagactttgacacggcgtggctggctggccacatatccttgacaccatcacgtattgcaaatctactgaccaaggcagggtcctggtatgtggtccctggggtcagtgggtgttggtgttgggtcggtccagtcctgtgttggagtgaaagtgtctggtttctgggcctgcgtcggtgaactgcgtgcggctggggacacattggctgctttcctccctcgctgggctctgccggcaactttctcagcccactggactgagcaggaagttacagaagacaagtctccttcttagttagaaggtagaacccatcgtcagctgtttttcagtttttaaagtacacaaattttttttaaaaaatctgttttggatgaaaaagcaatgggaaagaatcaacttttagaagatgagacagtttcagaatattaacatttaaatatttggatcccttttgggaggattttttttttgcttgactgtcaagagcaaagaagtgtggcccatcgggggcttctgcaggggctgcgagggtcgagacaggtttcagtttggtaggttgatgcgaggtgtcacccgtgaggcgaatgtgggaagtgctgtcagcaggcatctgccagctgggcatggtggctcacgcctgtcatcccagctctttgtaaggccaaggcgggaagatggtttcagcccaggagttcgagaccagtcttggcaacatagcaaaaccccatttctacaaaaaattttttaaaaaattatgggggcatggtggtctgtgcctgtggtcccagctactcgtgaggcggaggcaggagcattgcctgagtccaggaggttggggctgcagtgagctgtgatcgcagtgacagagcgagaccccctctgaaaagaaggcagcagcccaccccctccagtttcgcttctgcggttctgagaagacacagtatcttacactgatgacatctgtgagggctccttgccaaaaccacaccctgacactgtggcatttggtcctgtggatttctctttcagcaacagcccgacttagagatgtccacgctagcttctgctagacacccttgatgggacgaattaccatattgtttctcgtgtcttcctaattctcattctttctgcatatttgtcttttcaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggtagccttggctcgtgctttggtctgggagggctttttggttcactgctgtgcgtaaaggggcattttcagggtggaggcagtgattggtagagccaccgccttaggtgtgaaatcagaaggtcttggctgtagggagtgctgcgccctccatttctgtcccagcgagggacttctgccagtgtcgggtgtgtcttgccccctctggtggccacccgtgagtttgccgtccggcacctcccctgagtggtgattcatggcacatctgctaataatcatggaagcgggaggggaaactcagcattggcccagtctgcgcaggaccgaattctggagctgtcttttcattccctctgaagtataaaaaagcagtctttggagccagtcctgaagtggctccatttctggcttttaagtgggtcgacaagagtagaatctttgaagttaaaaagagaagtgaggttttcttgttattttgatttctaactaattaatttggaaaccgcttttttgaagaatatagtccaggcacagtggctcacacttgtaatcccagcactttgggaggccgaggcaggaggattgcttgaggccaagtggtcgagaccaacctgggcaagatagaccctttctctacagaaaaaaattaaaaagttagccaggcatggtagcacacaccagtggttccaggtacttgagaggctgaggcaggagaatcggttgagcccaggaagttgaggctgcagtgagcacgatcctgccactgcatagcagcctgggcaacagagccagatcctgcctctaaaaaaaaaagaaagaacatataatctggttcttagaggcagtccagttctcgtaaccatgcacattgggaaaccaggctcagcattccctcgacatagcccgaggcatgtctggcctcagcagtgggaggatttgtcctgccctgagacctcctttctgagagactttttgttttgttttgttttgagacagggtctttctctgtcacccaggccgagtgctgtagtgcaatcatggctcactgaagcctcgacctccctggctcaagtgatcctcccacctcagccccctgagtcactgggaccacaagtgtgtgccaccaccgtcagctactttgtgtattttttgtagagatggcgggatccctctgtgttgcccaggctggtcttgagctcctgggcttaagtgattctcctgccttggcctcccaaagtgctgggattacaggcatgagccatggtgcccagccagactttgtttctgtctgcttctttctttttgttcatgatcttaaatgtgtgggaggccgaggcgggccaatcatgaggtcaggagatcgaggctatcctggctaacatggtaaaaccccgtctctactaaaactacaaaaaattagccgggcgtggtggcaggcacctgtagtcccagctactcgggaggctgaggcaagagaatggcgtgaacccgggaggcagagcttgcagtgagccgagatcgtgccactgtactccagcctgggtgacagagcgagactccgtctcaaaaaaaaaaaaaaaaaaaagtttaaaactcataaacttaagctttctttggaatgtgacgtagcgtattcttgcacaaaaatagaagttaaactttgttggttgtgtctgtgtttcattactaggttccacttccaaacatgagttccaggccgagacaaagaagcttttggacattgttgcccggtccctgtactcagaaaaagaggtgcgttccctgctaaccatgcccgatgctagcaaagtttcttttcacaaagctggtttttatgccattctggagaattgccagataatatattcgctgtgagaaagcattaaactttggacaggtcctcatcttaagctaccagtgagaggagttttaccagaatctattttggtttcctggataagtgtatccagatggttctttgggctggatcaactctgggaattaattgaattttgccaataattttaaaagttcccgaaatacaggcctggtgtggtggctcatgcctgggaactcagtgctttgggaggtcgaggcaggaggatcacttgagcccaggagtttgagaccagcctggtcaacacagcaagactccgtctctacaaaaaatttaaaaaattagccagctatgggggcactgacctgtggtcccagctactcaggaggctggggtgggaggatgacttgagcctggcagactttggggctgcagtgagccatgattgtgttactacactgacctgcacaacagagtaagaccctctctccaaaaaaaaagtcccccaaatcctagcgtgcagctctgctgaattccgtctctgtggagctttggatacgctctgaggcccctttgcctggtgggactacctgcaggtcttggcggctttggctgccggaggaagaaggttccccagtcctgtgtgtatggagcagggaggagttactgaggaaattaaaacgcatttggggccaggtgcggtgacccacacctgtaatcccggcactttaggaggccaaggtaggaggattgtgtgagtccaggagtctgagaccagcctaggcaacgtgaagagaccccatctctattaaaaaaaaccccgcaaaactcatttggggtgacaggacaaggaaaaagaaagatgaaggccaccatcgttgacatgctgattattgctggaaggcaaaggagagtcctgaagaaagtttgtaaagcagcagatttcaaagctcagagggccttctaggagctgtttccgggtttcgtactgatgagtgctgcattcctgactcccagtgacctccagcttccgcccagatcagccaccgcttcctcttcacctatgtgctcttgcggacttaatttttctatttttaattgtgtgggtttttgttttttttttttttggttttttaattttttggaacagggtctgggtctgacgcccaggctggagtgcagtggtatgatctcggctcgctgcaacctccgcctcctgagctcaagccatccttcctcctcagcctctggctgatatttgtatttttttgtagagacggagttttgccgtgttgcccaggctggtcttgaactcctgggctgaggtgatctgcctgtttcagcctcccaaagtgctgagatcacaggtgtgagccaccacacccggcctctctcactgattttaaatggaaggtctgtttgaggtcagtgtgcttttcagctcctgagggacagctgggccctgaggcctgtttttctccgggtgtggtagacctggtgtttggtggtccccactagatgagatgaagctagggaacctgtttttgtggagtaggagtgtattagtccattttcacgttgctgataaagacatacctgagactgggcaatttaccaaagaaggagctttaattggacttacacctccatgtggctggggaagtctcacagtcatggtggaaggcaaggaggaacaagtcccgtcttacatggatgacagcaggcaaagagagaatgagcaagacacaaaagcagaaaccccaaaaaactgtcagatctcatgagacttactcactaccacgagaacagtactggggaaacggcccccatgattcacttatctcccaccaggtccttcccacaacacgtgggaattatgggagtacaattcaaggtgagattttcgtggggacacagccaaaccatatcaaggagaaatggatgtttgagtgatatgccgtcatccctgtgcaggagttgggaaagaaattgttcctcgcaggcctcttttgtttgtttttttgagacagagtctctctctgtcggggctggagtgcagtggtgccatctcggctcactgcaacctccgccttgtgggttgaagcgattctcctgcctcagcctcctgagtagctgggattacaggtgtgttccatcacgcccagctaattttaatatttttagtagagactgggttttgccatgttggccatgctggtcttgagctcctgacctcaagtgatccacctgcttcagcctcccaaagtgcctggattacaagcatgagcccccaaccccagccagagggctcttcttaaagttataattaacagatggacacgtaacttcaggcttgattaaaaatcctgaaaagggccaggcaccgtggctcacgtctgtaatcccaacactttgggaggcggaggcacaacgatcacttgagcctgggagatcaagaccagcctgggcaacatagcgagaccctgtgtctataaaaattttaaaacaattagctgggtgtggtgcatgcctgtgggcccagctacttaggaggctgaggtgggaggattgcttgggtccaggaggttaaagctgcaataagccgtgattgcagcctccagcctgagtgacagagtgagactctcaaagaaatcctgaaaggaaagtcagcaccttcagtcactttgtgaccggcccagaggaactgcctttgactaaagcagaaactctttatgctttgagaattgactattctcctctaccttttaacagttattggaagtgcagctgaccagatagatcctgcaggatgagtgtccttcattgtctgtgcctcccatttctattcctgtaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggtacctccctcagtgtccaggcgtgtggcaggcccggccatgcagcaaggacaggatccgccttctagtgatgtctcgggtcccagggacgtactggccgtccgtaccaccaggataactctggctataatttagtgttacagtagcactcattcattatagaaaattttggaaaagcaggtaagcagaaaagaagaaaatttgaaatcaccccatcatccagcaataactactggtaacatcttagcatatggccacacagggttttggtatatgcaggtattaacatatctaaacatatcttatttttaatgtactcttttcatatttttaactgcgttttcccctcaaaatgccgacgaagcagtgctgtggctgctgctgtagccttgtggaaattttaaggctgaaaagttaggccaaagaggatcaggtaggggccctgagagacattgcatccaaagacagctgcctcaggacctgtcatcccagggtcacggcgtcattgcgggggtgtctgtctctgtggagaggtggacagactggcctcggtgggatctgagtattcccttttagggtgctggcttgctctgaaggtcatgccacataaatgaatgcaggcacgcgtgaatgaatggacttgtgaagggatggctgttttaattaaaggaggggcttttgtgaggtgtcagctttacgcactccctcttgggtttagagaatccagactgagccccgtggtacgtgccagctgtttgtcatagcccttggtcataaggattgggtggggagtgggtttcttctctccctgcctttgctgagctggcctggctgtggaatgggccctgtgggcagggctgcagcgccctgtgctttcctcctgttttcagcacagaggttccttgcagatgattgaaaatggatgtgctggggcaaggggtcatggggacatgattcttggtctttagcagaggggccagtcctcatgtgccagtacttcctggtactaagaccatttatgttacaataatgatttttggttttgtcttttgtcttcttttttcttaaagaacagttctagatttacagaaaatttgagcaggtaatttagagctccattatatcctttgggacccagtttttctattctcaatagccgatgggagcgtcatggtccatttgtttcatcttttttccttttttttggagacagagtgtggctgtgtcgcccaggctggagtgcagtagtgtgatctcagctcactgcagcctccgcctcccaggtccaagcaactctcgtgcctcagcttcctgagtagctgggattacggatgtgtgccatgatgcccaactaatttttgtatttttagtagagatggggtttcaccacgttggccaggctgggcttgaactcctgccctcaagtgatctgcccgccttggcctcccaagtgttagattacaggcatgagccaccatacccagcccatttattacaattaattaactaatattgatagattattcttacctaaagttttagaaaaggaagctttcttgtggggtctcagaggtattatgccattccatctcatctactgatatctcagctacattgctttttgttatttttaggggattttctagggaataaaatatgcagccttaatttatcactgtctagcttgaattgatatttaacacttcattgtaagaatcttacaacagtatcattccggtggcaaaatcatctttttcttttgatgtcaaatattttatgtatatacctgttgtaaaccctcacaaattcctttttatttttgtttgagacagagtctcattttattgcctaggctggagtgcagtggtatgatctcacctcactgcagtgaggcctctgccccccggatttaagtgattctcctgcctcagccccccaagtagctgggtttacaggcacatgccaccacacccggctaatttttgtatttttagtagagatggggtttcaccatgttggtcaggctggtctcaaactcctgacctcaagtgatctgactgccttggcctcccaaagtgctgggattacaggcgggagccaccgcgcctagtctcaccatttccttttaaaatcacattgtgcgggtcgcctggcaacagatgatttctgtctacatctgaaaaatctatagtttttttttttttttagtaaatattttagaacagatttcaattttcagaaaaattttaaagatagtacagcgttgccatctactccaacacccagcttcccttatgattgaaaccttatggccgggtgcagtggctcacgcttgtaatcccagcactttgagaggccaaggtgggcggatcacctgaggtcaggagttcaagaccagcctggccagcacggtgaaaccccatctctaataaaaatacaaaaattagccagatgtggtggtgtgcacctgtaatcccagctgctcaggaggctgaggcaggagaattgcttgaacccgggaggcggaggttgtggtgagctgagatcgcgccattgcactctagcttgggcaacaagagtgaaactcgtctcaaaaaaaaaaaaaaagaaatgttagtatattacattggttacagttaatcaaccggtatggatatattattcttaacacaagtctattcaggtttccttagtttttacctcatgtcctttttctctcccagcatcccacatgacatttagttgtcctggccccttagctcctcttggctgtgacagtttctcagactttccttgtttttgatgaccgggaagatttttttttttgaaatggggttttgctcttgttgcccacgctggagtgcagtggtgtgatttcagctcactgcaacctccgcctcccgggttcaagcaattctcttgccttcagtctctcgagtagctgggattacaggtatgtgccaccatgcctggctaattttgtatttttaatagagacagagtttctccatgtcggtcaggctgatcttaaactcccggcctcgtgtgatctgcctgcctcggcctcccaaagtgctgggattataggcatgagctaccgcacccagcctgacctggaaggtttttatgtttgtttagagtcaggatcttcttccgtctccaggttggggtgcattggtgctatcagggttcgctgcagccttgacctcctgggctcaagtgatctaccacatcagccccctgtagctagggccacaggcacatgccaccatgcctggctaactttaaaaaaattattttttttgccaggcatggtggctcacgcctgtaatcctagcactttgggaggccgtggcgggcagattgtctgagctcaggagttcaagaccagcctgggcaacgtggtgaaaccctgtctctgctgaaaatacaaaagaaattagctgggtgtggcagcgtgtgccggtagtcccagctactcgggaggctgaggcaggagaattgcttgaactcgggaggcggaaggtgcagtgagcggagatcacaccactgcactccagcactctagcctgcgtgacagagcgagaaatttttttttttttttttttgtagaggcagggtcttgctttgtggcccaggctggtgtcaaactcctgggctcaagcaattttcccaccttgaccttccaaagtgctgggattacagatgtgagctgttgtgtccagccctatgttttcttctagaggttttatagctttagctcttatatttagatctatgatccatttcaagttaatttttgtgtatggtgtgaggtagggcttgaggtttatgttttgtttatgggtgtacagttgtttcagtactatctgttaatagacctatcatcccccattgaattaccttggaatctttgtcaaaaatcaagtaatacactctctgtgcatctctgttcctgtgctctgtttggttctttcatccatgtgtcgatccttaaatgcccacatcgcactgtcttaattattgtagctttataggaagtcttaaaattaggtattttaaattctccaacttcgttcttcaaaatattttgaaaattttctaagttctttgtatttccatatacattttagaatcggcttgtcattttctacaaaacctgtgaggatttagactgggattgcagtgcagatcagtttgggaaaaaataaaaataaattgaaaataggagctattagttgcattttttcctttaccttggtctaacattaacctttcccttaaggactctatttaagtttctgatgtattaaacacttaaatgaaacttatatttaatgactgatatcaactagatactaattttaagtagttttttattcataattattacatgatctacaataaatgaatcaggctggattttggactattcaaaccggcacctcagaaataattgcccagaagcctcttggtgccatgtttcttgttggctgctggggcccgtgaaacatgcacacatgtgtgcactgcagtaactggtggtgatgtggttttggcacccattctgcctgtgctgcctacaatgggaaggctgacagctggccagtctccctggcctgctgcttgctgtggattatttgctgagtggcactgaccacccttgctttgccaatggagacagcactggcgcctggtgctagtgggctcccatggctcctgcaggctgtcctggagaggaagtctttagaaaggaacttcctagaaggaagttcagaaaactgtttctgagggcctttgtcccaattcatagatgtggaggcttggagtgagctcttttatttaaggtggtctgcacatcatagcagagcaagctggggctgtggctacattatgggcatgttgagcgaggatctgcagatgggagtctgactgggctttgaggaaggaggagcccatggtcagtaaggccttgtgtgttcaccagcgcgttggtctgtattgtgattcaggctgctatagccgaataccttagactgggcaatttataaacaacagaaccctattgcttacagttctagaggctgggaggtccaagagcaaggggccagcagattgggcatctggcgagggccctttgactcaggcagtgcctcttgcatcttcatacagaaggtggaaggggcaggcaagctccctcaagcctgttttctaagggccctactcccattcatgagagtggagccgtcgtgacttgatcacctccccaaggcccccctcccagtgccatccccttgggacttaggtcttaatatatggatttgggtgacactggcactcagagcagagcagctgcaacaggataggccagatagaggctccaacgcaagggctctgccttcccgcaggagaggcgtctgtgcccgctgttcccatggtggtagggtgggagtaggtgccgcgtgcagagctgcgttcccaacacctgcttcctggtgtcctcagtcagatcattctgctggattgagagagccaccagaggggatcactgttccccagaaccacagccagggagaaggcgtgggggccacatcttgatggtgggagagctgtgcttttcctaattgctggtgtaatattttcttttcggaatggtttttaacaaacaaagcaactttctgctgtcccttcctgttttctctggtgaggccaagctgctatgactagaattagtcttttcgttttttctttttttttttttgagatggagtctcactctgtcacccaggctggagtgcagtggcgcaatctcagttcactgcagtctctgcctcctgggttcactgggctcaagcaattttcctgcctcagcctccgagtagctggaaccacaggtgctcgccatcatgcctggctaatttcttttttagtagagatggggttttaccatgttggccaggctggtcttgaactcctggcctcaagtgatccgcctgccttggcctcccatagtgctgggattacaggcatgaaccatcactcccggcccctagaattagtcttttctgatgagcatctggtgctacctggctgggccctgtctggccaatgtcattgacaccacttgagtccctgggactgctggtgcactcacccggctccccaggtgctgggggcttggcacttagtgcgtctctctcctcaggatactggtatcgggatgacacaggaagagctggtgtccaacctggggacgattgccagatcggggtcaaaggtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtagagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcgggtggatcacgaggtcaggagatggagaccatcctggctaacacggtgaaaccccgtctctactaaaaatacaaaaattagctgggcgtggtggtggtacctgtcatcccagctactcgggagactgaggcgggagaatcacttgaacccgggaggcagaggttgcagtgagctgagatcacgccaccgcactccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatgggtgagtgacgaatgtcgcctgacaggcagctcaaagctgagctggagcccttagcatggagtttggaaagggatggactcagaaaacgtacacaggcattttctgggctttttatatgaaatctgactctcccattttggggagttagtgacttttgtggctccaggtggcctatggcacctgtctggtcccatgtggttggtcaccaccactgcgctcgggaaggcaggtccggcccgcgctgagctcctttctcagtggctgagctgcaggactggcctgtcgcctggtggacactatgcagcctcctgtgaccgaccttctgcaagagctcattctgcttcctcccagccctggcatttcctggctttgtctccccagcccacttctgcctctatagggtgaggagcctgctgggggctttttttttttttttttcctttgggacggagttttactcttgttgcctaggctggagtgcaatggcacaatcttggctcactgccacctccgcctcccaggttcaagcaattggcctgcctcagcctcctgagtagctgggactacaggcgcatgccaccacgcccagctaattttgtatttttagtagagacagggtttctccatgttggtcagactggtctcgaaccccgacctcaggtgatctgcccgtcttggcctcccaaagtgctgggattatagacgtgagccaccacgcctggctccgagggctttttagcaggtgagccgcttccagccagccgaggcgtcctccctccgtgatgccatttctgctccacagtgtgtgcactgtgctcagcttgactccccactctcccaaaactaacattcctgtttaattccatgggagcggggctcagagtaaacttaggccaaggcatcaacatggccctgccgggggattcccccctcctgtgcttcggagatggttttctgctcttcttagggggcgcctgtccccctggcctttgtttttgcccctgggcatctggcacccgatttggagctgggccagtcccccaccgtgccccagacctgcttttggggtaagcccagaagcttcttcgaagcccagggtcggtggaggacccccgcccccccgccccccgcccgagggaaccaggagaactctgccgcctgcgacaggctcatcgttcctgatgggcatgtgatggcctgagtggtgcgctggggtcagaaatggggcatttgaggtgtgttgtgtgttgtttgggctctgcctatgaaaccctcgggaaccgctggagtcccatgcagggtatgtcccagtgtcacatccacctggcttttcctttccttgcctgccttagttctggagtgtttgaaatcgccgaagcttcgggagttagaaccgggacaaaaatcatcatccacctgaaatccgactgcaaggagttttccagcgaggcccgggtgcgaggtgagcgggagcccgggcccaggctcactctgggatccatgtgtggcctggaggccaccaggtcagcaggcattttccctggttctacctgcacgtagggtgcacaggcagagccgtgaagggccgagccgctgcgggactgggaggggggctgcccgccagggctgcgtagcatcgagctcctgctgggactgggaggaagctggcctggctgaggcggacctcctcctccttcctctgcgtggcccttggcctttagtgcacctgggggtttggcgcagtcctgtcccaggatgtgggcgtggccttccctctttgtgtcctgctggacactcagggaggccctgagtacccccaggagtcagcccagaaagccatgttccagccacaagctgacattgcagtctcgcagcagccggggcctccacagctctggttctcacgtgggctccgctgctgcccccgtgagactggggggaggacaggtgtccccactgtgccctgtttctgtacctgtgaagtgtacacagcatggaggacccttcccagcaggctggcgctcatcctggagctgctgcaaagcttgcgtttccacaagcattgtagatgcagtgtggtttttcttttgtcccttccagatgtggtaacgaagtacagcaacttcgtcagcttccccttgtacttgaatggaaggcggatgaacaccttgcaggtgagccctgagttcctctagggactggtcaaacatggagacaaatctgtacgtttcagggcagcggagaagagatgagcccaggggatgcggcccagagtcacagggcgagctgctctgtggagatgagacctgggtgtggggatgagacaggggcccagctctaccacagccctgcccctgtgcaccgggcagccggggtcaggggtcagggttcactgaggcgtaacgcccatcccagctggctcaccacatcagtgtgcagccatggtgttcagtgcagccacagagctgtgcagccaccccgcatcaattccagaacatcccatcaccccaaaaagcagccctttccccactgcccctcccccagtcccagcagccacggtctcctttctgtccattgtgctgcctgttccagacgtttctcctggatggagtcacacggcatgctgtcctcagtgactgacttccccctcgcggctcagctgcggtgcagcgtgggtcgtcatcgctctcacggcccacactgtattcgtcagctcgcccctgctgggcagcgtcatcctctcccacaggccccctcaggtcccggctggtcctcctgacatgttgtcctgaggagctcctgccccagagccttgtgtgtctcccctgcactacccggcatagcccagcggtggggctggagaggggtctacgcctgagaccaccgcccgtctgtcccaggagcctgtccagggccaggcgctgcactggctcaggcctgcacggtggtggagaagacgtgcgtggtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatggtgaggcactgtggcagtcccacggccctcagggtgactctgttgtcccctgtggcatcagctctgcagatgtcacatgattaacatggcagtgtgagggcatgaaaaacataggtagtgctgggtgtggtggctcacgcctgttatcccagcactttgggaggctgaggagggtggatcacctgagcccaggagttgcagaccaggctggccaacatagtgagaccccatctctgaaaaaaaagaaaaaaagaacagatgcctctgggtgggtaaccacagaggtttcctctgtctcaggggtcacacatggcgagggaaggattgatgggcatctcagtgcaggctggggtggaggcttgtggactggggtgtgcctggggagggccctcagagcctacatcatctgctgtggatcagtggatgctgtcctgccaggcgctctgggaagggcctgtggtctgcctctccgttggcctctctgtgtgcttcctccacaccctccaactcccctggtttcctttaccacattgaagttcccgcaaatcctgccgtaaggagacctattcggggctgagagccagcccgtcctgcccccaggctcttctgtccttggctgcctggaaactctcctaatgtcctgcacagctggcatccatcttggaaagagccagccaggtgtggcctccaggggcttgttagagtctcaggccccacccagggctcctgcgtgggagcccacattttaatatctccccgcattttaaccggatcccccccattttaaccaggtcgccccacattttaaccaggtctcccaacatttgaactagatacccgccgcattttaaccagatcccgtgatgaggtgtgggtcccggttcgggaagtaccagtgtggagcaggtgttggcaggcacgttccacgagggccagacaggagctggtcccagcgtttcgggcccggtgtctttcgtagccactaaccctgccgggtgaggaagcagcactgccctgctgccctctgagcacacagggccgggtcccatgagctgcgtagacactgaaatttgagtttcatcttcacttctcatgagatcatcctttttgaaatctttcctcaactgtttgaaagtgtaaaaaccactcttaggctacacagaggtaggcagtgagctggatctggtcggagggctctttgctgatccctgacctgtagcaaggtttggctgtgttcagtgtgttcaggggtacgtgcaaggttcactctcttgtgtcctccttaggggctgggctggggagggcggcagctgccagagaaggccttcagcccctgcagagccacagtgtggggcatcgtggggcccctgcactgggcttcaactcagagcagacgctgggggagggcgaggcgggagtgggctctggattcatcgtgtccgcccccacctcccagccagggcctgcctggggagggtcagtgctgcatgatggcgtgttctcctcacccccagaaaccgtccatgtttgatgtgagccgggagctgggctccagcgttgcactgtacagccgcaaagtcctcatccagaccaaggccacggacatcctgcccaagtggctgcgcttcatccgaggtacgctgctcagagtccgtgagcagtgcccccgtggcccagtgtcgcccgctgcatctgtgagggaccgtgctgattccattctcagcagccctctgcagcgagagcaccgccgtcggcctgcgctgcctgtgtgtcagtcgcgtttacagaccccgggagctgccccacctccctacgcacatgactgatctggggggagcactggggtgttcagattgaggtctttccatatgtagggatactgagtttcagattgatatgtgagttgtgttacgtttgagtgagattatagtttaagaaagacttcagtatttaagccttggtacacagaggtgcgaaccatccctgatagagttttgtttgtttgttttttgagacgagtcttgctctgtcacccaggctggagtgcggtggtgcaatcgtggctcactgcaacctccttaagtgattctcctgccttagcctcccgagtagctgggattacaggcgcccgccaccacacccggctaatttttgtatttttagtagagatggggtttcaccataattgccgggctggtctcgaactcctgacctcatgatccgcccacctcggcctcccaaagcgctgggattacaggcgtcagacactgtgcccagccagagttgtgatttttaacataaagcccaggctgtcattttccgagtgttaccccgaggctgtcccggccacccacagcccaggtcactgttctgggaggtggcaggacgtagaggaagctccggcagtgccgcctccctgcttccctcttagcacacgtgctgggttgaaggccaggcctgaagacaaagggcaggttaatggggaatgttgggtggtgtggagggccgcagccccgggagaagctgactgccgtgtctcccaggtgtggtggacagtgaggacattcccctgaacctcagccgggagctgctgcaggagagcgcactcatcaggtgagcctcgggccgcggggagaggaccctgctggggacaaggcccctacctgctcctttgcccccagagggccctagccgtggcccatggagctgagagcagaggtggtcggggaagcccggcctgcacatgggggccctcaggagccttccaggtgctggcctggcctctgaagcttgtggtccagaagaaggtgggggtggctggtcatggctgaggctggagtctggatagggggaggggccgcagagccagacctgcccacctgtgccccagggttgtgactgcagccctgcagcaggccagccctgtgtggaggggactccagtgtgctggctccaggttctccatcagtagctatcacttccccactctggccccaggctcaccaaatagtctttattcaaaacctcgcttactggctttttttcccctaatgcaagtagtatttccttactagagcacattcaagtgacctgtgctctcacctagagatgactgctgttgatggtttagggtggggtagattggcagccacatagggcaggtttcagagggagcctgtggggtgaggattcagctggaatttggagccctggaggtctctcaagagcccaccacgtgcagcatgccatggaacgggccttgttggagcccccaacgtgcctgcagtgtttctctgcccaccggtttctctccagtgttgaaatggaagcagatcctcggaaaaaggatgagtctgggtaattggtgtgtgttggggctgcgctgtgggcatggcgagaggcccacaccgagaggcactggtcctcagagattctgtcctgtgccgcgggcaggagcaggtctggggagatggtgggcagtgtggtttcctgcctggtgggtccatgcccagccctgcgaggtcacatggcctgccggtgatatcctcctgcctcaccttcagaggcagaaagccatggagatttttttcttttttcaaccaagcaagccgcagtgatgttttattggttgactgatagggtctttcttgttgtccaggttggaatgcagtggtgtgatcacagctcactgcagcctcaacctcttgggctcaagcaatccttccacctcagcctcccaagtagctgggactacaagtgtgagctaccatgcctggctaatttttttgtatttttttgtagagttgggatctcactatgttgcccaggctgatcttgaactcctgggctcaagcgatcctttggcctcagcctcccaaagtgctgggattccaggcatgagccactgcacctggccacttagatttttttttttttttttttttttttttttgagacggagtcttgctctgtcgcccaggctggagtgcagtggcgcagtctcggctcactgcaaccttcgcctcctaggttcacgccattctcctgtctcagcctcccgtctcagctgggactacaggtgcctgccaccatgcccggctgattttttatatctttagtagagacagggtttcaccgtgttagccaggatggtctcgatctcctgacttcgtgatccgcctgccttggcctcccaaagtgctgggattacgggtttgagccactgcgcccggcctgtttttgtttttcatgcaattgaattcatattgcttatactgtttccttttttctacctagtttatttgcaccacttcccatgttgttttttggaagcacttttaattgctacatcatgggacatcacagggatgtaccatagtttactgatcccgtccctcggggctgcacagctgggctgtctcagtgtttctgcagttatgacactgcagtgcatgtttatctttgttctgaaatcttttttttttttttttttttttttttttgagacggagtcttggtctgttgcccaggctggagtgcagtggcacgatctcggctcactgcaagctccgcctcccgggttcatgccattctcctgtctcagcctcccgagtagctgggatacaggcacccaccaccacgcccagctaattttttgtatatttagtagagacagggtttcactgtgttagccgggatggtcttgatctcctgaccttgtgatctgcctgcctcggcctcccaaagttctgggattacaggtgtgagccaccgcgcctggcctgttctgaaatctttacctgcagctgtatttccttaggatagaatactaggggtggggttacttggtcggaagatataactatataaaaggtattttccttgctgactaaagagatgttatataatcaatgaaaagggggcctcagtgcttgtttccccacacagccgtgctggcttctgacagcaggaccccgacttgctgccgacatgaccacagggcagcagttgtgctgacctcaacaggatgcatccccgccccacagcagcgactgttctgtggtcgttagagtcgtgctctttggtgtactgaccctgtgcacttcgagtgcgcctgtgggttactggtgatctgcccaatgtttcagttcacttcagtgaagagagggcttggggctgactcccggattattattgctggtgctggagttgtccccaccttgtccatccccatcaccctgcccaggagtggccacaggaggggaggttccaggtacaatgtccctgggctggataaggcaaaggacacccactgaactgaggacacgtctggcctcatctgggaagctcacggatgaagtggaggcaggggccaggccctgtggagagggagctcctggcgtccctgcgggccgaggcggctgcgttcctctccccatcctgaatgtgtttcctgagtatttcttctccactgagaactgtgctgagcctgcataaacacgtgtttcatcctgtgaggggagccgtgagtcctcactcatagttgtggaaactgagtcacagaggggtggtcctgctcagtaagggagctgcattcctggctgtggcaggcatgctggcccactggtagtgcccgaagctgcagagcaggggtcctcatcccagcttgtggttgtcaaaggttgcgttgtcagtctgagaactcatctcgatcagaaaagagtcagccgaaattagagcttttgaaagaatcacaggcttaaaagttggaagcatggtaccaagaacatgtttttcctcgaatcctgtgagaggaagttgccttctcgatgcctttggggtgcatttccaacaaacaaggatgtccttccctttgtaattaacagatgttataggtattttgaagctatgtaaatgtcacattcttcatgaaactctcaatacattcatttatttacttaaaatatttatgtgttggccgggcgcggtggctcacgcctgtaatcccagcactttgggaggccgaggcaggcagatcacctgaggtcaggagttcgagaccagcctagccaacatggtaaaaccccgtctctacttaaaaaatagaaaaattaggctgggcgcaatggctcactcctgtaatcccagcactttgggaggccgaggcgggtggatcacgaggtcaggagttaccagcctgccaagatggtgaaaccccatctctactaaaaacacaaaattttagccagtcgtggtggcaggcaggtgtaatcccagccactcgggaggctgaggcagagaattgcttgaacctgggaggtggagattgcagtgcgccaaaatcacgccactgcactccagcctgggcgacagagcgagactcatctcaaaaaaaaaaaaaaaaaaaaaatcagccgggtatggtggcaggtgcctgtaatcccagctacttgggaggctgaggcaggagaattgcttgaacccgggaggcagaggttgcagtgagccgagatcacgccactgcactccagcctgggggacaagagcaagacttcgtcggatggaaaaaaaaaaaaaaattgatgtgttatatttatactatttataatttatttatatgggctgatttcctgttttattcaagagtttataatcttgctatcattaataaaatttttttatttttatttatttatttatttatttatttttgagatggagtcttactctgttgctcaggctggagtgcagtggcgaggtattggctcaccgaaacctctgcctcccggattcaagcgattctcctgcctcagcctttcaagtagctgggactacagtcacccaccaccatgccctggtaattttttgtatttttagtagagacgggggcttaccatgttgaccaggctggtctcaaactcctgacctctggtgatccgcccgcctcagcctcccaaagtggtgcgattacaggcaggagccaccatgccccgttgattattcttagcacggttacccatttgaccaatccccctccatgtaaccaatctaccattgccactgccctcttctgcgggtgtccctgtcacctacttgggctctgactcttcacggtgggctggtcacgcccccagcctggacacccttctctggggttcttgggctctgacacccataccaggctcttcccaaccatggccctgcatagacaccttccctgggctctgcaccgcatcctgggctactgtccccccgctcccaggcacgaaggcatgtcctgtcccattctgccctgtggctgaaggactgagtcactggggatggagtgtgggaggaaaggctctaaatgaactcgagagagtgttgttcccatgctctggattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggtataggagctgtgttccaggcctttttctgggccaccttgtccctggggctgctgaggaagctggtggaggtgtcccctgatgtggcgacggtgcagctgggtaccctggctgctgctgctgctgccaccagggtcaggaaatggaaggccaggcttctgggcctctggcaccttccaggcacatccttaccctcccaccagtgctgtgctgtgctctgaagggctcagcctcactgctgtgtgaaggtgcagcccagggagtggcaggaagagggcgtgcacacactgtctcccctcagaggatgttgggggctggggagccacagacaggtgggacaagccaaggactccgatcccgtgggtggggaagtgggtggtctcagtgtctgttgagggactattcatcatgtactggatatcagtctccaaatactatgctacaggggccagtcgttcagttaatccaatagtggatggctgaaaaacgaaacatttgttccataaacattttttgtccattttttattgagatacaacttacatagcatcagattcacagaattcaccttttaacacgtaaaattcagtggcatttagtgcattcacagtgtggtgtggctgcctccactgtaaccccagaacatttcatcccaggagcccatcccgtgctggtgtcccttctccccagcagcaggaggagggtgaccacgtgtgtggggtcccaaggaggccgtgttctggttgtttgccgacttcggcagcttctgacacaggcctcttcattctcctttatcttcatttgagttaacagcacacaggtaagagtcagagacatttctaggtctttgtaggtgtgcacgtgtgacatgtcttatcaatgcagacccaccatgtgtgcaggggtggcctgggccctgctggttgggtgtccagctccttgcttttccctctttctgttttccccctgcgtccttccagctgcagctcccatgagctctagaggtcacagctgcgttcagctgatggggaggagggcaaacccctcccctaagggcccttctccaaatcccactgaaacccactgggcaaagccagtctctgccatagccagctgtgaggagggccgggaaccgtggacttcacccgtgtccgtgtgcccaccagagactgactctgtcactgagggcagagggaagacgctgggtccaggccgggctctgctgttgggtggggtcccctcccagggcgtggtgcgcgtagctccctggagagcccctgggccacctggggcaggaggtgcttcctaagcccccagagctcccaaaaggggcctgatgggcagagcaaggcctgctctcggacaacccccgagtccactaccgtccctcgggtcagggccagcctggagtgccaggaggccatgggcatcggagggtttgcgcccagttagttgggcaacattgagcccatgggcctggaataagtggtgacctgccccgtcccttctaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccaggtcggcatcccctgctctctaggcgtggggctggtttccactccccgcacgcctctcctgccccgcagcgagggcttcctttgggttttcgtcagttgacctgggctcagccacccccgagaagagccttgtgggagcaccctggtgactggaggaaggtgcctcctggtttagatatcaggggtctgtccagtgctcctgccacggtggcttctggagctggcccagcttcttgagaggctgtgtatttttttaaagccctaaccaagttgtatgggcctcaggcaacctgaagcatcctttgaggttttacttttagatgaaaagcatcttgctagcttgtgtctccatcctggtgggagaggaggtgggagctggaagcatgctgcgtggcccccatggaagccggggagttgggatgcaggcctgagctccctgtcgcctgctcttccgcagccgccgagtgcctatcagagaaggagacggaggagctcatggcctggatgagaaatgtgctggggtcgcgtgtcaccaacgtgaaggtgaggctttcccggggatggaccaccacttggccgcagtgtccctaacaggctggccagctggtggctcccagtacctggcccgttgggtgtccttccagcagcagcagaagcccttggtgtcaggtggagaccctgtgggtccctgctcggcacgtgttgctcgggagtgccgctgaggcaggaaggccgtgtctttctcccagccctgctccagagcaggtgtgaactgagaactgaaaaaccagcatcctgagtgggagctgcaatggctgaggacgtgggggttccaaacaagggacatgctaccccagccctcaggagctcacatgctcacttgggtgcttagtcgggggttttgggtgggcttcagagagctaagactccccccaccaacctgtctagctcagagtgagaaatgagcgtcccatgcatggtcacttggaggaaggggcctcatgcagggtgggctggcatggagcagaggacgatggattcgggcagctcctggaggcagcagcggggcaccagggtggtggagcccctcgggcacagtatctttgcgtggggcatcagctcagggcccacaagttagtgggtaatggggagggagcagcgctggtccaggggagtccttgagaccccgcctgctacctcgtggtctgggtgaccttcacccctggtaagatcctgccagccctctcacattgggaacctctatcaccctcaaccccgggctttgctcacaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggtgaggccacgctcctggctcttccagcctgtgggattccccagaatcctgtgtgtggtgttcttttgttgtggaatgtgacacagaagaaaagtgcgtgaggcctgtggacatgtgggtaactataaggagctgtatgcagtttaggctgcacccatgtgaaatggaacctggccagccccttaccatccccaggtgtcacctgggaggttagccacatcccagcctgtgaccatgtcctcgttttgctttatggctttgccacctgtgcgtgtcctggacatgctcagttttgcctgttttgagctttgtacgtggatcttggtgtttgctgaagtctcacgttgctcacttggcatgagggttgcccatgcagaggggctgccacaagttcattttcatagccgaataatgtccgctgcagaaacccacctcggcacagcagactgctccgttctgctctgctgggcctccggtggttcttggtcagaagttgtggagagccaggctgctctgagtattcttgtccacgtgtctggggcttgtgtgggtttctctgtggccccggtggtgggagctgcttccagggtgcaccgagaaccccccagccctgacagtggctgagccgtaagatttccctcgtttcttcctgttgttctttatatgccctttatctgttgtaaatgtcttttcacctgcctttaggtatcttttgagtttctttctttttacagtatcacttctttgcacccatgaatgtgatctatttaggtctttaacatcctttggtaccttacattctctgtagggttctggtaccatttttaaagaattattctttgatgtgtcttatggggtattttaaaatttcattttctaacttgtatatgaactaacttgtatatgaagtttcttttttgggggaaattttgaatgtagcaattttttaaaaaatgaagttacataaacatgttaccaaaaatagaaaacagcaaaaaggaaatcaaaatccatagacttaccaccccccccacaatgtagcctaagtagtattttaatttttgagacagggtctcactctgtcccccaggttggagtgcagtggggcaatctcagctcactgcaacttctacctcctggcctcaaacaatccacctgccttagcctcccgaagtgctgggattacaagtgtgggctaccacccccagccagtttttgttttgttctttagtacatgtctagtttttttcttttgtcattttacaaccataacttttaaaattatactggaggcgagggagatgcatcttcctagccatggcactcctggggaaaggctgacttggcttatggctgtcagtgcacagcagcgccagtatgcagaatgcctgtgcctctgctggagcagctcagtgaggcggacaccaggtcactttaactagttttggtgccaaactagttttgtgagatagctgcagaagtgctcgtttctgtctgttgccacttcacttttggagacagggtcttgctctgtcacctaggctggagtgtaccagtggcgccatcagagctcactgcagccttggcctcccaaagtggtgggattacaggcgagagccactgtgcccagccagcttcactttcatttgttttaaaatttggtgttctgtccacatagttcagaattcaaaactgcttacaggggaaaatttcctcctacctgtgtccccagtgcagccagcattagggcttttgtatttctgcagagattatgtgcatttgtgggcagctgcgcccgtgggcttccaagggggaacttgctgtgcagtgggtccttgccttgcttttctcccttagggtaactaggtgacctccacattagcatattaagaatgtcctttttttccagctacgtagactagaaatgtgaggatgtgcatttgaagtgtttcctctgttaggttgggtgcggtgcctcacgcctgtaatcccaacattttgggaggcctaggcgggtggatcacttgaggtcaggagttcgagacctcatctctactaaaaatacaaaaactagctgggggtggtggtgggtgcctgtaatcccagttacttgggaggctgaggcaagagaacctcttgaaaccaggaggctgcggtgagccaagatcatgccatttcactctagcttgggtgaaggagtgagagtctatctatctatctatctatctatctatctaaaaaaaaaagtgtttaaagggatgcagttaggaaatggaatggctgagtctcagcatatcatccacatgtggttttcccgactccagttgtcctctggagaggttgtacaaatttacagttccccagagccctcggttttatcagacttctaagtgaaaaattataatattcatgttaaggttaaatactacatgatgctttttcctatgcagaaaaaaatattgttctgacgtcaaatatgtcaatcattctttactttttggtttgtggttttgcttggaaaggctttccccttctgagatgatgaaacatttcttccctagaattgtgcttgtcatctttgatccctctggaatttactctggtctaaatggttttctgcatggctcccagtcatcccagtgctgctggatggagtgatctgtctcctccctcttctgtgaaatactgtcctcatcagacactcagtgtccaccctcgttacatggagttgtttgccttccccctttccagacctaaactgttttatttactagagccctataatatgtttcaacatgtgggtcttactcccttctcttttattatttatctaggaaccaaggcatgtcttcacgtactaagctccttttgtccctttagtgtatattaatcttggagtttggctaccttacagcattttctaatactgacactcctgattctcttgggttttctgggtatataatgatattatctataaatgatcattaacataccttatttaaaaaactacagacagtcttactgtgcttctttaaatatcctgataatcccaaaacatgaagggagggtcacagcacgtggtactgagctgctttttctggtgggttctgtgttgcaggcacgcgctcatcaagaagctgaatcagctgcgcgcaagcgagcctggcctggctcagctgctggtggatcaggtgagtgcagcagcttaggatgactgcagggacccaggctaccagccctgccagcctgccttcagggtggaacagcggtttcctctaaaatcctgtctttttgtttgtttgtttgttttttgagatggagtgttgctctgttgccaggctggagtgcagtggcgcgatcttggctcactacaacctctgcctcccgggttcaagcaattcccctgcctcagcctcccgagtagctgggactacaggcatgcgcctggctaattttgtattttagtagagatggggttttcaccatcttggccaggatggtctcaatctcctgacctcgtgagccaccgtgcccagccaaattctgttttaaaaacggaaaaatggccaggcgtggtggctcacgcctgtaatcccagcactttgggaggcggggggatcacctgaggttgcagtgagccgagatcgtgcctctgcactccagcctcggcaacagtgagactctgtctcaaaaaaaaaaaaatgaaaaggtgccccatgcccctcataatgggtttctcctcttgcctttcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcctggaagttaaagggaagagccgagtcgggaacaacggcgcctcggagcagcatccctgcaaccacgatcctgatgggtgttgggaagagaaagtaggttcccctttcacacatgggcctggctcagcacccgcaggaactaaactaagagccctgggacctgccagtgcaggtctgtgggtgcccaaaactgcacaccctggtctgtgcccctcaatgtggaaaccacatgacagcctaggtgtctgcctctcctcttatccccagatgtgcttttccgaaaaaacctaaaaatcgtggctcttgttattctgttccctgtagtggatcaactgaagctcagttgggtgagtgttcaaaggctttgaggcttctgaagcccgacctatgagtcacggctgcccttggaggtgccctcagtctgccctaagcgcgaggccctgctcacctgtcataggcacagtgcgtgggtgtagctgtggtgtcagcgctgtcggggatcagccactggaaggtggggcttgtccacaggcggatggatgaccactgggagggtctcacatagctgcagcccgcattgaagtcgcccatcaacatgacgtcctaccaggaaacgctgcctgtggccctgggacatgcggaggccgctggtgcccactgcccctgggagggcctcacctccaagccccatttctcttggacatccaggtagacgtcatagagagcgtcgatctcggctactgcgtcccccggggccgcatgcaggggaacaatggcaaactccctgacctctgtggagacagccacgtcgtgtgaggcacactccctgggggcaggttcagtcaccatgtcagctggaactatgtatcatgacagtccccccggggggtggatattttccaaatgacttgaatggaaaacccaagccccagggactgggagggcagtgtgtgacacaggcattccaggttccctaggagggggtggaggccataagcgccaagccgagccccaccctggcccaggcagcacccacctgtgaaccgggagaagaacctgacaatggctggctctcggttgaaggtgtcgttcccgcagggctcgcagccatcatcgtagtagtagctgtccaccgcagacacctggtcaggcctgcgggaaggccgggcaggaggaggtgaccccaggctggaagctgccccactcctgcttcccaggaggcaggcgtcgcgtcccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggaccttggggtgttttcactccaccctggaccctgctctgaagcctcaggttcttgccataggacaaactaataggacaaactacttccctgctctgttggggccctcccaggtgagggaggggcttcctggctttctagaccacccacctgtacacgaacaggtagcgctccttatagctgttccgtcccagtggctcactgaccacgtagtgataggtgtctggtgcatccctggattg

SEQ ID NO: 694 - DNA, 18103 bp, Human
atactattgtcatcagtgagtagcttctcctgttgtattcttctgtgtagcacggggctggagctgtggatatttatgaaccccaggcacccacttcctgttttcgtggctgtccccggtccctgcctctgtgccgttttctctgcctttggccaccagatggcgctctggaaacgagttttctgcatcaaagctcccctgcattactctcaactaggctccctccctcttctctgttcccttccaagccattttccagggtgcagccaaaaggcctttctggagggcacatctgtgtgatcttgggcaagttacctaacgctgtgtgctcagcatcttcaatgtgatggtatggctgtgagtgcgtcatgagaggatgtaggtaaagcacttaggacaaggcctggcatgtggtcgctgttctcattatcctgcgtagagcttttcaaaagcactccacgaccttcaggacaaggtctaaattcttagccatgggaacccaggccactgcatcatctgaggacccctgcttatgtcccctgcccaaccttcctccctacactactgcactgaccctcttgcagcacagccaggagccagcctgcccacttcggggcctttgcccattttgcccctgccaccagctttgcctgtctcctgcctattcaacttcctcgggctcactcctccaggtccgtcaggattcagcgtgtgccctccatgaggagcctcccggacccccaggcctgattccagagccattctactggcctctcgcctttcattttccctgcccccacctgcgactgtcagccccttgccttgttcactgtcaggcacacagggggacgattgcggggcggatagtgagactgtcacgtgggctgccagcagggggcaatgggcacccttgtgtccctgagctcccaggggctcctagtagcttaggcagcaccttgcccacaccaagctgagggagacctgagaaatgggattcctgccaaagaggcaaagaaaaaagtgaagggacaaatgcaaggccatctttgccatttgcgtatgaggcataaaacttggaagataataaacagcaaaatcatagtccctatgtgctgagtgctttctctgagccaggccctgtgctgagtccttaccccaccttgtgagatcgatgacagccctcagagaaggaaacagaggctaggagaggttaagtcccttgtgcagtgtctcagagcttgtgagtggcctgtctgtctccagggccatgctgtaggaggtggccctggattcaggccccttgctatggtttaatgggtttcagtgaaatagttgggaaacctcaggagtgggatatggagttaagggaaagaaaagccagagagaaagggaaggagtgcaggtgactgtcccttagccaccccagtcctgatgaccacaggcctccatgccaataagccctgactagtgccacttgggtccaaacatggcatctctggccccaagggcttagtagcaaacacccatctagggaagctggcgttcattctcatcacctcaaatgcttcatgagcctcagggatcaaccttgaagtgggtataaggctgggagaatgttgggggcagcaaactgaagggcacaataagaagcaataaggccacctcaaagcccacccaagcaaactgctcattcacctccttccttcctgaatttcaccttatgaggaggtgagtggaaggtagggtatcccttaaaacatctaaaaggagagttgggggcagcaaaggagatgtgcttcacgggactcttataaacaaaactggggagagaagaattggaggaagggggaaagacacagatgaaagggaggggaaggtgtgggagagggaaacgtataaaagcttccaagaggagtgggaggctgggggttccccagacagagactcagtctggaccagatgcagagaacaatggacttcaaggctggaggggggcagaagggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctatgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggaaacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggctttgagcatgtcgatgctgacggtgatctgcctggctgtactgctgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcaggtacctggggcatgggcagctctttctctggtcactcctggaccaccagaaacagaatcagacacccccataacctgcacagtcctcatgtttcttccttaggctcacctggcactttctgatgctttgggtagcaatggttcagggcacagctttgtgatcggctgaacttagctgtgtgatcctaggcaaattccttactgtctctgggccttagttgtcttatctgtaaattagagatgatagtaagggtatctaccttgtagagttgtccagaggatttgatcaattaattcctataaggcatttatggtgcctcacaagtagacacacagcaaaggtagtgattaagagtataagctttgggcaaggttacctgggttcaaatcctggctccacttcttcctagctctgaaccacagaggaagttaacatctctgttgaagatgtctatgttaacaccacccatcttctaagtttgcctgaaaataaaatgagtgaatgctcttaatgcctgtagaacagtgtccatctgacatgtagtcagtactcagcaaattattactattacttcctcaaagcacttctccatctccactatttgcctgccttcatctcatctgggcaacttccctatgaagaaggccagcataggcatcattgcacccaaacccaggtgttgcaaataatttgtctgagaccccagagctttccggctgggcctgcggatggggcagtggaaattaccttagaacttagcagttaggcagattggagttcagatttcaacacagccacttaggagctgggcaaccttgtacacgtccttcaacatctgagcctcatttcctcatctataaaatggggattatgagaccaaacttaccctgtgtctgcctccttagagtgtgagggctaaatgggatgatgagtgtcaaaatgtctaaggacctgggattttctagacacaagtggggaaacctttccagggatgatgcctgatctcacacccatatctgcttctgtgaacctcagatattttcactgtgccaggctgcccgcccaaggcacacttctgtttggccaggctatcagctcaggtttcctgtgaagcaaaacacagtttccttccctattccctcctcaggaagccacctggagatggcccagctgttctcttaggaatcttgccctgggatcggtgcagacccagaggttgccagagccaaccattcatttatccttccattcatccatccatttatcaggtgctttttggataaactctgtgctgaacactgtgctggctgctggtagacaggacaacagagaataggccctgtgggtgaccccgctgaggtgacagaaagaaaggtgcccatttgggatcaacttgagggtaacaggcaacttgcccaatgctcatatctttccagcagcacatagagtcagatctgagtgtaaattccagccctcccactaatttctgtgtagcccctgtgagcctccaattccacctctgcaaaatggccataatggtatctcttcccttaggctgttgtaagaattaaatgagattatacaccactggacaatcactgtttatcatgggatttattaataagctcatttaaacctcgtaacccaccatatgacctgggtctcattaatatgcactttttttactgttgaggaaactgagtaattttctcagaatgcttaagtaattcctcaaggccacactgatgggaactggggcagggacatatttaggatttgaacctgagtctgactgattcgagtctgggctgtaactgtgaagtgaccctgaatgacagtgctcagcatagggcttggcatgtagggagtcatgtcatgaaaaggcagctgtcacttgagcaaagggtggcaggtatcttaggagggcttctgggcctgggctgggaggtgggatcttccctgaggcaggcaataagaccccgagtctcccaagtcacagtgaaaccccagtcctggccatctcctcttccaactctcctctgaggttgacacttcctacctcaagctgcacagaggggcatggtggacctcctaagggaggaatggggatggacccaggaggaggaagcagtgtttctaggaataacagtgcaaactccttgcttttgcagaggatttttaactttttcaaaccatttaatcgtgacaacactgagaagaaggcgtgtgggtatttctagccccctattagagatgaggaaactgaggtctgaggaggtctaaaaacctgtctaatgctatacaataagctacaaatggccttgaactagaactccgcctcccaggacttgatctgttgcctctcccttccaatggcctatagggtctggccgtgatatctcacccatcccctactccattctccagtctttctgaaactctaccttctcttccagcctttcagtgtgcagtgcttctgcctgaaaacctccccaccccttgcccagaccttcattctctttccacttgccaaactcctatggagcctttgggtctcagcagaggtgcctggcatgtggtatgaactcagtaacatctgttgaaatgaatgaattaacttaatccagtaccacccccctgcttcctccctgctccaagttgggttaggggccctctgctcccacagagcccccattctttccctatgcccagaggcaacccctgtggtaaacactcttcgctgccctgatctccagccagcctccctgtggggctgcctgcaaccttcacatcctgacagatgtgaccacgctgagggcagcagctggggctccttctccttcttactcccatagcaaccaccctgcctggcacttattaagtacttgttgaatgaatgaaaagatgaataaatgaataattcaatgacaccattttgccttctctacaacatagtcttacatctggtcaacaaaaattggccgaatgtccaaatactgctaaaggggaacataactctttaagataatcttcatcaaagtaacaacaaattgatggtcaggaaatgcctttttcaccccatctctcagagtccaccaggtgcaggacactcggaggaatgagtatgaggggacaggcccagagggtcctcttgctctccttcagacactcaggtcctggggtgacatgacagagcaggggacctgcccgcccaggtccctgtctctgtcactgggcaccatcccccatctgatcacacaaacatctgaagccagaggaaagactataaaaagaaagcaccggcattgagggaaacatccggcgaggaagtgtgctgagtcggaattgtgtggagtcaacagatttttcctgtcttgtagcaaatctcccagctgctgtccttgctgcatcagggccaattccagcccaaaccaaaccaccgaggaaataagtacttggccaagccaggaggcagcaggtaagcagcacgtagcccccacaggcatctcaaggcccctactggccgcccctcatcactgcagcctctgtgagtgaggaagggtgagcacaagtcagacaccggtcccctgggagggtgcagcagacagcatccatcctcccaccctgggagttttggtcgtgaggtgactgtattgatagtatttacaggacctagaagtcctgtaggactaactagctgtattgataaataccatcaatacagtagtcaccaaggaaatgacctcatccctgagactgtatttgtcccaattacagaggtgctgtaaattgcctttatatctgtaactgtcacctctctttctcttgacccataaacataatatgaaggctccccactaaagacatggctgtgtgggcgtgtccctttgggcaatcctagaattgaagacaccttaagagaacatcaaatccaacttcttgttacggatggagaaactgaggctctgagtagcttgattcaaaccagctatgtaaacttgagcaagtgagataatctctcaggaccttggtttccccatctgtaaaacagaacccatcccatttcccttgtggtaatggggtgaggatttcataatcaattgtattctaagcccatagcccagcaactgacacatagtaggtgcacacacaatgctaactcctttccccttgaagcaattttgctaaaggtcatgtaacaagtgagtggcaaagctgggaccagctctcagagttcctgactcctgcatcagtgctcttgccctgacaacttacagcttctttttacaaggatggtgagaggtagtgtactgcaggggtgagtccacacactccagggtcacactggcctggatttgaagtcttgctttatctcttaatctatggggaccttgggcaacctgcaaaatcttcacaagtcttggttttctcatttgtacaatgggttgattaaagagaaccccttacaggtgtggaaggtttgaataagacggtgcatggaccttgcatcgcataaggcctgactcagactcactgctcaaaaacattagttgtcattatcacccacacacttgccacctccctgctcatttcttcacagcagcagaaatggctacaggggaacaaaaccaaacaaacagaaggactcctacgccttaaaacccctcaggtagccttcccacctgctgggatgagggtccaggcctgtccccaagtgtctatgggagagagggaccaggatggagacagcaggagactggggtgcaggtagcagattctgagcagctttaggctgcctcactccggctgcaccctccataggtctgctcttctggcctaggatttggcctaaagtagggaggaaggaatgttcagtcactcattcagcacccactgtgtgccacgccctgttctgagcatcagtgagggagcaggcaatgagacaggcaaaaatcccagccttctcctacggacggatggacggctgcactggctccactgaggtttactaaactcctcctgtgtgccaggcaatacctagacatgggaggggcaacgagaatgatatcaatgaactcatcttcacttctgtctgctgagtgcttacaatgtgccaggctctgtggtaggcccctctacctacaacgtctcattttaccctcacaacaccctgtgaggtgggtgttatttattactctcattttacaaatgaggaaacagagtaagaggagggcgggaatcacatgatccaggttggtctgactctagaggccaggctgtgtatccagttccctatatgggtaaatgaatgcaaacatgaatgggcatgaatgaatgaatctatatgggaatgtccctacccatggactggttggtttcttttgcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtagggaccccctggagttaccttgaccctgcttctgccccatggtgtccaagcttcagagttctgctccaatccactgcagggaaaagccattctgtttctgtggaggaacatcagcaacatttaacttcccttgcacccttgcagcctcagaaagtattttaaagaccaggttctactttgattttttttttttttagacagggtcttgctctgtcacccaggctggagtacagtggcatgatcacagcgtgatcacagctcactgcagcattgacctcctgggctcaggtgatcctcccaccttagcctcccaagtagctgggactacaggtgagcaccaccaccacatcccgctaatttttgatttttttttttttttgtagggacagggattcacctgttgcccaggctggtctccaactcctgggctcaagcaatccacccacctcagcctcccaaagtgctggcattagaggcatgagccacctgtaatcaaagccaaagtaggcacctggcctacgttgattattcattttaaaaatcattgtaaaaatagtgaacatgccaggcactggggaagcatcttatgtacatgatctcatttaagcctccaaccaatcccctcaagtagataattattacctcgaatttacagatgagcaaaccgaggctcaaaaaaatcaagtagccttcccagagtcacccagctcaccagtgattgaaggggagccaaaccctgagccagcctgtcctctatggacttcttaccactcattggcgtttggtgtgtttcaataccctttcaccctgggaaccaggtcaactctttaatatgctaacaattgcaatgaaaacaaaaagatttttttgcagagaaataattagctttgacaataaatacataatgtgaacttgaattcaagaatctgctagcgccccccgcccctgctgtggacattggtcagcctcctttggtaacacaccccacggcagaccatccctgtgctgtggttttctatctatgtagttaacactgtttctcatgtgctccatctggctgcagacacactgaaggtatggcagggacttctctttccttggttaaaaaatattgctaatgtttattgggcactttctatgtgctaggccctgttctaagtacctcatgagaaaatcttatgagataggggctattcattatccccatttcataaaggaaaaatgtgagggtcaggggtgtttcataatttgcccaaggttgtgcagctcgtggatggttattaacacaggcagtgtggctgtaaattttagagctgtgttgttcaatgaggtagtcactagcgacaagtggctatttaaatttaagtgaattaaaattaaataaaataaaatattcagttctgccataccagccacatttcaagtgctcactggctatgtatggctgggggatatagctttggattctatctctattggtcagctctggctggaacctgtggggtcagttcccacacggtcctgcttgcccacagcacaaagggtactgaacacaggggcactgtaaggagttgggggtaaggaaagaggaggggcagaaaagcctttgctgctcacaggctggactgccatggggagactgggatcttgctgcttcagatctgcttcagattgcttcagatttgctgcttcggattcagattgccccacttgagaatgcgaccatgataatgttttcctggttgcatgaactcactgaacctcacaacaactccacaagatacgtactactgtctcaccacttcctaagaggaaacgggagcttagagaggttaagccattttcccaaggtcacacacactgcccctaagctgcaaagctgggaaatcaaacccaggttggcccagtgcccacctgcagctagaactggtgggtgatgctgggtgaattcagcatcacttttcagctgttctcatacgccccagtgattttctcattccaagcttcactccttctgaagctctctgacccgtgtaaaaggaaaggcctgattctataacaccaagagttccatccaaccttatagcctcagagtctcaaggaactaaggtttgcatttcccaaatgttgaaggttaatatttatgttcattcaatcattcaacaaacattcactaagtcccaggcatggggctaaacccaaggatccagtagggcaggagcccaacagtgtctcacaagctgcacagtccagaatgcagggcagagattcatttatcagtacaataaatgactacacatacttcggaataacttgttcaaattacataagtaatatttggttaatatagaaaaacatagataaacaaaaagagaatggattgcttctgcccagaggtaatttcagttaacattttgacatatctccttccagtctttcattctgtgcgcagattttaaagtaactcaccttaggcaaacattagataaatgttaagtagatgttgtgcttttttttttttttaatttttttaagacactgtttcttaactccaagacttataatttctttcctctggcttggtctctaccatcaggcctgggactggtttcttgaaacaggattttctgttaaagggatgggaaaagaagggtgactgtggcattgcaaatgtaggggccagttttttgaattcccagccaccaggctgacttgccaccgccactaccccagtccctctcctgggacagcccttggacaggcagcccctccccagcctgactctaggccagggttccagcagcttgagagatgatgttgaggaggatttgaggatctggggccaggtggtaacagtgcagaccttaggtagcctgggaattccagaggccccagctgggcacctggagtatccagggggaggaagggccagctcttcagagagagggtagggtggtgccatcataggcttcaaagtcatcagacctggcatcaaattgaggtttggttgcctagcagatgtgtgacttaacttctttcagcttcagtttcctcatccatcaaatgggaataatactcttgacctcaaaggtttgtgaagttaaatgaaataattatgtaaattgctcatcacgtaagtacctaatatgtggtccctattattatggatgggaaccaaaaaaggcagcgctaagtcaggaactccagccttggcaaagaaaagggattttccctccatcctcagctagtggagccctgaggggagaaggcgccctgaggggtaaaaatcctggatgaaatatagaagacactgagactggaaacacacgcccagattgggaaattcttcagaaaacggcaaatttctacttctaggccttctcctcctcctgctgcttccccacttggttcgcccgggtgtgtcagtcgactgctttcctacccagggagcttccctgtcagggcctcttccttcctgtccccgtctggccactctgtctgtcccctgccatttcccttccctcctttgtccactgcccttgccctgctcattgccccaccctcacccgcctggcccttcccggagcctggccctcactgtgtcccctccttcccccacaggtctggccctggaccggctgagcgcccctgacccggcctggatggcgagactctctttgcccctcaccaccaactaccgtgacaatgtgatctccccggatgctgcagccacggaggagccgaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaaggatggccttcttgggtagcaggagtcagggggctgtaccctgggggtgccaggaaatgctctctgacctatcaataaaggaaaagcagtgattcattctcctgtttgcacctgtcaagagggagaagggaagagtaatagagtggggtttatttgtcatccaatccctggcaagaccgtcacactgggcctggacaggagtggggcaccttggtacacagtaacaggtacacaaatagcagacatgtgtgctcttacccctgttcccctatcactatgttaccaactaatctgcttctcagctgcaaaattagagctaagaaagcacaactatttataaagcatttacatgagccaggcaccaggctttacaataggatttaatttgattttccaacaatcctgggagggaggtattattaaccccatttcacagacacggatatggggcttggagaggtcaagtggctttcccaagatcaagcagggagtagagccagagccaggatttggacccaggctgggccaacaccaaaacccatgccttcaaccttgacaccagcctgccaaccaaagacaggagaagggaaggccctggaggtgagctgttggcagcagtgaacttgctcgagctccctcgggaaacactgttgaaaggaacatttccaaagccatccaggcccgcacctctctacattcccaagcacaaggcaaaaggaacttggatctgaactgatgcagacccgttctttcccaacaagtagctcttcaagtgcggatgtcatctttcccaaccccatttgcgggtaaaccttcctctgtcattgcaggttcaggcttgtgaatcccagaggacgctgtgtgaactgggtctatgaaatcggcactgacagcagccagccttccaggggatgggggagggaagaaacagcagatattttcccaaggttcagctttataattttcttggaaatttccgagcagccaatcagctagcttctaaatagtgtgggtctctcctggacactgcaggcaaaagttcctctatctgctcctctttttgtcctttcttggagctcagtgctcatgttcactgttcaagaaatgggccaatcatactcccaactagggataatgtgcatcatacatacttggaatacagtgtggtatcattattccattttacagatgaagaaaatgaggctccccaaagttatgagtttcaggggcagagtttctcctcacctcactctaggccagagtgatctccttacagaatctgtgattttcaggctggatcacagaactgttgggttctgtgggccagtgagagaaactgggggatatcaagcaggcaggcagggtctccagcctgaccagccaggtgcctgctacaaagcaacacttgatgaatagctgttgaatggatgtatgaatgaataaatgtgtcaataaatgcttcagaggccccttttatccatattggagctccaggtaggacttcattagaaaaaaagactctgtgatgtaaaagcaaagtctgagaaccacagtactggagtagaccatggtgacctcccagttaccagcagattttcagtgcagagcagatgttgggagggtggagagaagagagtgggcagggggagatgacctgaggaagctggagctatagctggcaactggatcactagacacatgggaccattgcatcattctagttcaaaagccctaaatctgtactccttgggcaccctgaatactaggtaaaactttgtgtctagacacttttttaggcagaagatacaaaattctcatcagattctcaaaggaaaccttgacctttaaaaggttacacagcattgctttaagatactatctaaacatccacagacatgggcagttgtcataaagagtctgaactttatctatttcaactcttcattttatagccaagaatatagaaagaaacggcagatgacttgcccaaggccacctggcaggtttgtgggggagagctttccaaattaagacatttaactgagtgcttgctcaaatcaggatttggatctgggatttagtatggtggtctttt

SEQ ID NO: 695 - DNA, 7159 bp, Human
  misc_feature (1)...(7159): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccgcctcccccatgctgccccgcctccccagctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggtgcgtccatgccccatacctgctcccgtcagcactgggtgccacaacctctgtcccttcaggccagggtgaccactgcacatccacacgtggaacttggggctctgtgggtgtccagagcggtcacagggagggagtggctgcagggcaccccagtggtcaggggaggcggccaggtccgccctggagcccagcccggccccagtgcagcctgccaaggcctttgccgtcgccccaggactgccggaaccgctgctgcaactctaccacctgccagctggctgagggggcccagtgtgcgcacggtacctgctgccaggagtgcaaggtgagtgcagcctcccaccagtgacccccagagcccatggctggcaggtgggaagggaccctggggcaccagggaccaggcagcttgcgtggacctgtccccgtggtgagctgttctctgctgggccaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgaagtgggcacagagctggcctggcagggtggctgcaggccttgccagggctaacccgctcctggtcccacaggtgggcaggctgccgaggagtcctgcttctcctatgacatcctaccaggctgcaaggccagccggtacaggtgagcttctgagaccgccctgggcccaggacatgtgctgttcccacagcggggtcagccccagaagggcctctgcaaagggtcctgctcccatgagggtctgctctggacccatggaccccaggctcaagcgcaccgtgttgtgggagggaggtgggtcactgtggctcctgggctccccagcatgctcccaggcaagctggcccacgacctgccgtccatccacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtgagcccctggctcagaggccgcgccaccccccaggcatcccgggcatgttccccacgtgggtgcagatgcgtttctgagcttggcagctgctcgaggccatgggaacagagttctctccgcgcttctagtagagactgaaaggtttccaggggtggggagagacatggttctcagttcatctgatggccgtcaccggcggccacgtgccccaggagggccacttcccaggggctttgggggtaggcagccggcagatgggctgaagcacagccaccttggacgtggtgaccacagcccacccccagcttaccatgcagtttcaagggacgctggcggggcagaggtccagagcggctgcctgagagacgcctcctacccccaggtttgctggaaaggacgttgccaggacttacacgtttacagatccagcaactgctctgcccagtgccacaaccatggggtatgtgtggcctctcgggacagggcccctgcacagaggctgccgctctgagggagccggtgctggggacagctctggacacgggagcctgaggctgggggagcctggcgtgtcctgtccatgggggtctctgtggagcccctgtcggctgaggcccggcctgggtggcctccgtggatggaacctgcatggtcaccgggcagcgggcaggggctacatggagaggcctcgccgtcagcgcatgtgggcagggaccgaggggccctcgggggtggggctggcccggggccctcatgctggaggcacggcccccacggccccttggggtccacaacagggttggccctgagcccagccgtccccgcaggtgtgcaaccacaagcaggagtgccactgccacgcgggctgggccccgccccactgcgcgaagctgctgactgaggtgcacgcaggtaggcctccctggccagcgcaggtggggctggggtccaagctcagagggcccgaacagagcccaggcagaagctgcgggcccgggaagctggtggtgttcacggtgccagtttgctgccacaggcatcgacacacagatataggcagagcctgtctgtccccaggctgatgtgaggaggggagagccctgtcccagagggaggcagtggccgagggcagggcacggccgtgagctgagactccagtgtcctcagcctgtgtcttccagcccctcctcggcccggggccctgaggccacccagcatttcctccccggcggccactgagcatgtggtcgtccagagcatcaggcctcaaaggcacagccgtgcccacagcactgtggcccagggccaccctgccaagctctccaacctgtcactggcaagctgggagtgccagtgtaaggtaccaggtcctccctgaggggtccacagggcacagcctgggggtgctgagaaagaccgtgtctctgggaacctccctggctcctgcctgaggtcgcggcctgcctgcctgatgtggggccgtgtgtcccacagcgtccgggagcctccccgtcctcgtggtggtggttctggtgctcctggcagttgtgctggtcaccctggcaggcatcatcgtctaccgcaaagcccggagccgcatcctgagcaggtgagggtggtgggggctgtgacggagggtggcgagtgcttcccgtgctcagctgccagaggaaggagtgcccagcacgggcccatggtggacggcacggacacccaggctcctctgtgccccgacgtcatgacgccccccggcttgggctgagtttgaagggccttcctggctccactcggccagtgccactctggactccaccttcccctgaggctggggcggggcatggttttggtggccggttgggcttggggcaaatccagagaggcccggtggggtcccccataccctgacccagccccgtgagcaccctgccagtttcctgctgagccctgctctagggacctggacccccacacagcaggagacccccacgcagcaggacacactggccccacagcctccaagcatctcccgcccacctgactggggcccccaggacatggagggggtgtccctgcctcttcagggtccgccccacctcctgggcctgtgtgtctctcatggccacaacctctcgccctgaagcctctcgggtcggctggagctgggagggagagactcggggtgtggtgctggggccccatggccggacactgaccatgcgccctgtgcttcctccccaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctgtaagcaccacccctggcgggttcatgaggccgaaagcagtgcccaggccccatcctgcgaccccaagtgcagcccgaggccagcagagccctttcattaaattcacgcacaggccagcggtggccccgaggcccagagcagctgctgtggtcgccctgctgggaacactgaggctttgggagtgggcacttcccagacccctttgagccatgatagaatctgagcttgaacttaaacttgggggctcccagcccagggaagcttcctggcctccacagagcccatctgaggacagtgtcgagacacaaatgctctccggcccccagctcgggatcacacggctgaggggaggaatggggcggggcctctcatctggggtggggccctgtgggccgcgcagacgcctccagcacacacaagaggcaggaacctcggatcctggagctgggggtgctggaggggcacgggggtcccagctctgacccaggctctcggccctgtctcctccagcctccggtcactgtgtccagcccacccttcccagttcctgtctacacccggcaggcaccaaagcaggtgagcagtggtgattgggcggccaagccgtctgagggtgtccaggccttcctgatgggattggggtctgtgcactgcaccgggggccagggatccccaggtggcccctgctgtacacagaaggctggttagcccgacctcgtgaggacatcagacagaaaggcaggtcagcgaggccacaggaaggcaggagctcagtcctgccctgcgttggagctggtttgggggtcctggctccttctccttccactcagacctgctccgcccaccaagcccctcccagagctgaagctctggcagagaagaggactccctggggccctgcaggacagatgggtgggtgggctcagggcagggacacgttcccttgggtttgggggctttgggggttttggaaagatctctcaaaacccgaatcactggagccctggcatgctgagggttaactcccaggcctccgtgtccccccagggttggggtcctgtccctgcgccctggctcccacctctgggctaaccttggagccctttttggaccccgtgggggcagctcattggcctcagccctgggaaaccgctctggcagtgggtggagaaggacccttgagctcccttcctggggccactgactcagctagggcagcagaaagggccaggctttctctctggggcctggcacggggccccagtggtaccatcgaggtccacttggcattgcgggacattgtgagcagcctctgtcctcagagagggcaggacggtggcgggcaggctggggctggggaggtgcctgtgtgaagaggtcccacggtgcatctccggggaccccctccacagaggttcgtggtcagccctaggactgggctgtgcatggaagacctggggcaggagagcccctgccctctgggttgaggctttttttttgttaacatttaattttgaacaaattttagacttacagaaaagttgcaaaaatagcctagagagtcctgcatgcccttcgcctggcctgctcccgaatggccacagtgtgggcgcgcagccgaggctccacgtcaccgatgcgacccagtcagtaccgcctgctccctctggacgcccttctccagccatggtccccccaggcactcagcccccggcccctctgcctttcctcagcttgccctttggaagtgtggccagcagtgttttcagagtccctcagcctgggtttgtcccgtctttccttgtgtggatgagggccgtgcactgttggcgggggcagcactggacacacccttccccaggcacagcccaggcctggcccacatgcagcttcggtcacgggggatgttgacacagcgcctagttggagcagcgtccacagatttttccttagaaagctcctgtcttctttttatagtgagcagatgcctcagggagataccttgagactctttgaaccttaagcttggacccactagttttggcatccattggtgaatattggctgcaatagttgttctgtgctgtttgcctaatagtgattttctctcttttttttttttgagatggagtctcgttctgtcgcccaggctggagtgcagtggcgcgatctcagctcactgcaatctccgcctctcaggttcatgccattctcctgcctcagcctcccaatgtatctgagactacaggtgcccgcgaccatgcctggctaaatttttgtattttttttttcagtagagacggggtttcactgtgttagccaagatggtcttgatctcttgacctcgtaatctgcctgccttggcctcccaaagtgctgggattacagacgtgagccaccatgcccggccctaatagtgattttctatttctctctttcctttttaactttttatttgaactaacttcagacttgtacgtgagttgcagaaatagtcctagaaggggtctggacaggcaaaatgggggcctgaagggggcagagagatttctggccaaggaagttatggttaccag

SEQ ID NO: 696 - DNA, 82048 bp, Human
  misc_feature (1)...(82048): n = A,T,C or G
ctctgacagctgctaccacctgtggggacccttgatgatgttcacgcagcttttctgagtggcacatgctgttctcttgaatactccttgaggtgaagaagaggccacccctacccctatgcacacacagctcctgctctttcctggggctgcaccctgcttgtatttccaatgcagggatgtcagattccaaagagggctccccaaggcattccagaaggcttcaggccagcacgtcccaaccttttcatgccatgggacccctttggcaggctgctgaaaaccatggggttcttctcagaataagggttttaaatacataaaagaaaccacaagaggttacaaaaaaagccaataatattgaaatgtagctaacaaaatgtttttaaaaatttgtgctagagcaatatatatgcttcattattgacatataatatctggctgattgtctaataactactgttatttgagatacttgcaacaactgtgatgtgatgtaaaaacctatggtttctagtgattactaagtcataaatacttatcctactgctactgtagtttgttgtctacgttcataatggcaaaacgtgctaaatgtcagaggttggtgaaaattaagacgtaaattttttctcatccaagttcacagtactcttgaattaattacctctcctcgggttaagaacccctgcaggataaggttgcccctagggccaacacctcactggagccccgcctcatgtcctggagcaggatccttcatgccacctacacagaactcggacctgtctcttggcccagcagttctccccacaactagttctgaaagtccggggctaggaaagaacggcatcgtcgcctgagctcctggcgccactttaaacaacccatccttgacttgcgtgacttcttccacaagctctcctggtcacctgggcaaaatcctaggtgatctggggacaaggcggaacttcggttttctgatctgcaaaaagaaacacctacctcataggactcttagcatgacttgacgtaatggctggcttgtgtccattatacagcactatcaaggtgtgcgctctgatcatttttgagggttcttaggtgtttgagcacccagcacagtctccacagctctactccccacctgttcgcgccgccttaaggaatccctaaccacctgtccgaaatcaatgactccacgtatccatctcgccgtccccctcacatctcccccaaccccctgcacaccccatcccccgcgatccatcccctcgccttctctccatcacccccactaccctctccctcccccccccaaacctcccccgcccccctacccaccaccccaccaccaccacccccacccactccctcccnnnnnnnnnnnnnnnnnnnncagtctacacagctgtagtccccaagtgttgggcacgccttaagcgctccataaacacctgtagaaatgaatgaatgacgtatgcatctgcacgtgggcccacatctgcaagaacaggctgctcaggccatgaggcccggtgcatcacctgcacttctctttataacgggtagtaaagtctccctcgctctgtgctactcggcaaccacaattctgtccacagagggcggcgcagtggggctgcttcgccgcgagctcgcctccggggctcccacgtcgtggcttccgggcaggtaccgggcagctggagacgccagagccggcgggtaaggtgcgggcggtgcgccgggccgcgggcgcgcaaggaggggcgagagggtggggaggggcggggccggcgtcctcgtcacttgataaaacgcctgcgagtctccagagaacaacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgtgagttcccagaccttcccacccccactggggcgccggcctgcgcgcgagttgaggcgagggcgcgccctgttcccgccggccccggggagtatttggcccgtgggtcgcgcccgggccggccgaggcgcacccagcgcccagcgcgctcggctccccgccctgacccgccccgcgcggcgcctccctccattcagctcgggaaggaggacaacccgagggctaggctgggccccgggagagtttacttttttttctgttttaaacaaagtgctttccgccggttcttccctccgggcgtgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttcccagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggctatttaagccggagagggtattttggcgcttagtcgccttaatcgctatggggttgcattcttcatctgtgctactgaaaaataggctgtagcaacaaaaggtctcccctccccacccaggccttgagttgaactaaggaccttccaggaccaacagaccggagaaagcaaagtgcagccacagtgaagagattttgtgtttaggagaggcgaatgggattttagaactggaggaaacctcttgatttcagcggttaacaactttggaattcgtgaatgttgcagcccctgaattttagtcagtttttttttttttctgataacacctgctaggtgaagcacagaaattagctgggggtggggaggctctaggagggtggtctgaggctatatgcctggccagctgcttatactctgctttctctcagaaataattgttgttaagctgtaaatctgaaatgaaaggttcctgttaactcagttaatagatgacgtttattgtctcggaatacttggtgtgtagaatttgagcttgttagtgcagaaatgattgtgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgcctggcatgggtacttgctgactaaatggtagctgttaatgatcatttaaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatgtttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagccaagttggtccgccgagtgactgaggtcagggtctgagcaccttggactctttaatttctcttaggtagttaagattgagtcattcccagaggtggaaggtatgtgatgatgactgtgggtatatccagcctatgaatcatcactcttagctcttctgggaagagatggatctatatatgatcacagggaagaacctagaagaaggagatctataagagatagtctcatgaagtcattttggatttctgccaaccctcattttcttctttatggggtctctctctctgaccaccactgtcttccagaaatgctccaggcccgcggtctgttctgttctgacccttactaggtttgttcttgacttttctcagacttgtcatgttccatctcttaaaatcatattttctgaactagagatcatctagtccaactgcctctttttacagatgaagaaactgaagctgaaagttcagcttgagcagaatcttaacagaatgtggatttgaatctctgacccatgctcatgccatttttaaatggaaaagccagaaatgttcttcagacctagagaaatcggcaagcatctgaattttggaagtgtactatattgtgttgatttatcaaactgcttcccatatgcataggtcagggctatctatttaaatattggtgcctggactcttactattgactctattccagctggccttggaacaagttctgggtccgtccttctttgcctgcctccaccccattcccttctgaaaaagcccagtgaagtgtggctgtagctagccaagaatcagagctgtattcaggatgtgtacctaagcacttgcttccttgcatttattcactcggagtgccatgtggcccagggccatcttccagggattgctgggtcaccttgaatgctaagagtagagaaaaagccaaaacgggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgagacaaaacagaaaatactgttgtaagcttagatgacagggtcaattgtgcctgaaacactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgcctgctagcacctagcatatgccttgcaaatacaatagagactgatattatacactgagtttaacctgtgacatcaactcttcctgctgagggtggagagagggagaaatccctttctttaaccctttgcccttccttgctcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggtactcgggacttgctgaggtggttggttgttatgaggctggacagagaaggatgactgtggaatagagatctttctgaaagcaacttgacaggggtgtgggggtcaaatggaagtgtgcagtacacgtgtgaagtcacttgtgaattgatagcggcaggtttatttcttcaaggatagtaagggaatcttggatatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagccatgccttctacttagcagcccttcgtagctactaagccatagataaatcccagtgaggtctcagtgttcagagatgagtggacagatgggtgcatagacatgacggggcagtgactgtgagctggatacccatggagggtgggtggtgcagttataggttgggcttactgctaaggaataccacctgtctggtttccaggccttcttagacctctatgaccttgaaagcacccccacacctccatccctaggaggctggataacttgcacaacacccagggcaggtttgaaaacgatttatttttcttagttttttgcttggcactaatgtttgctaggaaggagcttgtggattattgatgacaaaactgcctaaggttggaaagtatgtgggcaaatatggaagtagtgtttccttcacaggtttgttaaactggcatttagatttgcaaacactgatctcttggaattaagttaaaaggctaattgttaattagccctgaactggggcaggtagatgggcctctcaccagtgcaggtccctgtcaactaataacagggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaccactaaacgcaagtcacaaagggcaaaaactcatgacatggagccgtgggtatctgcttgcatgtttatttgccaagcggctagtatattttgcatgtcatacaatctgaaacttacttttttgaaaagccatttcagatatagtataagaaaagcctttgagagaaacatgctttctaagcctgggagtacagaaataaaaataaactttgcaataatttgaaaggggcacactggttagttgaagagtaaggaagcacccagtaatgcctctttacccaagagctctgtttgctttgctcggtgatatcaatgtcactgtggtttcttcattttgaaaaggaagttcatttgtactgaggtggttttaagtgtgtgtgtgtgtgtgtgtgtgtgtgtgtgtatgatgcaaatgataataaacatttcagacccagagggcagaatgtcactgaacctaagccctcctgagccaaataactcctttgtccttgcagaatcaggagcccttctcttcaggatatgctgccattatgataaagcattgtgatgtaaagttaacgagaggatccttatccaagtgaatcacagccaaggggtggaatggttggcctctggtagggatgccccattcagcagcactgagagtttggagttgttctgttctctttccttcttgctgagggtagtaagaaatcctccctaggccccattcccctgatatatcttgcgggtgatggcctcttactggcagtgtgattatgtatgtccctttagaacaaaggtatcgaaacaataaaagttgtgaaatggaaatgtttacaattctacaaggctccagagagattagagataggtaggaaaaaggccattgttttccaatcaaaggtgctgagaacctgttgattggacctaaggaatccagctttgccacgacacaaaacccaagagttttgtttcttttttttttttttttttttttttgttgagacagagtctcactctgtttgcccaagctggagtgtagcgatgcgatttcagctcactgcagccttgacctccttgggcttaggcaatcctcccacctctgcctccccagtagctgggactgcaagtgtgcagcaccacacccagcaatttttttgtgtttttagtagagtcagaatgctaccatgttggccaggctggtctcgaactcctggattcaggcaatcagcctggcttggcctcccaaagtgttgagattacaagcgtgagccaccatgcccagccccaagagttttcaaaaaaggaagagttcaaagaggctcagaaatgatcaagtggacatacagagacataattttaggaaagggatattattaatatttgccagtgagtcctcgttactgctggtgagactaggcccaggtaccgacttaaggcgatactttgaaaaagttgagaggtggcttaaagacctgggtgatgaatgaagaagacctccatgactttacaagtgcaaagagagatgggtctgggcactgctgggccttttagaggctcaaggacagtggccttggggaaggctgaaggagacacctattgaattagatggtgccaaggctgagggaggactttcgggaatcccagactagagaagtgttttaatgccaagaacatgggaaacccatttcagatactgtatcagataagccagcttagaaaagcaccttctaaggcttgccctatatttagaaagggctgctacagaggttaactgagaaggggttgtaggaatgtggagaggcgttgtgaggatcctcattcaggatgatctgggaggtaagctctgagagacaatgatacctctccccaagcttagcagccatgccagaagccagctgagaaggtttttcaatatcatagaatatgtaagctctgtaagctcatttatttctctctgtgtgtgtacatgttttaacccaaaagaaatagggatttttgtctgtattcgaacatgcagggaatgtggtctggacctgccagagaaaccgtggccagctttttggggttttcctatagaaattgttcattcaacagatattcactgagtatttactatgtatttggcactgttctagtgctggggctacagcagcaaacaaaatagacaaaatccctgcctatgttctgatcggggagacaaaccataaacaaaaaggtgtattatgttagatagtaataattaatgcagaagtgttaatgcaagagaggggagaatggttgatgtgatctgcaaaaatataaagtagagagggaacagggagtgcagatggggagggaagtggtcagcagtagggctgcctgggaagactttgctgagaaggtgaagctgcattcctggcagagagaatggcaaacacaaaggccctgaggcagaagcatgttcaggcaaagcagtgagtctccttggaggcagattgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtttttgacctgagcagctggaaggatggagttgtattatggtttggggagagatgtgagagtaatagattttgggggcagggcaggagtatggttttagatatgtcaggtttggagtgtctagacagccaagtgagttatttaggcagttgagtaagcagctgagtcaattaaaaaaattgaatttaaaagcctgaagttcagttggaaaggtttgattggtgatgcaagtagaggagcctctaggttgtgtttagaatgatgaactgatgagggcaccaaggacggggatggaggcctgagccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagattggcaatgtagaagccactggtgaccttgtgagagcactgatggggaggagtgggagcaatgcctaattggagtgggtttgtgagagaacaggagagaaggaattggagaccataggaactcttgaggggttttgctgtagaggggagcagagccatggcaacaactgtaaggggaaatagtgggtttttgtttcgttttgtttaagatgggagaagattatagtgagctggtttgatgaagatgattcagtcaaaaaggaaaagttaatgcaagagaggggagaactgttggtgtgacctcaccaactgagtaggtgagaggacgtaccgtgggggaggtggcctgatgactggagcaagggtagctcatcacagttatgaggaagaaaggtcggatgaggggcacagatgcaggtaggtggctaattatcctggtggaagggcatggggtttttccattgcttctaatttctcagtgaataataataagtcattagccctaagttactcagtagttgtgtaaaagtttgcctcattaggagtaagaacttcactgaggcagatggatgtggatttgaatcccagctcctttacattctattgattttgacattggacaaattacttatcttcattggtcaaatgaaggtactaatagcacctacctcagagggttgtgaacattaaaggtgaggataaagcacttagcagagtgcccggcatatccaatcaacatcagcctttactgttagggtcccttaaagtaaaatatgaacataattccctcacactggggagtttttgtagctctcttatcttttcagtctggtggacagcagaggttaccctttgggggccaggtcaaaggttaagtttccctatggaagactacaactggagggcagtccacaggccgccatgaagtatacattgttttgatgaagacaggaaggggaaatatgggacttggaagaaggaagagaagatggcagcatgtcaaaactctttggcaatctgcagacctttgtgctatatttgagctacagagaaccacgactttttattttgagttcttacaagactcattttaggtgtggagagagctcttcccatgtgggtctgcagctctagaattgggtagtgccttggatggcacagtcctggtgtatcctgcaggctgagtggacaggagggcgttgactgggtgtgtgtgatacagggtggaagccagctccgagaacgcagcaggagagccaaggctgtgcttcctgttcctgctggcctggttgatttgtctttgtaatcctagtcaatgcatccagcgtctcagtgcatatattgaataaaaaatgacgaatggccttgttgaattgtcaggagtgtagaaaatgaggctcaatcagcactttgggttctaaaatactgtcgtttttcaatctcttctttcaagattattggtatagaccttgagggaaatctgagttcaaaaggaaatagaatatctttggaattttgcaaaagtgtgagtcatcaggacttgagcatacattcccctggtgtgctgcaaatcagatatgaaacatcttcctgaggtggcatggtggtggtataaaagcttcattatagtacagaatgaagtgtgtacttatataaaacacaagtcttcgaagacattgcaagcttttggtggttgctttgcactgtgcctctgtacatgttcacctgcctctgtcattcagtgcttttgtgaaaatggctgggaagcattgaccagctcaaccttttctctctagaaggaagactgagacccagaaaagtcaagtgacagctagtcagtggtaatgtgggccctgaaacctagctgcccagtgcccagtccacctgatggtatgccatacacatcttccgtttggtgaaatagcccattcttggagttaaacttgtgccacataaatcttgcccttaatagaacagtatcttgggtttttaaatgtcccctacatagtgggctgggagagatagaaaatacagccactgtcaccccttcccctgcttactagggcactccaaatgaccatagcacattttttcagtggagtctcagaattcttcaggtcaacattggtcagccttcactgttgtgtgggtgtttgcaaataagacagcacctgtttgccctcctggccttgctaaatcccgtgcatatggaaggcaccctataaatgtatgcctgatggatatgagtcctgttggtttgtgagcttcttaagaacaaggctgacatcttgttcagttttggttcaaatctaatacatagaaatggatattcagtaggtatttgttgaactctttgattccccaaatacactaaaggcttttagagaacaggaaccagggtaaacatttctttagaatgatcttttacatgctggtactttgaaaaaaaattgtggtaaaatatacataacataaaatttattttaaccattttaaagtgtatgattcagtattgttaagtatattcacatcatttcttgcccggaaatgatgttgtttcatattatgaggccataaagtattgataagctaaacaaactttaactcaatatatgattgtgctgtatcatttagtactatattctaatgtgtattagtggcaatgaaatttaaagtttaacatatttatggtacaagttgaaatttagtctcttagcttattatgtgtttttccaatccggttaaggactgctatgagttgaattcagcagttgtatacctggcaccaacagcctttgagaaaccaagtaatttaagtttttaattgagtaacagaaaattgcaactaataaaatgcctggctatattagcttatttgtcatttatatgttgttagtactccttaactcttggtagctttaagatgaaaccaagagtggtttcagttgcattctgtgttctgattgaagctgaggcttgatttgtggcttgaagtttgaaaggaagtgcctgtttgttcagggaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccagcactttggaaggctgaggtgggaggaaggcctgagcctaggaactcaaggtgagagtgagctatgattgtgtcactgcactccagcctgggtaacagagtggagacgctgtctctttaaaaaaaaaaaaaaaaaaaaaaaatcaaacctcagtgcataagacacaggtgttttcatctgtgaacgagagtagacacattctagtaatacccaatgtttttgtgaatttctttacaattgaaactattttccacttgtagaagttgggaaggaacttggggaatggcctggaaaggtagaccaccatcctcatttcatagaacaagaaatggagacctaggatttgtcatagtcctgcagccagctacagacagagctgtgcctacaattcccttcttgtcctgagttgtttctgcttcatttcccactagaaccccatcccgccctcacccctaagcagaggtccagctagctaatgtgtctgtttttataaaatgccaccagaagcttaagtacgtcggttcgtgtcccatcaaacttgtccagatctctttctcatcatagagaggtaccatcctgagttgctcagatgataaacatttctccattagaaactaggctcggatttgcctgtggccacaaatccagaagcagctgtgtgttccccatgtttctcaccaacccctgcgtcatgtttctgaataaggagtcctggttaccgccacacccctcattcattgctttagattagatgaaaggcgaggtgcctgactcaggccactgactcactctgcttgggtgaacccagctcctcccggtaggaagtgattgccccaggcaggttgaggagtgcccacagcatccaggactaaagcatttggaccctgcagctatttataaacagcactttacagtgctttcagtctgaatattgggactcccctagaaaggacagattcagtcctttctgaaaggaggatagacgaagggtgaggagttcttgttggatgtattttcatagctgaaaggttcccctgaatgctgtcagtgccatggatgttcatagggaaggttagagttcctgtctctgatgtcattcattttatgctgcagctcacttgactgtgggactccctaggaaagcttatctaccttttcagctgttgcacctcttttcttccatgtagtttgccctctgccttacattcactcttcattgtaatgccccagttgccagcacagtgcctggcgcacagtaggtacgtgtttgtgagcttgctttactgatgtgttgtcatgcctctggaacgggctgtaaaaatcaatctttgactctttgccagcaactgcccacataaagagagcatgtgtgagcttgttttatgcaattacaaggtttgcttcatgacttgtgggcgctgattttttttttttaacctcactatctccatcattttctctgcaagattttcagtgaccctcgtgtccatggactgacctccatttttaaaatttcatttttaatttatttttgaataggtagtacagtcacatggtacaaatattaaaactacaaagatggaatgaaagtcagcctcccacccttgatctctgggcatcctattcttcctggaggcaaccattgttttaccagcttactgtgaatctttcagagctacctatacatttacaagcaaatatgtacatagattttttttacccatttgccatgtagattcttttgcaccttgctctttttctcttggtatgttttaatgcctgttcaatcttgtaaataaagagcttccttattatttttaatctctgcataatactcagtttcgaggatgaactatgatttatttaaccagtctgggtattcagataatttctaatccttcgccgttaaaagcagtgctgcagtgaagaactttatgcttccctcatttcaccttaaatgaattaatttaaggtgaattaattaattcctagtgcagagtggcctggccggcgttgttgttttaatggtcacggctgattctggaggagtggctgccctcattcctttctatcctaaccatctgataggaccacaggctacgctatcagtgggtttagtagagtcttttcaacaatcgagtttccagccttatgcccaagctgttggatccctgaaggcttcaatgtttgtgtcctagctgtactttatgcttgttaaaatgtatgtgttaaaattagaatggcttgttggaatgtgtaagattgcgtatagtgtttcatgttttatcactgtgttgagtttacaaagttacttgatgttatttcttttttcttttttgaggcagggtctcacgctttcgcccaggctggagtacgagtggtgcactcacgggttactgcagcctcaacctcctgggctcaggtgatcctcccgcctcggcctcccgagtacctgggactactggcatgcactaccacgcctggctaatctttgtattttttgtaaatatgaggtttcaccatgttgttcaggctggtctcaaattcctgggctcaagtgatcctcccaccttggcccccaaagttctgggattacaggagtgagccaccatgcctggcccatcgtttcatttgatccttgcaacaccctatgagaatatttagatagaacgatttcacagataatccatagtgatactcagctaacgggtggtactgccaagacttgaacccaccattcttgtaacttccttgatatctctaattatggttttggtctgccagtttgttatggagcagaaaagaagatgtaagctttctggaggtagtagctgctacaggcatacactatattatctcagcaatagcaagtccaagtaggactgattcagtatacacaaagaagtattagttgctaaaatattgaaataactttcattctggttggtgcacgttgagtatcccaaatatgaacaaccaaaatctgaaatgctccaaagctggaaactttttgagtgtttttgagtgcctgccaacatgacatgcaagagaaacattcattggagcatttcggattttggatttttagatttgggatgctcagtaagtattaatgcaaatattccaaaatccccgccccccgccccccgccaaaaaaaaccaaaaacccaaaacacttgtagtcccaagcatttcagaaaaatgatactcaacctgtaaatagctttgccccaaacccccctgagtttctttctctacttccctggccagttttcacataggaacccccctaatcgccacgtatttcccccccacaacccagcaataaaggggaaatgccctcataagcgaggagcccctggattgtagctcccgtgctatggccaccatctgtgctcgctaattggttcccaagccatactggtccctaaatattcttaaatctgtaagtgcaggaatggagtattaaacaatgtaagcgtttaggcatataacttgatttctgtaggttttgtttgttttgttttgttttgagagagagtcttgctgtcacccaggctggagtgcagtggcgggctcttggcttactgcaacctctgcctctcaggttcaagtgattctgctgtctcagcctcccaagtagctgggactacaggcgcccaccaccatgcctggctaatttttttgtatttttagtagagacagggttttgctatgttggccaggctggtttgaacttctgacctcaagcgactgcccgcctcagcctcccaaactgctgagattacaggcatgagccactgtgcccggctggtatttatactttgtaaattgcctttgttgttcttagtatcctatttctaaatctgttgtctttttcttttctttttttttttttaacaaaaaaaaaaaaaggccgggcgcggtggctcacgcctgtaatcccagcactttgggagaccgaggcgggcagatcacgaggtcaggagatcgagaccatcctggctaacacggtgaaaccccgtctctacaaaaaatacaaaaaattagccgggcatggtggtgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtagctggtctgaggtgttgggacccaggacttgctctcttattgctccaccactggagcctcaacctcaaactcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtcttttactatgggaaagaggagaactgatgttgggtgacagccagcactctctggcagagctactaagcctgttgtttcatttatctcatttagaaaataaactgtgaccatattaatttccttttcaaagcattgaaaaatttgtatttcctaaactattggagtagtaaaatgggtatggtgacccaccaggtgtgagctcattaagtctatcttttctcttcttgttttttatttaaaatattttattgaaaaatgatggaatttaaagtcgctttttcctttgcagatgaactatttgataacaggttttaagacatgaatcttattttttgagttaacactgataatatttatgcttggtacacttgaaatagaaaaacctgcttggtcacaacatgctagaatttaaaattattaaaagtgatgaattaatgataaaactttattcccataacagaaatttactaagcatctactatgtgccgagcactgtgcaaaggtcagggatggaaatggtgagctcacaatccaagtgtgtacagtttcctagacttggtttcttgaaaggaaaactcactagagattggactccaaatcacaaatgtcatttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttattgtggctctttaagagatgtcttagtggtatgaattgcttggtcagctgaaaacttttcacctaatttaattttatttttaatttttttgagacagagtctcactctgttgcccaggctggagtgcagtggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcctgacctcaagtgatctccctgcctgagcctcccaaagtgctgggattataggtgtgaggcaccacgcctagccaaattttatttttatttttatttatttattttttattttgtgagatggagtctcactctgtcgtccagactggagtgcagtggtgtgatctccgcctcccaggttcaagctattctcatgcctcagcctcccaagtagctgggattgcaggcgtccaccactatgcccagctaatttttgtatttttagtagagacgaggttttaccatgttgactaggctggcctcgaactcctgatctcaagtgattcgcccatctcagcctaccaaagtgctacgattacaggtgtgagtcaccacacccagccccaattttattttaaaatgagctagttatatatttatttctgtacttacaaatttctgttgaagtggaattcttgatcattttaaatgcaggccagttgcttttgtgatttttatgttgttgctaatgttattcttttttccttgaggttattgaaattcttatgttgggaggtaagaagcaagtgttggtggaccaaggtcacaccaaaaatagatcctagggatagaaccagaattccagaattcttttcctgtctcctcctccattttcctgatctgaccgctcttattagcatattccctttaaatagttgaaattgagggttgtgatttcacattttttcccccggtacgtggtaaagactttgagctgaaggagttgaaagttgtggatgttaaaaacacgttctgctttggatgttcctttactgcatgagctcccttgctcttaatgagacacacccatagtaaagtccagacactcagtctggacttaactgagtcaggttaagaactagaacccctcaggcgcaaatgtcacatgagcatcatattcactagaaaatgggtttagttctagcatgctctttcaaggaggcaggaaagaaggcatcttgtgaaattttgggaaggccaggataaaattgctggtcttgtgctccagttaaaggtaacaggtattctttgcctttaattttgcctttagcacagatctcaaagtacttaatagacgttaattataactgaccatgctcttgtaatagattttttttaatgagtaaactggggtgtagtgatgtcatcaaatcaagcagaaaggagactcttggagtagtggtttagagcaagatctgggagcccaggagtgctaggcacaactcctggtttgtcacttaccagctgtgtgaccttggacaagttacttgtcttctcaatttgtgtccacatttgtaaaatgggtaatggcaatagtgtctcttatattattgtctcttatagtgtctcatgttattaggcagagtacctaatatgagagcataggagatgatagctgttggggcattattaataatagcttgtttgcctcctttgaaagtaggctatgtttgtgatttcttagaaggttattagaaatctagtcttttgaatgtggagttgtagtttatagtcaaaagagagcctcagccttttaaccaactttctgtgtaaacatgaaaattccgggctggatttgttccactgtgaattttagctcacacttgcccaactggattatccagtaagtataatttaaaaatagggtttggtttttcttctccaaacacccttaaggttacaaaaaaaagcaggatctgcttcctgccctcaaggagtttatagcctagtaaagtgaaattgggagaagtacttgcccttggagatgatgaaacttgagttaggggtcttgaaggcaaaatcgtaggtaaggcctggagctggagcttggtaattgacagtgtttatggggttgggggcaaggtggcaggaaaatgtgagcacaggcgtcaaagtccttgtgtgcctgggaagtgaaaggaggaggggcagctcctggtggatggccagggtgtggctagatggaggaggagggctcccaattgtggtgggaagaatgctgcacagtgggaagggcatctgctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggacagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccatgggccttgtagaatgtggcaggaattcaaatttcattccattgcccatcggaacccactggagggctgtaagcagaggaatgatgtgatatgacctgagatgtgcaaagaacagcagttgcaaagaacagatgtggaggacgggctcgggtggaacaagagtagaagcaaaccagttagaatgatactatagttgttcaggtatgatgtgatggtgactcaggcctttgttttaggagtttgcaggagctcagagcagacagtgaaagtggccaccttgaagcaaaacacaaatgaaagggttgatcacaaactggattaaagttggcagtgagaatactggaaaggaactactgagaagtggtcagagtaaaatgtggaggtagagcctgtagactttactgatgcattggacgtgggatataagggcaagtgaagaatcaatgatgacttctaggtttctggcctgagcacctgggtagatggtgtacatttagtaagatagagaagggggccgggcatggtgcctcaagcctgtaatcccagcactttgggaggctgaggcaggtggatcacttgaagccaggagtttgagaccagcctggccaacatggcggaaccccatttctactaaatatatatatattttgtatgtatgtgtatatatatataaaatatatatataatttatgtatttatataatatacaaatatatttatatatttatatacaaatatatatttatattatatataaattatataaatttaaataaatataaatatatttatcttgtatatataaatatattttgtgtgtgtgtatatatatacacacacaaaaattagctggacgtgggggcacattcctgtaattccagcttcttgggaggctgaggcatgagaatcacttcaacctgggaggcggagggtgccgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctggtgtggtggtgggcacctgtaatcccagctactcgggaggctgaggcaggagaatcacttgatcccaggaggcagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgagagcgcagctagagatgaggaaaaggtctaagagctggtggaagagaggagcaaccagcaaacttgaggagaaactggcaagtatcgactgacttgtacatccatctaccttgctgtcgtgatcgacccttatgtttgtgttttgcctgaaggtggccactttcactgtctgctgcgagctcctgcaaactcctaataatccgagggacagaggggagtggtggtgtactgttctagtatctacttttatgattcaaaaacctgttctttttgaaatcacatggtacttaaagatatttatattatcttctctatcgtcttttcctcccttcatttttactttggtaattttacctattaagattgtgaaggaacttgacattttagggatttcttgtagatgttgtaatgaaatatggttttggaatttgatttagaaagaggtggaatgtagtccgttttctttctccggcttccctcaaccttccagttctttataggtggttcattgctttgactaccagaggccttaaatgcaggttgcgtagttgaccatgcgacctgtgaggctccctttgaacctttgtccctatttctgtaaaattaggagctcaaatgagatcaaggtgggcttccttgatttcttccagggaacagggactggtgggagtcagtggcagcaagtcttgtctaaaggtgtgagcagcaacaaagcaacacacgaggcaggaaaggactaggcttcattaatggaggtgatgcttcagctgagatatagaggggattgggggctgggcacgtgctttttggagaatgggcagcatttgcacagtgtgggagtgcgaacaaagagcctggtggaccagctccaggtggtgaccccatcaataggaatagggtgattctcctgcattttctcatctataagtagccatgtggggaatccaaaaaccagttaccaacattcaaaattgctagtgctgttagttctgcaagtataaaattagaaacaaagttcaagcttcgtctgccaagttgaagtttcctaagtgttctctcaaaacccatattaatggactcattttggcgtttgtaaccgggtaagttacagataagggcatctgcattaactggagttgccttttgaaactcctcagccctagctttggtttctcaaatgtggtgtgggtatttggagtaaactgctgtaaggctaagctgttagtaagcatttgattttgagagccctctttcctttgcagctcttataaatggattactcagtaggaattgctggaaattagaatcactgcctcctttaataagtctagttaaggcagggaggtgggccccgtcacagcatagggcagagcagtcacttagcaaggagctcaggaaatgtttgctgaatgaaagagtggagagtgaaaggtcgtgttctcaacctggcagctggcatttctacatcacttttactcagagatttgcagacaaaactttttgtttaaaacaatgctatgttaattataatctaactgttacacaatttttttttttttaaatcacagtacagggctgggcgcagtggctcatacctgtaatcccagcacttccggaggccgaggcaggaggatcgcttaagctcaggagttcgagaccagcctgagcaacactgtagaaccccgtctctactaaaaatacaaaatattagccaggtgtggtgacacacacctgtagtcccagctacttgggctgaggtgggaggattgcttgagcccaggaggtggttgcagtgagccatgattacgcactgccctccagcctgggcaacagagcaaaaccctgtctcagaaagaaaatcacagtatacatggaatacaaaggttttttgtgtttgtttttaagaactagagccttcgaaggagcatgtggcttactggtattgggctgaaggatgattgcatggggcccatctggataatccaagatactttcctgggcaggggcattgacagggatattccctactttcttccacctttagaggatttactttagaaatggtttaaggtttctcaaagttttaagtctgctgtgttggaattattaatactggagtttgtcttttaattgtgtaaattacctggcttgttcattacaaataaccattggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcggtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactgtgcaaaggtcctgagccaggagagtggtggtggttggaggggtgtgaaagaagcccactgcagttcaaagagtagagagtgatggagagggttaacccagaatgtgccctttggaaatacctaacctgaaatacttttacctaagccattgttaggatctgagttcttggtgtctgagcacaactgaatgtgaataagaggctgtttggatttcctgctgtggatggcaggatgctattcacaaagaagcctatgtcctgaccctccagacctgctgctacattaggttaaatggcaaaggggcattaggttgcagaaggaatcaacgttgcttatcaactgatgttaaaatcagggaagtatcctggattatccaaatgggcccagtggttcttgtaatgtggaagagggagacttgaagatgctcgcccgctggctttacagatgaaagaaggaaccatgagtcagggaaagttttcctgttgggcactaggcttagtacctgagtgacgaaataatctgtacagcaaaccccggtgacacgagttgtgctgcataacaaacctgcatgtgtacccccaaaccaaaaataaaagttaaaaaaaagctggaaagggcaaggaaacagatcctcccctacaacctttaggaaggaatgcagccaagtgagacctgggttggcctgtggccctaaggaactgtgagatagtaagataagatgaaggctattataataactgtgttttaagccactaagtttgcggccatttgttaaagcagcaatagaaaacatcctgcctacccaactcaacgtctcattgcataggtgggtgttaccaccaagtcacttggcagtgacgacctctggtgcctgctttgctgctcacagagcagtggagagtggctcttactaataatgcctccaggtaaatattgctcagtaaatacttactgagggcctgccacgtgccagaccttgctctcaaagcttgggataactgctgggtgaaaatggtaagatgtgtgccctcaccaagtttcattctagatgcctctcagccctgccccatggagaagggccagcaagagtgtgaatttcacatccagacaccaaccctgactgcagctgctgctaaatagttgtgaacagcagtgacttttccctgaaaaagaagtcccttccttatcttaactacttgtaggaaaacatatatatactgaaatagtttccttccaggttattctgaagtgattctttgggactgataaaatgggacaaactgaatacaataatagttgctgaagcctagctcattactgctggatagaacctgttgtgagtacagagttctcagatgtctttttagatctccaaatcagtcaccaaaataaggaaaatagttttttttataacttaaagtacacacacaccaacatgcatataggctagaaagcctgatatgaggtgttagtctggtagattgacttcttgtttaaagggagaagagtttacagaggcagaggcacagggtttggataaacgcacaaacaagctttaacgcctcctctgcttttcttcaccaggtggggaaggcagggaagtggggggacccttaactaaagagaggagagtaaagactaagcagtcgaggcaggccaccaggtttgctgagggcagccaggaagtggtagagggtgtggacattccctgttaatcactggcccttagagagcaggcacttccccctgcagccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcctgtgaaaccataccagggccagatgcagctgcactgttgagatttgaagtgtggtgctgttgaattcaagctgctgcatcagtcaggtttctttgccagctttctatccgagcctggggtgaccatatcattcatcttccaaactaggacacgtttaatgaaagggagtggagtgaatgttcaatctttagacaacaggtatgatccaggactgtcctggggaaacctggacatatggccagcctagctaaggctagaagcgttaaccattccattggatggtctgatgacccaaaatggctaagtacaacatagcctgtgtgtggaagggcctcagcacccccaggaagagagggattgtcccaggtgcccttgctagcatatgtctgtgcccatagcatagacagctctctgatgtaggggtctagaataggtgttttctttataatccaaatacaaagcaatatttatttttaccccaaaattattctccttgtatttgaacattacaaaattgttctcttatgagagctgcccttctgactactttattttggaatgacacagtcatctgttctaaacaccttggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaccttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattatttttaaatgaatgtttagtatgtgtgattttaaatgtttgtataaatttaaacgatcaaatgtcagttgactttcatctgcgttcataaagcttaaatatatatgttagccaaaaaaaagtttggaatgtttttccccgttatattcatttatttaggcatacatagtatgtgaggagtggtagtcatgataagagagacgttgtggtaacagctggggaaaggcatcccccttcaaactgggggggaagctaggctgggatgaaaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggcgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaactacaagaaacagataatccaggaacacaaagaactgtaggaaaacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacggatgtggcttacttgaagaattttgaaataaccttgtgttcatagcatgatagtgagtcctgagtctctgtgcccagagctctgattagactccaaagacctgaatttatatcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatatgggaatagacctctcaggctctgctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcatttaagggccttggagggaaagggaagaaagctggaatttgagcataaattggattttgtgtgggctgagggtcctcctaggtgtagactgtccctcctggacctgtacccactctgctagctcaggagccaaccatgtcctgaacagcttagaccagcacccagaccctaaatgacctagattaggaagtagataggttgttctctgctgtcattgtttggacacagctctatttaccttatttattgttcctgctaggcacagcctcagctaatgggctgtgatctcctgcctttaaggctggttccaggcgaattaagagcctttgcttgtttcccaaaccagggagggcagctttaccttgaggatgaaggcgcctccagttgctgaatgtggttggggttactgtgttctctcatcaaggtgtagctttaccttacctttcggtgatgggttctgccaccttatcgcggtgggtcccaggagaccgggcgcaactggagcaggggcgccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccgcatgtaagacacgaggacctcttctgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggtctctgacccttcgtcctttagcgctgctgaccaggctgctgatcctcgaccccttcttgtcacccattgtgtccctcttctcccttttctctggctccttcccttgcagcctttgcatatgctgtgttccttacctggccacctccagtcccgctgtcatctcttagtgacatcctcccttcctctccagcaggtgctggtgcccacagcactctgtaccatcctctcattgcctctagctccctgtggtttcatgacctcatgacctgttcacggatcaggcttccccaggccagagattgaggagtgggggcaattccttattcatcctaggaggctcttaatcagcgtttgttgagtgaataggtgaacgaatgtgggaatgggataaacaggaaataagccctgtgcctgccttaggtaacttagtagccaccttgggtgtgggtgagaagaggaagtggttaggaagacacacagttaagacaatgggactcctgtgctgctttttctaggcttctctttgctggtggttacctttacaggaaatctcttacccagccttcactccacccaactgcaataatgcttttcttccttcccctctacttggctctattatcttaacttttatcagcatacagaacagttttggttgtgatgttttatttgtgtaagttttgccctttcaactaggttgtaaacttgaaatcctgggttttacttcctaagcagctttgtaaagaaatggagacaacattgcaccaagataatttttgtcatggccacccactagctgtgagatcttgggggatgagtaattaagctcctcaaggcctctgtttctttatctgtaaaactggaggactggtctctctcaggggcttccagtgtgaaagtcctggggttctgggcctctgatcctggcaccccacttatcccttccagcaccctccacatgactccacctctgacatctgccaagtacagtaatttaacacattcaccttatagtctaggcagttcacctcccaggtacttgtttgttggcattcctgggatcggggacatcactggaataggagtggagcagacctgtggggacccttgtggccccggccttgcctctgtcctctgtcaagaaggttcaggcaccaaggacactgctccagttcctaatttaaaagtctgtgtgtcagttctgtaccttggtgtgtgctgttttgttccttcaaatgtagggtgggtttggaggtgggggctgactgtgactgtccagggatctgggaggaaggacagtgctggggctatgtgttatccatgagccacccctccttctctgtctgggcatcatctggcccccctccctgctttccaggtacacttgcctccggtggcacctgctgcatgatattggtttaaaaaaaatatgttgaatcctttattggaatgattcctttattgggacccaacaggcatgaaggtaatagagactatttggtttgtattttcatttgttttgcttttgcttctgagatttgtgggtttcttgatggccaggagtggcttgttttctgttgtaagaatttgttgtttgtacaggttcgtgttcccagtccttttcctcagctccagccttgtttccaaaactctcagctcttggtttatctctgtccagtcaggtgtgtgttctttgtctttgtttcttgtcctagttgttccatgagtcagccaggcctcaaagattgtaaacctgatggtgagtaaaggtgttagcaaaagagacctagcaacaaggtcattggatctctaaagagcctgtcaagctgtgagatggtgaaattttaaggactgtggatttggactgggggcctccttataggagataaaaacactcggctggggagaagaaggaatattacagtgcctagtacataagtggagctacaccagttgtccctgaatcctttgtgggagactgataggatgagagaggacgaactcttgtaatgtgacaaaagtgcaaggaagtaagaactgacttggaagaacaaacatcaacttgtacacctcaaatatatctgctttttatttgtccattctaccctaataaaactggagggaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctttgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctagtgatgtgttgaggttctgcaggaggttgtggaaaaactcatttcatagcaatgaagagaatgaatgagcgtatcttgtattcatcagccaaaagttctcacatgctgttaaaatatttgggagaaagacagttttaaatatcagacccctttggaatgagagctggctaacagagataaagttttccctcctgtctcagatagagacttgttttgttaagggctctggataggtagaagataccatgaggtaggcatgttgacatccagtgtacctggcttcttgtaggttgagcagagcaattagtgtactgagaagctctagccaaacctcgtttgatatgttcggtctaagtagatttgcagattcgtgtctatgttcttctcttgcttcttcatcttttagaaataacatttgttggccaggcggcggtggctcacacctgtaatcctagcattttgggaggccgagttgggtggatcatttgaggtcaggagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaaaaacccactggcaatctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcctatactgttggactgctggttatgtgccagcaccaggcttacagcaggggacagcagggagcatacattctagcgaacttactgctttaaagcaggaatggatgtcaaaaagaaatcagactgggcgtggtggctcatgcctgtaatctcaatactttgtgaggccaaggcgggcggatcacctgaggtcaggggtttgagaccagcctgaccaatatgatgaaaccccatctctactaaaaatacaaaaattagctgggcgtagtggcatgcgcctgtaatcccagctacttgggagactgagacaggagaatcgcttgaacctgggaggtggaggttgcaagagcaaaactccatctcaaaaaaaagaaaaaaaaagaagaagtaatcacgtaatcaaagccttatttctcctgtgattcctgatatacttagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggattgggctagatggtcatggtaaggccttcctggttggaatatgatctttttgtctccttcaaaatctggttgctgtaacgaaatttatacagaattttgagaaaaaaaatttagtgaacattgagttttgatatttaaggaatgacatttatggaaaattgatttgatactgtatttttaggctgtgtttacatggaggttagccattcataccctgtagaaattatagagattatttctgtctcttctggccttgtaattctctctgccttttaaaagtaggcatattttgggaaataatctcagagctcagggtgtaagttaggactgattacaaggaaatagtgtggggaaaaggaaatgtctttgttttagctgtgtttgtttgatccctatgaaaacaggtccatgatttctctcctctagaacataattacccactttcacactgatgttctgaaggtttatacagccactaaaagccaatttgaattaagaaaatgaaataaggtgtttctctttgtttatgtgacaggtaaatttacaaataaattgcctatggatacagattgtcattcaattttggattggaggattattctgagtgagaataaggcacattctagtttctatatgtcttcataatggtctccttagtgccactttggggaatatttgctggtctgggatccggtcccaagatgaggacatgcttaatcatcctctttagaattaacctctgtattgaccattttattcatatgtaattttttaaaaacaaggtttatagacaagaatgggctactttcttccatctgcttgcagacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggtatgacctttgtatttatagaaatagagattagttcccctaatttctgtaatatgatttagtacattttgagctaaaatgtgttagaagacattcgtatattataaaagttgggtaggatattaaaaatctctaaatgatatgatttttaaaagctaataatagtggaatatatgttttggtgttgacattcttttcccctctaccagtactttactttaattcaggtagttaacttttttttagcaggaatataataattaacattagtattttttgctgttttagatttgtgcgactcatgaagctggaagtgttaattttaagttagtgatctgaaaacttaggaggattaaataatggtatatacaaataacagtgtattaacatggacattaataacagagtattaatatggacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgtatattttaattcatggaaaatatggtttacctgctttataaacctgacctaaaatgtcgccatttaaagccatatagtgatttgggcttactatatgaaatcttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaatttacacaaatgtattttacaaccataaaagtcatctctgtccttcctttttttcctccaaattttttttcctgtaactagtgatagcatgggggatgtttattaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaaactccctcgcagggcctatggcccctggacttctaggctgagaagaggccaggtggggccgggccacttttgctggaatttgataagcttggtgatctagaggcgttaaaccgactgatgcctgggatcctttccttctgactggggctccctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaacaataattactgtgcatttcttggaaaaaatgtaaaaaaaagtctaaacccaaatagtaacctgtttaaaaaaaaaaaaaaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctgtaatcccaacacttcgggaggctgaggcaggcggattacttgaggccaggagttcaagaccagcctggccaatgcagcaaaaccccttctctactaaaaatacaaaaatattagccaggcgtggtggtacacatctgtagtcccagctactcaggagcctgaggtaggagaatcatttgagcctgggaggttgaggttgcagtaagctgtgattgcagcactgccctccagtctgggcaacagagcaggaccttacctcagaatgtttcatttagggattacttatgattaaaatacttgattgtaattgcactggccaagaaaccaatactttggtctttaagatggatggctgtggattttataaatttacttgctgtcagaacatttgaaaatatgaagcattttttctcaaacacatttgccacttttagaatggatttcctcaaaagtgaatgcctgagaaagaaatcaaattcatattgttacattcggtttgtctgtactgtgtggaatctgtcacttcaaaagatcagagggtttgggggaacaaaacgatcctgcttgaggttttggaagctggcaatgagagcagcttgccggatgcagtggtggcctcctcatccagcgagaacagcagtggctgtcctgcctcttaccaagcataattactttttcttcaatttcttccgtcccgtgcatgcgtacaggcctgctgtttttgaccagcgtttcctatacagatcctgatcagtttgtttataaaacacggcctccccgggagcagcctgacacattccctgatgtgatgatgaatagctacctaggtttgtgacctctgcgacgacaaataaattgtcttggttgtggtcattaaatttttttttttgatccatacagagcataaatctttttatgccctattttgtttccattgaagcacacacaaaaagcatgccatggctggggctctgtggccagatggttgtaagagctggactccatattgccctctaatctggtggctcatgtttttcaattcacttcacaatttgagaactgcaacggtagtggtgaagcttttcataagtaaaacccaataaagggggtgagcttatattattctgcatctgcctcacctttctatagaaacatttacttaatttgaatggttttgatatgggcacttctatttgcttttcaccagatctgttatttgtaatctgacatcctacctgatgctttataatgggtgtgtcctaatgttttctgccctctgaacaagtatataactgataccaatgacaacttcctcacctctgttgtttatactaggttctcaaataccatgtatcatcagtcattgttttgtctgcatgtttgtgtctgagaactaagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaatagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtgagaaagcctcaggttatattatgctgcaaatcatttctgctttgactagcttctatacgactggagaagagccgtcctttcaggttcattgacgtaaagaatatttttattgccgcatttttaccagcctatctttatcatttctatgatggcagcagacagacattcatatccctccccagcgtataggattatatttttgattttcagtttttacttatatgttgggatcatgagtctatgagaattaaaatttgaaaaaaattgactcagaaaacacttgcatgattctgttctgtggtttcatatggggctgatggagcatcagctcccgttgaaaacaggaattggtgataaagtaaaaaacagatatgtggctgttggtgccagttgggggggttagaacagtgaggtcttaatgggagtcctgctgtactatggttctaactcgagaaattggctttgagttcttacccttagtatttttcttggggcgtttattataggctaccttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgcttgaacccgggaggcagtggttgcggtgagccaagattgcgccattgcactccagcctgggcaacaggagcgaaactccatctcaaaaaaaacaaaaaaaaaccccgaaaaagccaaacaaataaataatagtgcttgtgtcatcttactttaaaacattttactagagtgtttctaaagcgtttgttaaaatgttaaaatgtgatgttgtcaacagatattgcagttggagctccgtatgatgacttgggaaaggtttttatctatcatggatctgcaaatggaataaataccaaaccaacacaggtaaccaaataaccgggatttctacagctagagtctcaactttttgccctataataaaatatttaggtttaagtgacttttcacacaaatcttattttatttacaagtccacaatagtataaattttttaaaaatgtattactagaagataccttcaaaataaatatataaatgtaatgacttgcttgttctaattgtaaaatttcttagataagttaggaatcaaggtaatccaaagcaaatgaatgttattctaccctgacggcattaagataagaggaaatacgatatattctctttagtagcatactaaatagagatgaaattggtcaaacaaaataaatgactgtaactacatggagaatgtagacaccaaaaattaaaaatgtcttttgagaaaaataagacttgtagggaaggtagggagatttggtttgaaatggcctgattgacttaatacaataaacaagctcatcagaaatgggctcttttctgctttgagatactatgtaaatcggatgacttttatgaaatgaaatgtatgaagtgttagatcatatagaaatttatgacttgtatataatataatttacttataagtgaactctcaaatttcagttcaaaagaaacttgtgtgtctttttcaaagcattgttaagaagctcatggtgataacctaatgtccattcggatgccctgtgtatttcaggttctcaagggtatatcaccttattttggatattcaattgctggaaacatggaccttgatcgaaattcctaccctgatgttgctgttggttccctctcagattcagtaactattttcaggtctgttatctatgattttagtgttaagcatgttctataatcaggttatactaaaatgttgaccttttggactgaaatttgtcatacctatacttcaaaggtttatatgaattgtgaagctatttctttttcttttgaagttagtaaacaatgtaataacaacctattttctaaaatcttttaaagtatctgaggaaaacatagatccaagttagaatttttacttcatatatttttaaaaccttaattttgatgatgaaaaaaacaaaacacatataaaatgtgacagtacaaagaacatacagaaggaaaccccctataattcaccatgcattattaaactccaagatcttgatttctattttattttctgtgattggaccatgtatatttaacaaaattaagaccataattgtgcataattttgtaacctgcttttgtctctttaggatacatagtagacttttcctatgtcactgagtacttttccaaaatgaagttaacaactgtctgtgaggcatcttctgacaggttcagagcttatttaaccaactgccttgctctcactggatggttacgttgcttcgcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacgttattcccatcttccacaaaacttgtgtgcatttctctacttttagggtatcatcaaaaggctacactgtaacttctgctgtctaatctggtttttatttaatcttgggctatctctccttgtcaatacaatagatgacttaactttagtcagttaaatgtttgcccctgtctatgtgtaactgatattttaatatccttactttcctgtcctcataagtaggttgactgtcaaccctgtacacttgttccctctttacttgcagatagtgtgaaagtagaattcaacaaccctttgataagaagaggagtaacttccccttattttacaaatgaggaaactgaggcccaggacttggcttgagcttttaaggctggagcctgagaggacagaatgtagcacctaaatcttcctgacttgaatcctgtgcattttttctactaaattgtactagcacttcagggtagttagtaaataaacaccaattttaaacatgaggcagccaaactaataagacttattttctatgttaaaagacacagttttcataattcatgtatattttgccctcaaaattgtgtgttgtatgtttaaaaaacaaaatatgttctaggcagaaatgtcttaaaattctacagtatgtaaaatactatatctgtggcaactgtgccttttaaatatgctctcaaaacttaagaatgtatctagttagtatcttagaacctagcagctgtctaaatgtaaaataaaaatagaatggtaaacaataaaggaaaatggaaaaacagggaatgtgggcagtatttgaccctttattggaccctaccttcactgtgaatggacttgtgctctagcctaccaacagattgattccagaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacgaaaagatgttttcagatggtgaaccagagtagggcgtggaattggattccagcttctcaagtgtttgcggggttgcagtaggcagcgcagagatgggaagaagtttaaaagtttaagtttttgcttgcagagatatcgtgggggtagaaaagttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcacagatgatgtttgtgaaagcagaaagctcaacaacgtgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtgggaatggagacaaaatatttactttaacccccacatgttgcacatgtactcataagtgtgtacgtttttaaacaaatattgtataatgaggctctgcattgtatacatttatatctattaacagttattttcttcagcaatgggggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcatccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttcaatatgtaagtacctagtacctttaaaatatgtctactttctgtctgccaggttgaaagttctgcataaatcacagaaaaataaaactgcagtggccaacatgggtctgtcaattctggtgtaaagaattaagtgtatgttttgtctcccttttaatcaggagggcacagcaccgtgagggaggaaaaaaactccacttggtcgccatttgagttttccagagcagatggtttaggacagaatggcttggaaaagtacttatttgctaccacaaccatttcctccatttctgtctttgaaaagcagtgtggaaaattgattttgtggttgtgaggtggtgggtggtggctggtggttgtgaggtggtgggtggtggctggtggttgtgaaagggcaacggcaggagccagagcacagcacagagtcactgccaggctgccttctcttccccacgcccctccctcccggaacacccgccctgtgttcccaagagcaggcccctagggaatttgcaggccggccctgagaggtcagagacctggtctctgctcctggtttcagctttgatactgactgacccacagggcaagtcccttaacatatgagtttgctttcctgtccgttcagaacaatgcctagtagtcattagtgcatacagttgtgctggagatcaactgagaagacatgaaaagcactttgtcatttattagatactgttctgcttcctttttttgtaattcaaagtaagatttttttaaatttttgtggatacatagtaggtgtatatatttatggggcaacacaggatttttgacaagaattttgacaccgttaatgatactcttaacaatagtggccgtcgtaagctctcctctggcatgttttaatagcagccacacttcttcagctgtgagtcacctgacccctggctccagagtcaaggccaggggcataggaattccaagaaaatcttttctgcaaagaggaagtgaaaagaatgaggaaattctcaacccgggtccggccatggtcctggcagtttgggattctagtgtactgtatctgccaccaagggacactttgtgaagaacaaggtcattctgtcctttcatatggttgtcagcctttacgatactatgaggtaatgagtcctctgaagtgttctccctgttatctaaagtagtagttttctttatttaaaaagatgtcccttataatattccagaatataacctaattcaaataacctaaagttgttgcttgaaacaggaaaaaatagccacataaggactagggtttgcaatggtgaatcctctcacacgtcacagctctgttcttagctgtactctaattcttctttaactttatatgaagttttatataacactaatgaatgtatccactaagacaacagaatgaagatactgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactccttgacttcccccaaattaatcacctatataaaatacagactttctcctagctgtagcacagcatttgatgccatgtgtattacttttatgttatgtagctactccattaaccaagtgtttatggatggccttttatgggtggaactttcctttgaagacattcaaagaacatttgctttcattgcttttacttccacagtaaattctaaatgaactaagacagaacttctacaaagctacataagttaatacatctaaaatcttctcccagtagccaagaatgtgagcttattgtttgactgggctattttagctcagcagtcctcagatgtggtgttccatacatatagatatctataattgagccgtaatgagtgttctacttggcttgcccctcaagcagttagcaaaggtggcctgcaaagattttaagatgatgtggactgtctggagggttagggaaggttagagtgaatttggcagataaacggttttcctgcacccacacctcccatacttttgctgtgaggggcacttttgctgtgaggggcactcagcgtgtgagcctttatctggttcattgtgaagctagcaggtcacttataaatggatgatgtcaaggctgcagaggcctaaaatgggggagcattccatttggcagctgtgacatttaagaattctccagatggacacaaaaattactattgaaactgtcagtgtttctaaattttgttctgaatagctcacattcagcataagaatgtcacatcgtgtgtgtgcgcatgtgtgtgcaagtggggaaccagttactgccacttctgttcatctgttccataaatcatatgtctatcaggtgttgtgctagttgctggggactgtggtggggaataagactgatgtgatccttgtcctcggctttgccccactgtgggagacaatcaggaaatcacagcgtagtgggcttaaatgtagagactggagagatggaatactctaggatcgcgaagagaggccaggacaggcttcctggaggaggtgaggtccaagctgaaatctgaaggggaagggagggcttagccaagcaggccaacactgctgggaggtggaagggaaaagaagggaaagacagctggctgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagtaatttaagtattggcccatgaaaaacaaagttagcagccacatctaatgaaccaacaaagaatgcgttctgaagtaaaaaaatgagattctgatcatccacatcctagcttccctccaggttccattagtgtaggttatcaagaacaggctgtgccttctagcccagtgcaaggtaggcagtttggttgtgggagctatattatgctgaccgacaggccctccatccactcaaaaatatataatttaccttgtaattcttttttatctttattattatttttttgagaaagttttgctcttgttgcccaggctggagtgcaatggcatgaattcagctcactgtaacctctgcctcctgggttcaagcgattctcctgcctcagcctcccgagtagctgggattacaggcatgcgccaccaagcccagctaatttttgtatttttagtagagacaggatttcaccatgttggtcaggctggtctcaaactcctgatttcgggtgatccacccaccttggcctcccagagtgctgggatgccaggcagaattcactgtgcccatcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgggcctgaggttctgcatcctcacaggccctcaggagatgctgctgttctagagatctttcccagatagcaaaggcacgaggccacttgaataagcattgactggtttaaagggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaaaggaaggaaaagacagcttgatttgaaccatcacaattgtgcaaatgcatattaccaggaaatatgaagagaaacaatggcaatgttttctacaaggaattaaaatcttaaaaggagttcaacatgcttgtggctggattgtgcatgaatgcacttacgttaatatgattttaattttatctagcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggtgagggctgcagatggtcacatctgttttatgaagaggacagaaaaaggttatatggtgatatacagatttctgaaatttattctggcaacctcttaatcaatacaaaatcattgttttggaattccccaatagcatgtacaccccacttaactctgactgcatgcttttcatgcaggataatatcagagataaactgcgtcccattcccataactgcctcagtggagatccaagagccaagctctcgtaggcgagtgaattcacttccagaagttcttccaattctgaattcagatgaacccaagacagctcatattgatgtaagtctctctgactttcattttgccaaagtttttttgccatttatgatgctaaatcaaatgtctttgaagggaatagaactagtgatttgctttaaaggccattcttttgtgttaatatgtttttaatgtacgcaaagttagagaagacttgtttcccaaattagcaataaacataaaaacatgaaatacaatttggggccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctgtaatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctatttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctatgaagttagaatggtggtatctccacgttacctatgatgaaacttggactctgaaaggttaagtgacttgctagctaagtaaggggtagagctgcgtttcaaacccaaatctgtgtggctgctgggtcacactcttctataccacactgcctccatgccctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcagaacaagcaatcaagataatttggctccaattacagctaaagcaaaagtggttattgaactgcttttatcggtctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattataagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaatcacagtgactctctgtcctgttgaataaacataaacatagggtacagagtctgttcgtaactcacacatgggtttaggtctgtgtggctgaaatcacattcctgaaggcatagtgaccactgtggtgaaagcctcaaatggcaagcatgggcccacctgactccggcagaatgaagaggctgaattctcctctgtgtgtctcttagcattatagacacagctggggcaggtggtggtggtggttatgatctctatgcaggtgcagctggaaaagaagtctttgggttctggaacagtctcgacaccaagagggctcttacctcctgtgtttggcttctgccgcaggacgtcactctgttcccagcttggactctcagattcatggctgtcctaataatggttttgcagaatctcctctgggacagaggcagcttcatttttgcagtggatggggttttccagaagcaggttgttggtacactgccttggcccaggacttgtcattggccaagcagggtggttacagggcagttcacaaattcacacatgattttccctgggcgtatgttgagaacatggtatatctacactgctgattctgttgcatacagcagttgttcctagaacgagttagctatcagttgtcctttgacctttttgtttttatttacaaaaatctttaggcacaagtctttattttgaatgccctatctatagtccatttttggagcctgtgcttttattataggattacgttagatattttagcttctttctcttggtaaaaggagctgctacttaaatttacattgagaagattagactgagataatatgtattattttctaacaggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggtatgtcggtagatttatctaatgtctccataaatgcaaattagagaaactaacttgttaggggaaaatcattactgttcttaggaaagtggcatattctggcaggttgactttctctttggttgtcacaatttctcttttctagttgggtaactgagggaggctgaggcatttttgctggttaatgaccattatagtacataaggcagagtcattcagtgcttgctgaggcaaatggtattttctgatgtttcatcatgacccagtatgttacataataaggagaactgggggatgctcctggggtaatagtagctgctgttatccaggggccagccagtgttcactccaagtagaaccaaactcattggaaaagataatggcatctcagcaagtaaccttgaaagctttttatgcttatttttaaaatagtaattatttattgtgtactcattgtgtctcaggaactatgctaagcattttgttttcattttctcatttcattctctggatggtcctatgagggcgtttcattatcctcaccatttcacagatgaggacattaagattcagagagcaagtaactctctcagtcactcaggcgttaagagacagattccacatacaagccctgctctgcctgatgtcaaagcctgtactgttaacccctctctctatactgctccatgcttagataactggcctatcatttgtgttccagtttgatgaaggtttgcatgtttatttcttttattttaaattctaaggtgactgggtatgatcagtgatcagagttggtggcttatagcatgatcttctactcatcaatgttaaaaatcaagataatcggttattactaatctttgctataaggaaaatgcaattttaaaagttcttgtatggcttagttttcattgctctgctctgaatgagctatataatgggtctttttgcttctttctctgttcttcagtgtcacttattccttcaagatgtgctgactaccatgttttaggaacagagctggaggctagggatacaggaataagatttgatctctgatctcagtatgcccacagtttggtggggatacagaggaacaaagaaagcatatttctctttctctgagttttaaggtcagagtgggaatgaattacttagtcctatgagtaaatcaataaacttgaatttagagtgataatacttgctggttttacacttacttctgtgcctttggcaggagagaggcaaatattgttgattatgtgaatctggcactgtttgggaggatatgctcaagaggcttgtatggtaatgacaaagaattacataaattggaactattttggatataatttttttcaggagtctcacaactcaagaaagaaacgggaaattactgaaaaacagatagatgataacagaaaattttctttatttgctgaaagaaaataccagactcttgtaagtatttttcaagagctgtgaatatttgagaggatgaggggaaggatttcttcagaacaatgtcttttgatgaccattcttctttttctctctagaactgtagcgtgaacgtgaactgtgtgaacatcagatgcccgctgcgggggctggacagcaaggcgtctcttattttgcgctcgaggttatggaacagcacatttctagaggtatgaccttggcttgaggctgtcccatggaagtaatttgcctttgcctaggacacttttcacttccctaatgcattcactgtctccaaacaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttggtgctcatttccctcatagccccattacggagaaaactgtcttaaggtactggcactgcaagctgtattttaatagaatcattgaaaaaaagaagtaaatctagggtcatccagttcagcagtgcccatggtaggtttgagaactactggctcaattcagagaatgggtgcacctcacagccctctagaaacctgtgtcttctaccatctctaatgctgcagccattggtgtaatgccccagtgatggcccatcccttggccagctgtaattattaaaaaagatctcttcatagctgactcctgaactgaaccttgtaagtccctggttatgcccctcaaacaagtctaaaataagttctctctcttggccatgtagcagcctctcaaataattgaaggaaatggtcatgcctccttggatgtttcttattcttctcagagcttatgcacccagctcttgagttatgcgtcacattgggcacagctgaactggctcctggcctctcccttcctgggcaatttgattcccacgtggacagagcagctgaggtggggtctgcttggtcccacttaccctggggcctttacctctcagcatctcggcaccacacttctgtcagacctgcctaaaatttgctttttcaaaccattgctgagcagcatgtttgaatttctagcagctgctatttttgtgttagtgttctactgaaacttccaggtgttttcatcagaatttgttgtcaagctgtgtttccagtatcctgtccttgagctatttgtaaaaatctaaatgtatgcctttaagtgtatccttacattttatgtgatttgctttgggtccattgtttcagtttgcaaagtaattctgaatcttgcttcatcatttgctttctcaactttctatccctgaaagttttaaaaactgagaagcatgttctctatgtcttcatccaggtaatgacaaatatgttgaataggactaggtgtagaaccttgtagtgaaccaatagtgaggggttccctgtgggagtctagaacccacagggacttgtataaagatctcgaggcagaatgactgcatgtcatggtgggaataatgaatgggaatgttttgcaaaagagactggagaaagaaatactgtgaattactgttcttaagttaatctgccagtctacttatggaaatgttctggcttcagtcatttagctagctgaaaattcagggagcctccctaatcattctgttttctgaaatatagcagtccttacgatttattatccaagcaagaatacatttttgtttttatttagttttttgagatggagtcttgctctgttacccaggctggagtgcagtggcgcaaacacagctcactgcagccttgaatgcctgggctcaagcaatcctcctgtctcacctcctgagtagctgggaccacaggcatgccaccacgcccagctaatttttcagtttttttgtatagccagagtctcaccatgttgcccaggctggtctttaactcctggactcaagcaatccgcctgcctcagcctcccaaaatgctgggattataggtgtgagccactgcacccagccccaggatacatttgcctgagacaaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctgcagcttactagatactttatactctatcattcaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatgtctcctcttcaagtgctgtcttcttctggaagatgatggaactctgggggccctggtgtccagtctgatgactgggtcacaaatgaaagtgaggttctcttgggcattttatgttcttagagcttggagaactcatgcctcccagtgggaattgatgtcttcacaaattggtagatttgtgaatgggttactggtctcatatctagaacccatgtcttttgaaaattgagacattttcttaacctctagtcttctgacaccttttctgttttctgtgatttctgacatacaatagctcagatgtcatatctgcacatttcttgagtagtttgagctgtagtttttctgggcttgaagatctaagcttaatttggcttaaaaaagcaaaaaaacttttttgtttctttataaccccacgaatttcaagagttttgtgttcatcttttaataaaacacagttaaactttgggaggccaaggcaggcggattgcttgagcccaggagttagagaccagcctgggtaacatagcaaaaccccatctctacaaaaaaatacagaaattagccaggtggggtggcacatgcctgtattcccagctacctgggaggctgagctgagaggatcacctcagctcaggaagtcgaggctgcagtgagccaagagtgtgccactacactccagccaggacaacagagtgaggccctgtctcaaaacaaacaataaaaaacacttctaaattaggatactattataatgaagtcagggagagcagaagtcacatgattgagccaggtaagccatgctatattttagcatcagttaaattaaatccatcttgttaataaacacccatgaaagacacatgtatgccttccctgtgctaaatgttagagatgcaaagttgggtaagatacagtgtcaactgttaagaatgtcatgctgtaggagacagaaccaggaaaacactgtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttggcagttgacaagctaatgtagtctcagcactgctcactggtaatcgaatttaatgcatcaacagagcttatatccctcttccccttatgggcacatggtggatgagtttcacaggtgtgcgtcatccccatggaaataactacattgtaatgaaaccaaaggtaagaaattatttttggagttgtaaagctctacagtagtttctactcacctgttcatcagtaacagttggtgtgacaagacagaacaaggcttggagctctgggaatcacagcccaccctttgtcttccatctttggtcacctggctctatggccagcttccccttgttctcaatcccagctggagaatgactgtcataccagaaacaaaaacaaaaaaaacaaaaacaccttcagttgacagtttaagcaaacaaccaataaagtcttcctgactggcctctcgccctccagaaccacggagcacatctgccctttaaatgtgtagccaacccagtccctgactttggttctcagtctttgatgcccagtgagttaacaatatgtggaagttctggtttgaatggtgccaggcctggggcttagagcttcagctggattcccatccaccctgccactccaggctgcaaaatcaaaaattactttgctcagttgttaacaatattggatcccaaccatttatgggggtggctttcccctactgtcagctgttttaaagacacttgtgcacagtgtcattataataaagctgattctccttgccgaagaccagtttccactctccacttccagatttactggaactttttcttacaaatgaggatggcccttccacatgaccatcttgccctgaggatacactgtacaccttccttgtgttagataatagggcaacaaagttaaacaagatacagtttaggctaattgaaatcatctatttggtttgtttcattgtagtcagcttaccaaccacgtaactattctattgcttcactggtctgtccctgtttcttcttcccttctttgtagatgtccctgtgctgaacgcagtaatctcttccctgtcaggggagggaaggagaggggaagtgagccacgaggccaccttggggctcagagcttgtagaaaacctcatttagagcataacaggaaacatggtggctgataaaggtgttttatgcctgcctgttaccatcagtataattggctaaatctcaagatgtgattgctgtctattgaatgtttaaagaaaagcagttttgctgcttttaagtattttttgtaagtcaggtgaggttgagaaactgtttcctagaagtggaaagggaagtactttgatgagagatttttttaaagaaaaacaccaccgcatagaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaatagaagagtatgacatgaatgaataactctatctcaagggggtcactatagcgtgtatcaaacataaggaaggtctaggttcaatatgatgttcctcattagaatttggccctttgactgtaaataaaatgtaatatcttcccctgattctaccagtaaagagtctacattatgaaaaactgcgtatgagatggatacaaactcttattgcccaaagattacaacctaaaaattttagattattcccagtgagtgatagaggcttacagtcccttatctgccattccaaaaagctctgaaaccttgaagtatatataatgacttatttggcaataaaacctgacgtgatgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacatagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttccaaattgttgtaattacagatgtgagccattgcacccggccttgaaaattattttgatatcaaaaactaaagttggggtttgatatttgaggatgatgttgtgttttctggaagaggtcataaggatggtctttttcagagcattggcagcctttaatgagggtgagacagcagtggatttaaagttagaaacctaagctgtatataatcttggtcaaatcattccatctccctggggcctctgtttgcctcgtctgttaaataagttgattggattattagatgatttcattattttgggagtttttgttttgtttttgtttttttgaagctctgaagtgtccaggctgtcaaggggactctaaaatacgacttatacaaccccacatgagaagcatttttattactttatacttttattcaactgaattatttaatatgttaaagtcataggattttagggtcagaactacagttcaatggcccttaaattggattttgtatatccatgtagagggcaaagctaaactaggcaggatgaagatccctacttcaaccacagtagttcagattgtatccattttaaatatcaggattctgtacaggattttgtttgcaggtgaaaaaaaaaaaagtcccttgggctggtctaaatcaccttcattttgctaacaaagatgctcatgaccagggatattaagaatgttgctggctgggcgcggtggctcctgcctgtaatcccagcactttgggaggctggtggattacagcactttgtggcaggtggatcacgacgtcaggagatggagaccatcctggctaacacggtgaaaccccgcgtctactaaatatacaaaaaattagctgggcatggtggcgggcacctgtagtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggtggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataaatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggacggcttggaatgctttttactgttgctcaggaatcgttttatgctagctaagcatgcaacttccatttcctgcatatctcctacaggtcaaagaccattacaacaaactgattatcagcatgatgggcttttatggccaacttcagaagatgatcccttaccaaagttaccttccatctacaaaattctagtacaaaaaataccctgaacagtttttattgcaatatgttgtgatggagtttgaccatatttcatgtatccagagattttatccaaccttggatctcagttgattttaaattcaagtttctcttatttggaaatacatggaaataggaattgctagtgatccctttcaccatttacgtgggcatgagaggacagaattactcctgtaatcctttccatggcactatcacagtgaatcacaacattgccattcagctttacatattacccttaatttccctctttgtttaaatggggtagacagcagtcatattttgtaatagataggtactttggcttttttttctttttttttgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttctatcaatatcctcattcttctaaactgcattttaaagttgaaaacacctttttttaaaaaaagtaaatatatttcatttaaaaatttaatctcaattcaaattttttcagatatattctcagtaaaaatatactttggatcagattgactatttaaatgaattttatatatatatataaacacacacattaacagtttaaaggtaaatgtatttttgcaaaagaagagaaattagggagtgctctgaaattcagtgtagtgatgcacttctgaagtcctatgcagcacatgatttttattgcaggaaacagttactatgtgattaatgaaatagcttaattagaagcacaatagcaaatccaggcaacataaatgacctcctggctaatgagagaagtgatatgtgtactagagcctcagaggagagaaaaagattataaagttgacctgttggaacactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctacaaattgggagttgtctttggactgaatcctcctcttcactgcctgtccttgtaaggatagggaattgcttagcaatgataacctggcattaaaaaaaattctgacagctaagctgcttccttcttagaatatgttttggatgtgggagcaggctagctgtgacgtgtgtggcagaatcaactagtcagaaaatattttcttcagcaaaagaaagattttagatttgagttttatgaaacttctctagctggattatcacaacctaatacaagaaaataaaatatataaatatataaatatatataaatataaatatataaatatatataaatatatatatacatatatacgtatatacacacacacacacacacacacacacacatatatatatataaaatgcctagacaatatagtgtgccctggcctgaataaatgtctgtctaatatattaggtaatagctctccactatacttggcattacataaaatcttggccttcttggttctttgaagatcaaacaggtgttaccacccaaagaaatatgtgattgattggcacttaatgatttgggccagtggctgtgaacctttttagcctcagttcacatatcagatatacccagattaaatcactacaataatatgtaatcatcataacctcatagagcctatcagtagctgtggtttgactagggctatggcataaataacacagactgtaagtaagtcatggcccatccagtcatagtgcctgtgattccaacacttcccctccctctcaaaaattacaggaacgtctaccagcgattgtggaattattacagggttatccttggatctatttggattcacagaggaatcactgcaaacattgatacttcattattggttgtaaattagttgctgcaaattcagtgtgtcgtgcatagtcatggtttacgcttttcccttgtggctgagaatattctagcatgtggtgttgatataggtggggaatgctttaaagattgtccagactgccagccatggtggctcatgcctgtaatcccagcactctgggaggctgaggatccttgagaccacaagttgagatcagcttgggcaacatggcaagacccaatctctacaaaaaatttaaaaattagccaggtgtggtggtgtgcacctgtagtccttgctactcgggaggctgtggtgggaagattgcttgagcctaggagtttgaggctgcagtgagctatgatcatgccactgcactctggcctgggcaacagagtgagatcctgtctcaaaaattgtccaaatcagggaagtaaggataagatcaagccttctactctaaatgaaa

SEQ ID NO: 697 - DNA, 60195 bp, Human
ggcgacagagcgagactctgtcttttaaaaaaaaagaaaaaaatttaattaccttaccaaagaagatacatgaatgaccaataagccattaaattaaaacttcagtgagtatacacatatgccctgaagtagctaaactttaaaacactgccctatgtgtgtgtactttttagctaaaaaagtgtttgaaaacagtattattttgaaactcaaaattccaaatcctctcttcaaattaggtagtagtgtcactggaagtaaaagagaagttactttaactgctaaagagtatccactaagaatctacaacaaacatcatgtttaatgctcaaactttagaagaatttataccaaaagtcaagaataagataggatatctatcttcattattaagcaacattatattagaggccctaatcaatgcaacaaggcaataaataaaagacaaaactgtcataatcagatactacaaacatctaagaaaattcagggggatttacagtcatatattaaacagtccagaaggagtcctatacatcatcaatgaatattgagaataaaaaatagtttttaaaacccctccaatttataagggcaacaaaatgtacaaggtactaaaataaatgtaatgtgtatttgggtataaatacagcaacataatgaaaaggtttattggggaaaaaattacagggagaagggtcaacaacgtgaagaggttcccctgccatctggacttctggaaaaagacctgctggtctaggcacagctggatgcaccatggaaagtggttccaataaacactggcactgtaacaattgtgtatgttgatacaaaaagagggagccaatgaatacttggtcgattatttaacaattgcttctctgctgaagaaatggccttgttggactagagcttaactgtggttcacatactaatgctgctataacagctagaagccttactaagaaatttactaaaccaccaaaaagaggaaatgaaccttctaggacatctggattgccttttcttaaaaatctagtcttggctgggtgctgtggttcacgcctgtaatcccagcatttggtgaggccgaagtgggcggatcacgaggtcaagagatcgagaccatcctggtcaacatggtgaaaccctgtctctactgaaaatacaaaaattagctgggcgaggtggcatgtgcctgtagtcccagctgctggggaggctgaggaaggagaatcacttgaacccgggaggcggggtttgcagtgagctgagatcacgccattgcactccagcctggcaacagagcaagactcagtctaaaaaaaaaaaaaaaaatctagtctgtatggcagcacaacatcaggtaaaagtacagactagccagatcactggttaaccttaacccctatgtgcttgagtttccttatctgtaatatggagatgatatagcaatagctgattttggactgttaaaggaattaagtggacacatgtaaagtgcttagaattgtgcctggcaagtagtaggctgcaatattgtgatataataaatatatatatttgatcttcatccagttcctggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggcgattgattaaccaccagttgccagtgatttagccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctgtatcctttataataaagcagtaaacataagtaaagtttctgagttctgtgagccattataagaaacgatcgaacctgggattttcctttcggaagccgctctctctcacaagggagagagctgttctcctttttcttttgcgtgttaaacctccgctcctaaacccactcttcgtgtgtatcgtgtccttaaccttgttggtgcgagacgacgaaccccgggtattgaccccagacaacaatgccacttcatattggggacttcgtctgggattccaaggtgcattcattgcaaaggtgagtaaaggggcggacctcaactctgtcctttgatttcgaggctcttggcctccattttagaatcaaaccaaaccaaatactgggcccccttctgcttctgtgaatgagaaaactctgccttcaccaattagccatttaaaaattatgagcgtggctgccagccttacaagttttgggggacaggcttgctggggagaacatggagaaccccccaatacccacgggctgctgggcatattggccatgtttgaaccagtttcctttcacggaggaccaagctgtcgtgtggggctggaagaggtcctggagcaactgaggatttctggctggggctacctcctggtgccatccgaaggcttctggactgaccccagcctccgaccaccctaaggggtgtcggcaacaggacctccaactttcctatcataattccctcatttcctatccacgaccaccatgtctcctaacctctctctgtatgcagtactgagggagttttacagttcagggaagtaatcttgttaggcaagaacaaagactgctgtagtaaccagggatatagcacaggggcatgctgttgtgattttctaggaacagagggtctcctctcccaccacagtgagcgtcactctctgcccttgctctggaaagcacatggcatgtcaaggtcactctgccctttgtcatagtaagattagggtggggcgcccaaccttccccgcgtgctatgtaaacgtcacacctgttcaaaccaacctgtgggctctgcgcaaatcagacgccgcctcctcaggcctacctataaaatctggtgcagtccaccgcaggccggattttcctttcggaagcccctcacaagggagagatctgttctcgtttttctttcttttgcctattaaacctctgctcctaaactcccccaacccccaagaaagaaattatcgaacctgagggggttgcagatacccatgatttgtagtgaactcagacagaagtgtgggtaccctgaggtcctaatagttgtggctggcatctgaagtagggggcagtcttgggggctgagcccctaacccgtggggtctgcactaactctggttaattagcatcagaattgagtaaaattgtaagacactcagctgctgtctgtggagaattggagaattggttggtggaaaacccatatatttgatgtcagaaatgtgagtagagaaatggtttttccttgataggctctatgtaaattttagttcatgtttttggtaataaatacacaatattactgattcttaaaagtataaacccaggaaaattaagaaaacaagaatgtcaagtccaacagagtttaaaggtaaaaaaaaataaaatagaacagaaatgggaccagtagcacatagaatattttaacacattcttggaaagtagaaactatatggactagtagtcaggaaggaagcagctcaaggaaaccgcttcctgaatatggagtctcctatgagagactatctgccctatggagaagcttggagtaactgcggacacaggatgccagataggaaggagggctggagtgacatgaagggctgaaaattgagggactaattggaagcccgtgcacgggacagtcagctctctctaccccatgatcagaatatttgacacacaagtgtttaccctggggcaaaaaattacaggagtcttccctgcttcccccaaaattgaacacattgctttctcttagctgacctagagaaccagtgtgggcactggcaccccaaaactaagaatccttttaagaaatggtgattttatgtccaaggaacgttccaagtaagttttcggctgctagctttgtctttacaagtaacgggccaggcccagtggctcatgactgtaatcccagcattttgggggactgaggtgggcaaatggcttgaggtcaagagttcaagaccagcttgggcaacatggcgaaaccctgtctctactagaaatacaaaaattagccaggtgtggtggtgcatgcctgtagtcccagctattgtggggctgagatgagaggatcacttgagcctgggaggtagaggctgcagtgaaccgagattgtgccactgcactccagtctgggtgacaaagtgagaccccatctccaaaaacaaaacaaaacaaaaaaaaccccaagtaacttgaaatcattttctgaaatctttctctgacattctgacattagggtaattcttgttctccatagagtgaaaggctcaggttcaagtcccactcctgtggctcctgattttttaatgattagtttgaccaatgtgtttttaaatgacttaatttttaaacatgagttgaaaacccaggatcactacacatttgaggaaagttgataatatgaaaagtaaacaccaaggtaagtggtaaaaacctttgaggaaacataattcaggaaacaggaacttaaacattagtatcgtacagcagattcaggaagatggcactggttaaaaaaattgacactatgaaaataaggcacagagaaaagaaagagctgtgggaaattataattgctgaaattttaaactagattggagagccggaatataaaggagaggacagctgggtgcggtggctcacacctgtcatcccagcattttgggaggctgaggccggcagatcacttgagcccgggagtttgagaccagcctgggcaacaaggtgagacccccatctctacacaaaataaaatataaaatcagctgtgcatggtagcacacgtctgtagtcccaaaacttgggaggctaggtgggaggatcacttgagtccaggaggtggtggctgcagtgagctgtgattgtgccattgcactccagcctggatgacagagcgagacccttagaaagtaggaaaagaatatatgaaaaaaaaataagtgatcaattaattactcacctgaatagtgggaataccaaaagagtaaaaagagagtaacagacagtaggaagttatcaaataaataatagaaggtaatttcccaggcttgatgggagacccaagagctcagattgaaaatgcccattgaatacccagcccaatgaatgtagagaggtctacacttaggagaaaagatcctaaaagctaccagaaagatagaaactgttactataacagaaataagacactagcaccttaactattaaccaatcttaacaaactagaataaaggccggatgtggtggttcatgcctataatcctagcactttgggaggtcgagatgggaggatcgcttcagcctggaagcttgaggctgcagtgagctaggatcgtgccactgtactccagcctgggcgacagagtgagacactgtctcaaaaacaacagaaacaaaaaaactagaataaaatacttctggtgtgagactctgtaggtttcattactccttttgggtcctgattaaatcctgttgactcaagaccttagagcatttactggtaaagtctctgactgcgcgatttttttttgcattttagttccttaaatattttctcactgcttcctactaaaggacggacagagcatttgttcttcagccacatactttccttccactggccagcattctcctctattagactagaactgtggataaacctcaggtaagtaaattactatccctggcaaaggtgcttttcttccacacctaaacctatggtcccttctttgtcttgctattgtttctctctttggaggcaggatggtatggaggaaagaggacagacactggagtcacacagacttgggtttaaatcctagctccatggcacagttgcctcaatggcactcttagcactgtagtcaaagaatattagacctggaaagggccttggaaattacttctcctcccccagaaacagcctctagactggcatgattgaccaccaaacttcgttgtgtcagacaggatcaatgtctgctggtctgctgcaactctgtactcatttatctctggggaggcctgaagccttggtgctgttccttggccaaacctaaatgaaatgtactagccagtgattaatagagtcctgtgctggggtgggagacagaccagggagcagcctgtttcttgcttctttctttctttttggagatgaaatctcattggctttgaacttctgggctcaagtgatcctcccacttcagcctcccaagtagctgggattacaggtgcatgccactgccccagcttgactataccagcttgtttctggttttgagccctggtatgcaagctagtgttggctacctgatcagaggagtataaaagagcctcagatgaggttacagttctcttgagaccaaggtgtcttgcatgtatcatctagctggttcattgcttaaagatgaagcacatcttccacatcctctgtggctgcaaaaggaccctaggaactgggtgtggtgtttcacttgccttttggtttgttgggttttttttttttttgtatctatcctttacctttattaaagccttatgtgaggatactatgcggagtcttctaagtcttttcaatgatccaaacctgtgtaattgatgaagagggtactgtgaataggatcattactttttttttgtttttgagacagggtctctctcactctgtcacccaagttgagtgcagtatcttgatcacagctcactatagcctcaacctcctgggctcaagagatcctcccacctcagcctcccgagtagctgggtctataggcgcacaccatcacggctgcctaacttttaaaaaaattattttgtagagctggagtcttaccatgttgcccaggctggtctcgaactcctgggctcaagtgatttgcctgccttggcctcccaaagtggtgggattacaggtgtgagcaactgcgcctggccccaggtttttttttttctttttttttttcgagacagggtctcacactgttgcccaggctgtagtgcagtggcactgaagcctgaaacctctgcctcctgggttcaaacagttcttgtgcctcagccacccgagtagctgggattacaggcatgcaccaccacgcccggctaatttgtttgtatttttagtagagatggggtttcgccatgttggccaggctggtcttgaactcctgaactcaagtgatccgcccgtcccagcctcccgaagttctgggattacaggtgtgagccactgcgcctggccccccagttttttactttataatttaaatgatagctaaggctttgtttgggagaaagatgaaaagtggggaaagatttagagccactggtgccaggctagttgctggggaatccctgtttgaatttgctgaagtgctacaactctcaatgggaagaaagggatgacaatggaacttgaaggtggttgatgcagagcaagaggaaatcgctaaatagatttaaaaagaaatccagacacagaggaagtcagccaagaatacagttccctggctggttaggctgctttggcaaaaatgaaagtaactaaaaaagagcctgtgttgccaagtccaccaatttccttctgtaaagggaaggaacatgatgccaaagaggagttgggcagatatttcttctgatgggaatgtgaccctcatcgggtagataatcaccaacgaaactacagtgggagggcatcaagagacaactgaaacagggaactacacaagagtgaagttgcctgtggactgacagagcttcctgcagaaccactgctgggttggatatacatgaatgacaaaggagctcttttccttgtattaggtactgtcaaatgtaccttcaaatgaaagggtgtgtttggtcttaattagctgaattcgttgaagatcttcaattagctgcagcttttgccggaatgtggttagctgggcaaattccaaatcggttgagctgcacaaaggtggcagtacataaaacatatcttgtaaaggggaactgcccaattccacccataattgttagaagaaatactccctagaggttactgaaatgttgagaatgcaaacaaacacatttggactggttctgtgatgaaactaaggtatcccttaattttatgtctttgacttaagtgatgattgttgctgtgataagagggcctctaccttcgtagactttttgtatgaccctactactgggggagcaggatgaagtgaaagcctgttgaagacttactagttcctttgctccaaattgtgctgaatgatgaacagattaatatcattcaaaagaaaggaggccgggtgtcctggcttacacctgtaatcccagcactttgagaggctgaggcaagaggattgcttaagcccaggaatctgaggctacagtgagctagaatcatgccactgcacttgtactacagccttggcaacagagtgagcccttgtctcctattaaaaaaaaaaaaaaaaaaaggaaagggctgggcatggtggctcacacctgtaatcctagcacattgggaggccgaggcgggtggatcacctgaggtcaggagttcgagaccagcctggccaacatggtgaaaccctgtctctactaaaaataaaaaaattagccgggcatggtggcacatgcctgtaatcccagctactcaggaggctgaggcaggagaattgcttgaacctgggaagcagaggttgcggtgagtcaaaattgtgccactgcactccagcctgggtgaacagagcaagactccatctcactttgttgcccaggctggtttcaaattcctgggctcaagcaatcctcccaccttagcctcccaaagtgctgggattacaggtgtgagccactgtgcccagtcaagatttctaatgtatcctagtcttgatgaattaaacaaataaacctttaggatgatgcaaaagcagaatctacagtcactttaaagcagtgtgatgtaaagaaaagggtggcagagtctcttggtgctatgggacccaaggacatttacattggtgtggataaaatgcccggagtggtgaaaaactttattgtcattgttggaccatggtgcataatgtattgttatacctgctaataaaaaattaaacggcaattaacttagtttagtatgacaatacaactgtaagtttaagagtgaaaaatgggccaggtgtggtggctcaggcctgtaatcccagcactttaggaggctgaggtgggaggatcacttgagcccaggggtttgagaccaacttggcaacatagtgagaccccccccaccaacacccccaacacgcttgtctctataaaaaatggtggtgtgctcctgtcgtacgagctgcttgggaagctgaggtgggaggatcgcttcagcccttgaggttgaggctgcaatggatggtgatcaagccactgcactccagcctaggtgacagagcaagaccctgtctcaagaaaaaaaaaaagtgaaaaatgtccatataaaaacttgcacactaatgtgcacagcggtattatttataatagccaaaaagcgtaaacaatccacacatccatcaactgggttgaggaataaaatatggtatatgtgataataaagtgtggtatatccacataatgaaatattatttgacaatgaaaaggaatatgaagtactaaaacaatacaacatggatgaatttcgcttcctttttttgttgttctttttattttattttttaagcacctctaccaacatgaacattttgcaaagtgaaagcaaccagacacaaaggaccacgtactgtatgattcaatttatatgaaatgtccccagtaggcaaatctatagagacagaaagtaacatagtagttgcctagggctaggagggtaatgggggacatggaaagcaactgctaatgggcacagcgtttctttctggggggatgaaaatgttctaaaattgattgtggtggtggttgtgcatgtttatgaatatgctgatatttattgaactgtacattttatttactttttttagagacagagcctcactctgttgtccaggctggagtacagtactgcaatcatagctccccgcagcttcatattcctgggctcaagagatccttccacctcagcctcccacgtagttaggactacaggcacatgccaccatgccctgctaagttttcgttttctttaaaaaaaagttttttagagacagggtctagctatgttgcccaggctgatctcaactcctggtctcaagcaatcctcccgccttggcctcaagagcattggggttataggtatgagtcaccgcaccctcagttgttcattttaaatgggtgaattttatgatgtgtgaattatatttctttctctttttttgagatggagtttcactcttgtcgcctaggctggagtgcagtggtgcgatctcggctcactgcaacctctgcctcgtgggttcaagcaattctcctgcctcagcctcccgagtagctgagattataggcatgcgccaccatgcccagctattttttttgtattattagtagagatggggtttcaccatgttggcaaggctagtcttgaactcctggcctcagccccccaaagtgctgggattataggtgtaagccaccacagccagccccaactagctgggactacaagcacgtgccaccacacctgactaatttctttttttttttttttttgtatttttagtagagatggggttttgccatgttggccaggctggtctcaaactcctgacctcaggtgatccacccacctcggcctcctaaagtgctgagattacaggcatgagccactgctcccgatggattatatttcaatataattcaattatgcaatataattgcataattgttatcatctctccctgatatattatcggaatggatgtgacatctgaatggggatgctgttgaggaaagagatttcatgaaatgtacagtgagtggcataattgtggctcactgtaaccttgaattcttgggctcaagtgatccttctgcctctgctccccgagtagctgggactacaggcatgtgccaacacatctggctaatttttaaaattttttgtagagacaaggatctcactaagttgcctaaactggcctcaaactcctagccacaaacaatcctcccaccttggcctcccaaaatgctgggattacaggtgtgagcctccacacttggccacttactttctttttgattcctatttcaggagaaaatcataatcaatttgcatttgtgtggaaaggccaccaatgcacatttaagctgctcccacaggacatttaaattatcttgcttattgctacaacctaatgaggaacaacttagatttgattgcactggaaaatactatatcttttttttgtttgtttgagatggagtctcactctgtcacccaggctggagtgcaatggcgagatcttggctcactgcaacctctgcctcccaggttcaactgattctcccgcctcagcctcctgagtagctgggattacaggcacccaccatcatgcccggctaattttttttatttttgtagagatggggtttcaccatgtgggccaggctggtcttgaactcctgacctcaggtgatctgcccgcctcagcctcccaaagtgctgggattacaggcatgagccactgcgcccagctaatactatgtcttattatattgatgataataatgttaatctctcaatccaaatatccagctaagactgaattggaagtgcttgttaatcatataaccaccagggagggatgattaactggctaaaatgcaaggcttagaataaatggtaaaattcttagaaattacttgggctaggctgggtgtggtggctcacgtctgtaatcccggtgtgggagctgagattgcgccactgcacttcagcctgggcgacaaggacaagagtgggaagccaaggcaggcggatcacttgaggtcaggagttggagaccaagctggccaacatggcaaaaccttgtgtctactaaaaatacagaaattagccgcaattggtggcacgtgcctgtaatcccagctactcaggaggctgaggcaggagaattgcttgaacccaggaggcggaggttgcagtgagccgaggccacgccactgcactccagcctgggtgacagagtgagactgtctaaaaaaaaaaaaaaaggaggaattacttgggctagagccactagaaacattcccaaacaaccaaaattaagttgctagctacaagacagaggaaaaaggcacgaaaattagttcaatttcttggttcctggagaaatcacataccatgtttgggaattttatcaacccttattctcgaagttaagagggaatggggagctaatttacatggggctttgaaaaatgaacaaatgggagactttttgggaacttcgaagagattactttggggccatagcacctcagtgttcaaatgatgttagcaatgtcagcaaccgactcacgctgatggagcttcttaccaaagcccgtgactgcccctcagggatggtcatggggatttgacactagaaagttacccgaggcttctggcaggtatatgtcctttgaaaaacagtcattggcctgttactgagcttctttttttttttttttttttaagacggagtcttgctctgtcacccaggctggagtaccgtggcgcgatctcggctcgctgcaagctccacctcctgggttcacgccattctcctgcctcagcctcccgagtagctgggactacaggcgcccgccaccacgcccggctaattttttttgtagttttagtagagatggggtttcaccttgttagccaggatgttctccatctcctgacctcgtgatccacctgcctcggcctcccaaagtgctgggattacaggcgtgagccaccgcgcccggccagagcaccgagacttaaaacatgaacacaaaataatgattttttaaaactgagtaattcgatcaaattgttgctgccaggctatacaattttgtctatgtttttctttaatataaatgttcagtatatgctcatgttaccacattgtgtccataactgatatctggaaagcttcatgaatggaggcagatgggtgtctgtcttgttggttgctagatccccaatgtctagcactgtacctgatatatagtaggtgcttagtaaatatttgttgattaagtagatgaatactgatgtttcataattttccaacaatttatcttttgtgttgaaattccaggcattcctttaattcctggtttcttcggaaacagtgggaaatgctcttctaagaaaaatcttactataagggatcaacctgctttattttccttttcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaccttgaaattattctctgaagtgtttctctggcgttttaagtttaggttttatttttcaattgcttttgcaatattttgctaaactttcttcactggttaaatgtgttatattaggtataaggtctagtttattaaaattcaacatcaatatttttatttttgcttcattttctatttagtacagcctgtgttaatttgtcaaatatatataaaataagaaagttacgtctccttaaacttggaccttagaaaatactggctgtattcttaaggtcctgaaaagattaaataactcatgcggtcatcctgatcccagtctcctcacccaccctccttctactgctcttacatgatctttctttgattcttctcattgctgcagtattggagggttttgtttgtttgtcctagccccgccataggggttatgatatataaatcagagttctaacaataacaacgatcatttactgagtactgtacctactttatgctaggcatagagtgagtactaattcttatccaatgaatttacccctttctctcccatttcacagctgagttcatggaggctcagagactttaagaaacatgcctatgtttctaccgaaatgtcatggcaaggctaaaacgtaggttttctaattgcacgttacttcagctggtcctggtgttagtcggcttccctatcactttgaccctgagagctcaaagagcaacataccagctctggggggcagctggggcaggatattgagttacacagcttagggttctgtacctagagcacggctgtggtggaggggcccattttgggtggtgggattgaggatggagactcaggccaatgagatcgggagtgcacagccacgctggagcttgtcttgctcctgaacaaaacaatcaactctgtgtacataccccctggtgccactgccaggcaatctaaatattttccttcatatataggtaaacaggacacggtacagtgtttttcctgtggtggatgtttaggaaattgggaagaaggagatgatccttggaaggaacatgccaaatggttccccaagtaagtagataatttttgcttaaatgtttctttcttttttttttgagacagtcttgctctgccacccaggctggagtatagtggcatgacttcagctcggtgcaaattctccctccctggttcaggtgattctcctgcctcagccttctgagtagctgggattataggtgtgcaccaccaagatgggctaatgtttgtatttttagcagagatggggttttgccatgttgcccaggctggtcttgagctcctgagctcaggcagtccacccacctaggcctcccgaagtgctaggattacaggcgtgagccactgtgcctggctaaatttttcagttctttaaaagacaaaatgaaagacaaaagagccacctttctggagtagcaccttcagttttgatctttccctattcaaaattggaccactccaggatttattcaagcaggaaaggcctaattacattgtgaaaagtttgaattatagaattttaaacagtttttaagtatttcattatcccaaattctaagataggttttgcccagtagaagtttcatgatctgccttaattaataaataaggctggaagtggtggcccacacctgtaaccccagcactttgggaggccaaggcaggaggattgcttgaaatcaggagtttgagaccagcctggcatgtagagaccctgtttctacaaaaataaaaaaaattggccaggcgcggtggctcacacctgtaatcccagcactttgggaggctgaggccggtggatccgaggtcaggaaatcaagaccatcctggctaacacggtgaaaccatgtctctactaaaaatacaaaaaattagccgggaacggtggcgggtgcctgtagtcccagctacttgggaggctgaggcagaagaatggtgtgaacccgggaggcagagcttgcagtgagccgagatagcgccactgcactccggcctgggcgacagagtgagactccgtctcaaaaaaaaaaagttagccaggcatggtggcgtgtacctgcagtcctagctacttgcgaggctgaggcaggaagattgctagagcccaggtagtcaaggctgcattgagccgtgatcaagccactgtgctccagcctgggtgacagagtgagaccctgtctctaaaactaattaaataagtaataataatttccataggggtggtgtaaaatggtgtatgctggaaggtaaaaaatatttaaacattattacaaatggtttcatgtactgctaaatatataccaaatgaaaacactgtatttttaaacctcagaaagagtttttattactgcagtggtctttagttcctggcttagaaaaggaagtacattttaattatttttaatgctatatttactagtattttctacatgactttctttgtttctaccaagtacagattcattcctttaacaagtttttaaactttcactgtgtaaaatttcatacaaagatagaatagtgtaataaatacttgtcaacacatagccaaatcatatttcatccatctcctacccaccttttttcctggaaataataacaataactatatttttattttattttatttgagacagagtctcgccctgttgcccagtggtacgatcttggctcactgcaacctccacctctcaggtacaagtgattcttgtgcctcagcctccgagtaactgagattacaggcatgcaccaccacacctggctaatttttgtaattttagtagagatgcggtttcatcatgttgcccaggctggtctgaaattcctggcctcaagtgatccacccaccttggattcccaaagtgctaggattacaagcatgagccacctgtgcctgaccaagatttgttgttttctttctttcttttcttttttttttttttttgagagtgagttttgctctgttgcccagactggagcccagactggagtttagtggtgcaatctcagctcactgcaacctccacctctcagactcaagcaatcctcccacctcagcgtcctgagtagctgggaccacaggtgcctaccaccatgcccagctaattttcatatcttttatagcgacaaggtttcactttgttgcccaggctggtctggaactcctggttctacaaactcctgggctcaagtgatcctcccacctcagcctcccaaagtgctgggattacaggcatgagccactgtgctcagccccttaagatttttaattcgtagatttcctctttatccatctcttttttcttgtcacttatttgttaaagaagccatgtaatctgtcctgtaaaattccctctactctagatttggcagaatgtgttcctctggcatagtctaacatgttcctctaccttctgcatttccaggaacctgacacttggatctagcagtttggtcaggctcagattctattttctttctttctttttttttttgtgacagtctcactctgttgcccaggcttgagtgcagcggtgcaatcttggctcactgcaacctctgcctcctgggttcaagcgattctcctgcctcaccccacccaggtctgggattataggtgcgcactgccacacctgactagtttttgtatttttagtagagacggggtttctccatatttgcgaggctggtctcgaactcctgacttcaggcagtccacctgcctcggcctcccaaagtgctgggattataggcatgagccaccgtgcccagcctcagattctattttctttaacaaatatttgtcacacacctactacatgcaaagttgttggttggatactaaattaactacaaaactggacacagttatttacatttataagtcatcttgcacatggacagccatgcccacaaaagtgaatggaggcccggcatggtggctcatgcctgtaatcccagcactttgggaggctaaggtaggcggatcatttgatgtcagtagttcaagaccagcctggctaacatggtaaaaccctgtctctattaaaaatacaaaaattggccaggcgtggtggcaggcgcctgtaatcccagctacttgggaggctgaggcaggagaattgcttgagcccgggaggcagaggttgcagtgagctgagatcgcaccactgcactccagcctggtcaacacagcgagactccatctcaaaaaaaaaaaaaaaaaaaaaggctgggcacagtggctcacacctgtgatcccagcactttgggaggccaaggcgggcaaatcacttgaggccaggagttcattcaagtgatgaactctcctctcccctcttccctctctcctctctcctctcctatctcccctcttccctggccaacatggtgaaaccccatctctactaaaaatacaaaaatgagccgagcgtggtggtgcgtgcctatggttccagctactcgggaggctgaggcaagaaattgcttgaacctgggaggcggaggttgcagtgagccaagatcactccactgcacagcagcctgggcaacagagtgagactccatctcaaaagaaaaaaaaagtgaatggatatctttggtatgttttgatacgttgtgtgggaaagcaatatgcacaataagtgcagtgtgagactttgaaaatgtttaaaaccactcaaactatatatggagttgcttgaaaatatatagaaaaccttatgaaaatatgtaaaccaaactgtagatacttctggatctggatttgtcagggggtgaagtagtgatggattttcacatttattttgttcattgctgtcttgtttaaatttttggaaacaagtatatattactttcatagttgaaaagaaagtgaggagattaggagggaggaagtaaacaagggaggagaggagaaaggcaggaagaggagagagagaaagttagacaagtagatgagatggttatagggacgaatgaagctagaattgtgaaatcatttgacagtcactctggctccctgacgaatcaaaacagccacccaggcagtccttgtccatgctgacagtgcaccatatatgcatatgtaacagggaacagcagccccggctggagcacaagccgctgctcgtgggcacctgtctcagctctagcctcagctcaggcttcacttagcctcagggtcactgtgtttagtgtcgctgggttatacactggacaagtaccagtggcaccactcacacatgatcacattatcatgtgactagcacctactagagccgcacatcctgtctgcaggggccttcatatgccttctctaacatagtcagagggtaaggtaataagcacagggaggggagacagcagtccagcaaccactcctagagaggaaggagttcaggccagcaaacaagggcagggggtagtgcagaggcttaggagatagagccaggcttgaatctgctgctacctgactaccagaccctaggcaggtgactgaccttgtctgaatctcatatgtaaaatgcagtgtcaacaacaacaaaaaaattagagacagatatccccaaatatgtcaaatttattcaggaataagaaaagagggttatgatttggaatgcactactgtaaaccacaggcacgtgcagtgagggaagagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagccagagttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataaaagtgatttcatcttggtatctgcgacttccacagcagataataatgtacagcttgtctggtggttgtaaggatgagaaacaaagtatatggatcaaatgctttgtaaaaattaccatgtataatgtgaggatgacagatgaccaactgttttgcctttcatttgtttgtcgtcataagcacatggtcagtcaataaaatctaagagctggaattagagcaagaatccccaagtttcttgttgggttactctgtctttagctttctggacttcaatttgttgcttctttttatcaactgtcaacaaaatgagtatacccttacactttttaaaatgtggcactccataaatgtaagatgattttatggtaactttttaaggtactgagttcctcctcaatccatataaatcatgaggacagggaaccaccccgtgcattgtgtgccatgtaggttatgtgcagacttacggcaatccttggaaacatttatacacctgaaaactggggaccctggctgcctatcacatagaatcatggccctggggaaatatgcagatcatctgatggcatccatgttctcctgtgattataagagaacatggcaaggttggtcacatccccactggtggaagagcgggtactaatgctccagcctttgggttcccagcccattctttgctacagcaccatagaaagaaaacttaaatttgaattggagggatttttatttttatttttattttttttgagacagagtctctctctgttgcccaggctggagtgtagtggtacaatcatgactcactgcaaactctgcttcccaggttcaagtgatcctcccgcctcagcctcccaagcagctgggattacaggcgcccgccaccatgcctggctaatttttgtattttcagtagagatggggtttcaccatgttgaccaggctggtctcaaactccaggcctcaagtgatccacccgcctcagcctccaaaagtgctgggattacaggcatgatcccccatgcccagctgaattggaggaaattttaaaagttaattttaaaactgcttctcttttatgggaaaggaatatgtttttaaatggtattcagtgtgctcttttttaaaaaaatcaaaaattatccattaacatccgttactttttttgtttttggttttttttgagattgagtcttgctctgttgcccaggctagagtgcagtggcatgatttcagctcactgcaacctccacctcccaggttcaagcgattctcctgcctcagcctcccaagtagctgggattacaggcgcccgccaccacacccagctaatttttgtacttttagtagagacagggtttcaccatcttggccaggctggtctcgaactcctgacctcgtgatccacctgtctcggcctcccaaagtgctgggattccaggcgtgagccatcacgcctggcctaatagccattactttttaatgcatggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggtaaagttccttcagttcttgttcatagataggtatatacttcataagtcaaacaatcaggctgggcgcagtagctcatgcctgtaatcccagccctttgggaggccgagctgggcagatcacttgagatcaggtgttcgagaccagcctcaagacctccaacatgggccgggtgcagtggctcacgtctgtaatcccagcactttgggaggccgagacggacggatgatgaggtcaggagatagagaccatcctggctaacatggtgaaaccccatctctactaaaaatacaaaaaaaaaaaaaattagcccggcatggtggcaggcgcctgtggtcccagctactcgggaggctgaggcaggagaatggcgtgaacctgggaggcggagcttgtagtgagccaaggtcgtgccactgtgctccagcctggacgacagagcgagactctgtctcaaaaaaaaaaaaaaaaaaaaaaaaaaagacctccaacatcgtgtctgtctctactaaaaatacaaaaaaaaaaaaaaaaattagccgggtgtggtggcacatgcctgtactactcgggaggctgaggcaggagaatcacttgaacccaggaggcggaggttgcagtgagacgagaacctgccactgcacttcagcctgggcaacagagtgagactctgcctcaaaaaaaaaaaaaaaaaaaaaaaagtcagataatcaacaacttgaattttaatttccctcagggagaacattttgtgaattcctgggtccagagagaattacctatggcatcaggtaaaaactcaaacattttccaaaggctttgcttgtttatttcttcttttgattttttgtccctatctctttttgtcgtcccccccgccccgccccgtttattttgaagcaaactctagacatcattccatctgtaactgtgaagggacaacttgaacgctgatacttgcaatatcaaagcctactggtctctttaatttgtgcagcagcaataaagatatagaaaaaaaaaagactaaagcctgctggtctcaccttgtgctttttattcaagcttattgcaatgacagcatctttgcttacgaagaactacggctggactcttttaaggactggccccgggaatcagctgtgggagttgcagcactggccaaagcaggtcttttctacacaggtgagtcagtaggttgtgcccacttgcttgcttgacctttaattcccacatagactttatgctcctgggcttacgtttagctacactcagcaatgtccactagcttcagcgtttctttttcttttctttttttttcccccttggagacagagttgcccaggctggaatgcagatcttggctcactgcaacctccacctcccgggttcaagagattctccttcctcagcctctggagtagctggaaccacaggcgcctgccaccacgcccagctacttttttgtatttttagtagagacagggtttcaccatgctagtcagaatgctcttgatctcctgatctcgtgatctgcccgccttggcctcccaaatgctgggattacaggtgtgagccatcgcgccaggcctctcttcagcatttcttatagattcgttttcttttctttctattttttttgagacatggtcatccaggctggagggcagtggcgagatcatggctcactgcagcctcaacctcctgggctcaagtaatcctcctgccttggcctcccaaaatgctgggattacaggtgtgagccactgcacctggcatacatctcttttctttcctgcatcataaatcctctcccagttttctattcctcccttaggtggtaaaccttcaaatttgaaaccttaaggtctggactaacaatgaatacaagtattctatttgtgataattatcatgtcttttctttctacacattactctcctcacctcttgtcccctgacaaagtgctcctagaaactgtcacaggacacttctgcttatatttctttaatcagaacttagttggatgggccgggcatggtggctcacgcctgtaatcccagcactttgggaggccgaggtgggtggatcacctgaggtcaggagtttgagaccagcctggccaatatggtgaaactctgtctctactaaaaatacaaagaattagccaggcatggtggcgggtgcctgtaatcccagctacttgggaggctgaggcaggagaatcgcttgaacctgggacgtggaggttgcggggagtcaagatcatgctattgcactccagcctgggcaacaagagtgaaactctgtctcaaaaataataataataataataattattattattattattattattattagtcagatgaccatacctagctgtaagaggagctgggaaacctaatctttttcctgggtgacaatgtgcccagctaaatattgggatttctattagtatggaaggatttgagataataggaacatggatagcaatctttgccacattctgcctgcaggagaaaatcaggaaattaattttcatgattcctaaacatgtagagccttccaccagattgtggcattttctctttagctgctggtcattaggaagcacctctgcaatctataaatgatgggctggttcctgtcagctaaatctctgcctgaaatacaagatgatcagggaaaggttcctaggtaccttgctggtcttgctcaaaccgaacacatgcataagttacagtggaggttaatgcagatctttaactgagagatcaagtagttgtcacaaataccatagagcaacacagagaagcagaatatagttgtcactctacctaacagacatgtgccattggaaaaaaaaaatctgactgcctcacaatcttaagcctttggaaagagtgtttgccatttctccctactctactgtgtcttcctcttgtcagccttccgcaagacccctctgaccagtgtgctccccctcttcctttccaatcctccaccactccacacaaatcctaatcatctctgactgttttcagatcttgcaagctctaggatctcatatttctgggaggctttcctctgccccagctttcccagagtggaaggaagatgagaaatgctctgtttctagtttgatccttttgcagagctaaataccaatttctttccaaagaaatataatttcacaaagagacttaatcctatttctggtgtaataaacatggcaataatgtggtaagaggcaattaattcttcatgcattcacttacataagggctgctagatttgctggtatttttttttccgtgagctctaaatatattctttctgattcattcattaaacgaatactaattgagtgccacatgagtgtcaagcacttttctaggttcatgtcattcattagtgagcaaaaacctctaccctcatagagcttatttttatttttattttttgagacagagtttcactcttgttgcccaggctggagtgcaatggcgttatcttggttcactgcaacctccgtctcctgggttcaagcgattcttgtgcctcagcctcctgagtagctggcattacaggcatgtgccaccatgcccagctaatttttgtatttttagtagagacagggtttcaccgtgttggccaggctggtctcagactcctgacctcaggagatccgctggccttggcctcccaaagtgctgggattacaggcatgagccactgcgcccagccccctcatggagcttcaattccagattctggttgccaatctgtttgttgatcaaaggagaatggggcagagggatggtgtgcatcaaagtgcatggtgtgtaggagcattcaatgactacttgccagttaccccattggtggacagagtcttatatagaaaattgcctcactggtaaccaacttctgactgtcacaaaacccaactggagactgaataggctttcactattacaggtctggtggttattatctgcatgttaatggacagatgcccatgccagtggcactgatcaagtttccttacttttaggtataaaggacatcgtccagtgcttttcctgtggagggtgtttagagaaatggcaggaaggtgatgacccattagacgatcacaccagatgttttcccaagtgagtggaatgaatgttaaccatctgcaactttggatgcacttcaacagtttttttctttttcctcatttcctgccttattttatctttagattgagtctttatccactcctcggattcaggctatgaaggatgagtcttcatgtctttcatccctttgctccatgacccccttcctgtactagccttcccctctttatagttatggcatagttttggctagattcatatattcacattacatgtttacattatcatgactatacaaatgctatgtggagctgaagcttgtggtaaatttttatttatttttcccttcctgtatatccttttatttttttaggaagtaataactgtcctgttggtatgttagcttatttttttttcctgaggtaaaattcaggtagtaaccattttatttatttatttattattttttgtgacaggttctctctcttgcccaggttggagtgcagtggtgcaatcatggctcactgcagccttgacctctctggctcaagcaatcttcctcgctcagcctcccaagtagctgggactacaggcacatgtcttcacacccagctaattttttttttttttttttaagagacagggtctctctatgttgcccaggctgctctcagacttctaggctcaagcagtcttcccatcctggcttcccaaagtgctgggattataggcgtgagccaccatgcacagcaattaaaccattttagagtacacaattctgtggcatttattatagtacattcacaatgttgtgcaaccaccccctctatctagttccaaaacactttcatcgcccccaaagaaaactctgtatccatcaagcaggcccccctcctctctccaccccactccatgcccagcccctgggatacaccaacctaattggtgtctatggatttatttgttctgactatttcctctaaatggaagcataccgtttgaccttttgcatttggattctttcacttggcatattgttttgaagtttatccatgttgtagcttgcataagtacttccttccttttgagaccaagtaatattccatatggatacactgcattttatttatccattcatctatttgtagatatttgggttgtttctaccttttggctaccatgagtaataccgataggaacatttgggtacaggtatctgatggagcatgtaactgtattcaagtctctggggcatatacctaacaacgatattgctagctgtatagtaattctatgtttttactttttttttttttttctcacacagagtctcactctgtcgctcaggctggagtgcagcggtgcgatctcagctcactgcaacctccgcctcccaggttcaagcaattttcctgcctcagtctcctgagtagctgggattacaggtgtctgccaccatgcccggctaattttttgtatttttagggtttcaccatgttggctaggctggtctcaaactcctgacctcaagtgatccacctggcttggcctcccaaagtgctggaattacaagcgtgagccacagcgcctggcctgttttaactttttgaggaaatgctaaactgttttttccacagtgcttgcaccattttaaattcccaccaacaacaatgttgtgcaaccaccccctctatctagttccaaaacactttcatcgcccccaaagaaaactctgtatccactaagcaggccctccttctctctccaccccactccatgcccagcccctgggatacaccaacctaattggtgtctatggatttatttgttctgactatttcctctaaatggaagcatacagtttgaccaacaatgtatgaggtttcccatttctcatcaacacttttctatttttaaaaaaattatagccatctgcttaatttttttttttttttttttttgagatggagtctcactttgtcgcccaggctggagtgtaatggcgtgatctcactcactgcaacctccgcctcctgggttcatgccattctcctgcctcagcctcccgagtagctgggactacaggcacctgccatcacgcccggctaatttattttttatttatttttttagtagagacggggtttcaccgtgttagccaggatggtctccatctcctgacctcgtgatccacccgcctcagcctcccaaagtgctctgattacaggcgtgagccaccgcgcccggccagccatctgcttaatttttatgtacattgcttatttttgtttcttgagataaaattcatgtattaataattttatttatttaaatgaaataaatgaagacgaacaccagctcatcttcaacttatcccaaatgtttaaatctcctcttaagtcattcagacctaccagatatctcatcattttcatttcttgaaagagtcatcattttttttttctttttcttttttttttgagacggagtctggctctgtcacccaggctggagtgcagtggcatgatctcggctcactgcagactctgcctcccaggttcaagcaattcttcctgcctcagcatcccaagtagctgggactacaggcatgcaccactatgcctggctaatttttgtatttttaatagagatggagttttgccacgttggccaggctagtttcaaactcctgacctcaagtgatccgcctgcctcagcctcccaaagtgctggtattacaggcgtgagccactgcggctggtccattttcatcttgaaatgagtttccctggaagtcttctggcctgctggattatgaacaacttgtcctataatcatcctgggatccagggatctttcttcacaggcatcctggagattatctcctctgttgtatctcctggatctaatgtcatcctcttcttggttcactcgctcattttgttggaacacttcatcggagttccctgggaaagactgcataagaaatacacacttttagttgcatataatgcatatacagacatatagatctatctagatatatgtttttcctgtattctcacacttatttgatagtttagctaggtgtagaattataggttggaagtcattttaattctaaattgtagaggcactgctacatttctactggttcctaatgtgctgtcgagaagttccatgcctttctgcttgtcaatccttttactgcaaacaaaatttttttttttcctgtgctggaagctttcagaaaaatatctgttctaaaattttatgaagaaatatttcttttctatgaatctttaaacttaatttttttttacccatcaaactctttagaaatgtttaattgcaagaagaaatttgtgttttcactatgtaattagtaagagttttttttttagaaatgaatatgaacacatacagattttaaaatgaatgcttcctgctcatttgtatagtggtaaaaacaaaaataaaacaaaatgaatacttctatctaattttattgccttgaaggtattttgatagcagtagttacctcatttttctttcttatttgggcttagtgtataataaattattgagaacaatggggacattctacttaattcttggaaggataagctaggatgcagtctagtcttatttagaacttactctggaatcgatcaactcccttttatactattattattattattagttttagtgttttgttgttgttgtttttgagatggagtctcactctgtcacccaggctggagtgcagtggcgtgatctcggctcactgcaacctccgcctcccgggttcaagcgattctcctgcctcagcctcccaagtagctgggattacaggtacctccccaccatgcctggctaattttttgtacttttagtagagacggggtttcaccatgttggccaggctggtcttgaactcctgacctcaagtgatcctcctgcctcagcctcccaaagtgctgggattacaggtgtgagccgccacacctggcctttagtgtttttttgttaagagactgggtctcggctctgtcacccaggctggagcaagtgcagtggtacaatcctagctgactgtagcctcaaattcctgggctcaagtgatcctcccacctcagcctcccaagtagctaggactacaagcatgtgtcaccatgcccgactaattttttaaagtttttttttgtagagatggggtcttgctttgttgcccaggctggtctcaaactcctggctccaaatgatccttctgcttcagcctcccaaagtacttggattacaggcatgagccactgctcccagccaactcctttttggatttttactcttcctttgcctcttaaaaaaactgcaaaccagtatgtctccaaatgattacctaaaatttttatgtatgctttaaagaatgaataaaaagcaacctatgaacctcctagtaaagtcaagaaattggacattatcaatgccttaaaagacccctgcggccgggtgcagtgactcacgcctgtaatctcagcactttgggaggccgatgtgggcagattgtctgagctcaagagttcgagaccagcctgggcaacatggtgaaaccccatctctgttaaaaaacagaaaaatttaaccgggcctggtgacacacgcctgtagtcccagctattagggaggctgaggcaggagaatggcttgaacctgggaggcggaagttgcagtgagccaagatggcgccattgcactcctgggcgacagagcgtgactctgtctcaaaaaaaaaaaatcaaaaaacaaaaaacaactctgcatgccaaccaccccctaattctgattatatccctgtccctccaatccagaggtaaatgtgatgctcagtttgggttaattattcccttgcttctctttgtggttttaccaactacatatacatccttaaacatatttagctttgtctattcttgaagttcaaataagaagcatactgcatgattcttcttgtaattggctggttttactccacgatgtttttgagattcatccatatttatatgtactacacagttgtagttcacttgttttcattggtaaatagtgtattattttatgaatatataataacttattttactgttgattaacctcgtgggtcgttttcagagtgttgcaaattcaaataatgccctatgaacattcttgtacatattttccagtgctcatgtgtgtttctctaggatacataacaaagtaaagaattgcagagtcatagaactttgcgggtgttcaactccactagataatgcaaagctttttcccaagtggttgcactgatttacattcccattggcctagatgcgtttctattgatttgcttcctcactaacttggtattgcccaaattttaatttttgtcagtgtaattactaataatgttaagcttattttcttcttctttttttctttctttttttttttttgagacggagtttcactcttgttgcccaggctggagtgcaatggcacgatctcggctcaccacaacctccgcctcccaggttcaagtgattctcctgcctcagcctcccgagtagctgggattacaggcatgtgccaccacgcccagctaattttgtatttttagtagagatggggtttctccatgttggtcaggctggtctcggactcccaacctcaggtgatccacccacctcagcctcccaaagtgctgggattacaggtgtgagccaccgcgcccggcagttgagcttattttcatattttcctgcagaatagtcttgttctttctcttcaagagtgtgtcttagctatttttttgccctttggtctttcatattccagagaatatattaaatatcccaagcaggcatggtggttcacacctataatcccagcactttgggaggctgaggtgggaggagtgcacaaggcgaggagtttgagactagcctttgcaacatagctagactccatttctacaaaaaatttttaaaacaaacagggtgtggtagcatgcatctgtagtcccagctacctgggaggcagaggcaggagaatcgcttgagctcaggagtataggttgcaatgagctatgattgtgccactgtactgtggcctgggtgacagagtaaaactttgtctctaaaaaacagaaatatccctctttatccttgatagtattttttaggcctttattagttttttcatgttacatcttttagattattttctttttaatctatctgtgactatatttaaagtcaattcttgttttttccttttcctttttgtgggtaacggggtctcactatgttgcccaggcagatctcaaactcctgggctcaagctgtcctcccacctctgccaccctaagtgttgagattacaggcatgagccactgcacccagccttaaagtgaattgttataggcaacaacacagtggggtcttttattttattttttatttgtttatgagacagactcgctctgttgcctacgctggagtgcagtggtgcagtcttgactcactgcagcctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcctggccaggtcttgctttttaagagtctgacaataactgctttctaattggaatgtttagaacgtttaaatttaatgcaattatgaatatggttggatttaaacctattttaccatttgctttctatttatttcatcacttctttgtttctttttcttttcctgacttcctagggtttagggtttttttttttttcttttttctaccccctccttgagtatttttttttgtactccattttatttctgtcagcttattagctattaatccttattttacctttttactacttgctctagagtttaccatatgcctatttaacatatcatagtaatcttcaaaaatattataacagctgggtgcagtggctcatgcctgtaatcccggtaatttgggaggctgaggcaggcagatcacttgaggtcaagagttccagagcaacctgggcaacatggtgaaaccccgtctctactaaaaatacaaaaaaattagctgggtgtggtggcgcacacctgtaatcccagctgcttgggaggctgaggcacgagaattgcttgaacccaggaagcagacgctgcagaaagctgagatcgtgccactgcactccagcctgggtgacacagtgagactctgggtcaaaaaaatatataacacttgacataaaatgtatgaaccatacaatagtatatttccatttctcccctctcatcctttgtgctattgtcatacattttatttccatgtactttaataaatcttacaatataatgttatatctttgctttaaacaatttaagtacatttttacaacggcaaaagtctttcatatttgccctcttagttatcttatcattcctggtacttttcattcctttgagtagaaccaaatttccatctgctatcattttccttttaaatgatgtgcttcctttcactttttttttttttttttttttttgagatggagtcttgctctgtctcctaggctggagttcagcgccacgatctcggctgactgcaacctctgcctcccgggttcaagtgattctcctgcctcaacctcctgagtagctaggattacaggtgcccaccaccatgccaggctaatttttgtatttttagtagagatagagtttcaccatgttggccaggctggtcttgaactcctgacctcatgatctgcctgcctcagcctcccaaagtgctgggattacaggggtgaaccactgtgcctggtccctttcacattttttgtagtgcagttatgctggcaactgactttatttggcatttgtttgtatgaataagtttatattttaccttccttcatagttcttttccttgatgggcctattaaaatattttttttcttttgtaagccacttcaccccttccctatgggtttgtttttatttacctctacatggctgactttggacagaaacgttaaaagttctacttgttgttttcctgaagctatgcttctatttctggactcatcgccaagtcacctgaaggcaatacaaatgaagtatctgggccacatgcagtggctcacgcctgtaatcccagcactttgggaaactgaggtgggaggataccttgagcccagaaaaaaaaaaaattagcctggcatggtggcacgtgcctgtagtcccagttacttgggaggctgaggtgggaggatcacttgagcctgggagttggaggctacattgatccttggtcgtgtcactaccctcaagcctggacaaaagagtgagaccttgtctcaaaaaaaaaaaaaaaaaaaaaaagtgtccctttgctttactcctgctctccagtgattctacagcatggaataggccactgacttactcacatgtatagttctcatctgtccattttaataattgcaactagagctctttttgaactttctctcttgttcttcaagcatacatcaaacctgagtttagagggtatttgcgtcctagtttcacgagattggcaagtagtttttagagagtatgtttgtggccattcttttcttttgatactgacggagggtttcttttttaattttttgtttgtttaagacagggtcttactctgtcacccaggctggagtgcagtgatgcaatcacggctcactgtagccccaacctcctggcctcaagtgatcttcttgcctcagcacccccaagtagctgggactatacatgcatgccaccctgctagctaatttttagaggaggtctctctatgttgcacaggttggtctggtcttgaacttctgacctcaagtgaaactcctactttggcttcccaaagtgctgggattacaggcatgagccattgcacctggcaatggagtggtttgtggttggttagttttttgtttgtttgtttgtttgtttttgagacagagtttcactcctgttgcccaggctagagtgcaatggtgcgatctcggcttacttcaacttctgcctcttgggttcaagcaattctcctgcctcagcctcccaagtcgctgggattacaggcgtccgccacaacgcccggctaatttttgtatttttagtagaggtgaggtttcaccatgttggtcaggttggtctcaaactcctgacctcaagtgatccacccgcctcagcctcccgaactgctgggattacaggcgtgagccaccatgcctggccttgtttgttttttgttttgttttgagacagagtctcactccattgcccagactagagtgcagtggcacaatctcagctcactgcaacctccgcctcccaggttcaagcgattcttgtgccccagcctcctaagtagctaggactacaggtgtgcgccaccactgcctggttaattttggaattttctttttaatagagacagggttttgccatgttggccaggctggtctcaaacttctggcctcaagtgatctgcccgcctcggcctcccaaagtgctgggattttgggtgtgaaccaccgcactcacagagtttttttctttttttaataaatttttatttgaaattatttagatttgcagaaagtgcaaagtaatacaaagagttcctatatattgccatacccaatttaccctaatgctaacatcttacactagcatatttgtcaaaatcatcagtgtaccaattcatatactgtacattactatttactaaaatccagagtttatttggatttcaccagtttttccactatgttgttttttgttccagaattcataaatagagggttttttttttcctatttttgattctttaagttcatttttgttggttgcatggaggagtgtcatatacgcactcattccaccaaattcccttgatatcctttaccattactttataaaccatttacatttctcttgcagagagccacaacctaagtgccttacctgatgacactgacagagagaatcactggaaatgatagttttatacttaattcttgtcactaaaactctaatagtgtttttaaaaacctaatacaaggccaggcctggcggctcacacctatcatcccagcactttgggatgcctagggaggagaattgctcaaggccagaagtttgaaaccagaacagcctgggcaacatagtgagaccctgtctctgaaaaaacaaaacaaacaacaacagcaacaacaacaacaaaaatacctaacacaaatacttaaatgcatacaactatttttataacttttaacttttacacttagttgtccatttctccaaaatatgaagtcctctgcggaagtgactccagaccttcagagccgtggtgaactttgtgaattactggtaatgaacaccgtcatcttgtctgttttaccagcacatgatcatataattgaaaactgttttgaacaggaatgtctcatcataaataagttaataaattctacaaacatctactaaacatctgttatgttctaggtacagattggggaaatcacaataaaccagtcgggcacaatacctagcttcatgaaatgtatagtcaatctcttctacttcaaggcccagactctcttagactttgttgattagcatccaggctaaatggatcctctctggatcttcatgtggagggcaataaggctggatttgctacttggcctttttaggggttgagaagatgttactttaacaaaagcaagtgcccaacaaaatcataaacccaggtaataggctgaccactttaagctgagaaatcctacctagttctctgggatataagccactactaatttaatgcacacatataccaccttattttgaggctgtgtgttaggtatgttatgtttgtcatccccccacccccaacacacacaaaaaccaacttgctattcacgtgattcattttctatatgaattgaaaaatggcactaaagaaaaaagtttggggatatagaaatagcttattttttaaggaagaaacataacctttctaagtactggatgtgtaatattaaaaatgtagttaaccaaggacagaggctgcacctaatgacttttggaggaaccttcttgctcaagacactatgattctcgttacctggatagtatcacccatggattgtatcatatatgaaccactgaggaacacacattcctgcagatgtttgcagattattaattgctttatatttggagcacccctcccttcaatcagcataaatatttgagggtgggctgtgtttagaagatgtttagtctccaatgattacaacatgatgcaccactctcctatacaaattttgatttaagaaaagattttatttttcaaaggaaaccacaagtgaaagcaatcttgaagattcaatagcagttggtcctatagtgccaggtaagaactttgaagtagcacgtgggattatatgtatttgtaaatatatttgtatacagggcagttgcaaaaaaaagagtatttataattgtccaaagagcttccaaagaggagcagcattgcaacagtgtcgtgtatgagcaaaagtcaagattcttgtggcttctccagagtgcaggcaggaccaaactgatagtaggcaacgtgtctcaggtacaagcaaaccagtccttagaagcaccaatcagtaaacttctttcctgagatttttatttttattcattttattttattttattttatttgagacagggtcttactttgtcacccaggctggaatgcaatggcaagatcatggctcactgcagcgtcgacctcccaggctcaagtgatcctcccatctcagcctccccagtagctgggaccacaagcatgtgccaccacacctggctaatttttgtattttttgtagagacagggttttgccatgttggccaggctggtcttgaactcctaggctcaagcaattcgcctgcctcggtctcccacagtgctgggattacaggcatgagtcactttgcctggcctctttcctgagatgcatggtgcttatgataagcacacattatgtctaggtccctgcttcaagtgtggcactttggacacatgcttcccacattccgattttgtgccaaaacctatgagatgatcgcaatgtgggaatcatggatggctgtggaaaatcctaacacattcgtagtagacaggcagaatcatggaatgaaaaggcatggcgttcagactgagggagatgtgactatgaatccctgttgtgcccccctttctttctctccacagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaaggtatacctgtatatattttggatgactattctgatgtataatttctttttcttactttaagtggttgaaaacttctgaggccatgaaagcatgcatgctcattgatagaacagatataaaataaaccttcactaattttttttgacagtagcatgaattagtgaaaagtccttgaataatagaatggttttcaaataactcagacaaaatgaataaaatatttatattaaattattgaaggttcttaataaagacatgaattatctgttattagtaaaagaattagctatatgtaagatgatgcttagaaattaccttcaccctagctgcctaaaggaagaaaggcctgtagtccctgggaaataaataaattaatgggaaataatatcttcatctatttgtgtcttaactcctctaagcactatttgatagttttcagtgtagacttaacccatctttcattaaatttattcctagatactcatatcttttgaaagtattgtaaatgtcattaaaaatattttttcattttctaattgttgctagtattgctttggtcttaagcagtttgactgttatatgcctaggtgtgctttgctttgtatgtatcttgcttgaggtgcactgaacttttttggaatgtgtgggttgacatttaccaaatttagaaaatttttcatcttttttcaagtactgttttattatggtaaaatacatgtaacaaagcttacattttaatcattttaagtgtacaactcagtggcattaagcattcactatgttgtacaaccatcaccactatccatctccagaaccttttcatcatcccaattaaacaataaattgggccgggcgcgggggctcacgcctgtaatcccagcactttgggaggccgaagagggtggatcgccagagctcaggagtttgagaccaccctgggcaacatggtgaaaccacgtctctactaaaatacaaaaaattagctgggcgtggtggcatgcgcctgtagtcccagctattcgggaggctgaggcatgagaatcacttaagcctgggaggcagaggttgcagtgagcccagatcatgccactgcactccagcttgggctaccgagtgagactccgtctcaaaaaaaaaaaaaaaaaaaaaaaaatcttccctcccaccagcccctgataacttctcttctattttctgtctctatgaatttgcctcttctagatattgtttataagcattatcacttgtctggcttatttcactttgcatactgttcaaggtacatcatgttgtagcctatattggaatttcattccttcacatgtactccataaatatgtacaattattatgtatcaactttgaaaaggaacttcatcctttttatagctaatattccatggtatgtatatagtacattttgtttatccattctgctgctgagagacacttgggttgtttctaccttctggctatcataaataatgctgcaatgaacactggcattataagtatcggtttaagttcttgcttttaatcattttgggtatatacctagaagcagaattgctgattcatatggtagttctatgtttaactttttgaggaacttgcacagtagctgcaccatcttacattcccactatccatgtacaaaggttccaattactccacatcctcttcagcacttgttaatttttgtttttgtggagacagagtctaattctgtcacccaggctggagtgcagtggcgagatcttggctcactgcaacctccacctctcgggttcaagcaattctcctgtctcagcctcctgagtagctgggactacaggtgtgcaccaccatacctggctaacttttgtatttttagtagagatggggtttcgccatgttgcccaagccggtctcgaactcctgagctcaggcagtccagccaccttggcctcccgaagtgctaggattacaggcatgagccacagtgcccgacctgtttttgttttcattgttgtttttcagacagtgtcttgctctattgcccaagctggagtgctgtggtgcaatcatggctcactgcagcctcaacctcttgagctcaggtgatcctcctgcctcagcctcctgagtagctgagactaccagcatgcaccaccgtgcctggataattttttattttttgtagagacagattcttgctatgttgcctagtctggtcttttttctttttctttcttttttttttttgagatggagcctcgctctgtcccccaggctggagtgcagtggcgcaatctcggctcactgcaagctctgcctcctgggttcacgccattctcttgcctcagcctcccaagtagctgggattacaagctcccgccaccacacccagctaatttttgtatttttagtagagatggggtttcaccatgttggccaggctggtcttgaactcctgacctcaggtgatccacccacctcggcctcccaaagtgctgggattacaggcatgagccaccgtgcctggcccctagtctggtcttgaactcctgggctcaaatgatccacccaccttggccttccaaagtgctgggattacaggtatgagccacctcacccagcccattttgttttgtgattatcataaagccgttctagtagttgtgaagtggtatctcattgtggttttgatttgcatttctctaatgcaaatcatgaaaatgatgttaagtatcttttcactttttgaaaaaatatctgtttgctcatttaaaaattgttgttgtttttgttgcattgtaagagttatttgtatattctggatttcaacctgttatcagatacacagtttgaaaatatttttcccattccataggttgtcattttactttatttataatgtcctttgtgcacgaaagttttaaattttgacgaagtccaatttatctgtttttttcttttattgctggtccttttggtgtcctatctaagaatccattgccaaatccaaggtcatgaagattaactcctatgttttttctaagagttgtgtgatttcagcttttatatttaggtcgttgatccattttgagttgattttttttacatggtgagggataggaatccaacttcattctttcgcatgtgcaaatccagttgtccccaaccgtttgttgaagagatgctatatttcttttctcttcttttttttttttttttttttttttgagacggagtctcacactgtagcctgggctggagtgcaatggcgcgatcttggctcactgcaacctccgtctcccaggtttatgtgattctcctgcctcagcctcctgagtagctgggattacagatgcacaccaccatacccagctaattttttttttgtatttttagtagagacggggtttcactatgttggccagactggtctcaaactcctgacctcgtgatccgcccgcctcagcctcccaaagtgctgggattacaggcatgagccactgcgcctagccgagatgctgtatttctttttgtgagtctgaagagtagcacagggcttcccatacagtgcataagctgcaaaaagcaatatcttcatatatgtattctttaaaaaaaaaaaagaatgttttatggtatgtggaaggtttgcatgtgaaaatagctggatgaatcaaaatgacagttttaaaatgtccattcagaactctttagattaataatgggaaactgtgctgctttccagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactaggtaaggatggcactttaatatacttgtttttacgtaagttggaaaagctacttggccaataatttatttaagagttaaagtgcctgtggttctaagggtgtagcctgtatccatggtaaattgtgaggaatagcactctttctcattaagaaagcagagtgctgtttgtaattattgagcctttactacacactaggaagtatcctaagcacttcacaaatatgaactcagtcttcatacccactctatgaagtaaagtactattattattattattattattattttttttttttttttgagacagtctcgcgctgtcgcccaggctggagtgcagtggcacgatctcggctcactgcaagctcctcctctcaggttcaccattctcctgcctcagcctcccaagtagctgggactacaggtgcctgccaccacgcccagctaattttttgtatttttagtagagacggcgtttcaccgtgttagccaggatggtctcgatctcctgacctcatgatcttcccgcctcggcctcccaaagtgctgggattacaggcatgagccaccgtgcctggccaaagtaaagtactattattaatgctattttgtagctgggaaaactgagacataaagagataaagtaattcgtaatatccagctaaggaaatgtatatctgtgactcaaatacaggaattttgactccaaaatctgagttcttaatccctaatataggccgggcctggtgactcacacctgtaatcccagcactttgggaggccgagaagggcagatcacctgaggtcaggagttcgagaccagcctgaccaacatggtgaaaccctgcctctactaaaaatgcaaaaatttgctggcatggtggcatatgcctgtaatcccagctacttgagaggctgaagcaggagaattacctgaacctgggaggcagagattgcaatgtgagccgagatcgcgccattgtactccagcctggggaacaagagtaaaactccatggggaacaagagcaaaactccatggggaacaagagcaaaactccatctcagaaaaaaaaaaaaaaaaagaaagaaatccctaatataatgttgccactccaaaataatttgtagggttattttattttgtttttggttaggctggtcttacattgcaacttacagatctggcagctcagcaggaaggaaatctgctaatccgtagtcattggaagtatttccctgtttctcaccagcctatcctaatagttcatggaaaatggtgcagccatctttcttaaatacatcatttagctaaatgacttaggcaccatcattccttaacttagtaaacactgaacactaaagattgaagaaatatacaactctatggaattgacataaagacttgcatgcaaaagcttcattgttggccaggcacagtgactcacacctgtaatcttagcactttgggtggccgaggcgggaggatcgcctgagagcaggagttcagcaccaggctgggcaatatagcaagacatcgtctctactaaaaaaataaaaaattagccaagtatgatggtgtgcacctatagtccccagctactcaggaggctggtaggatcacttgagtccagaagttcaagcttgcaataagctatgatcatgccactgcactccagcctaggtgatagagcaagaccctgtctcaaaaaaaaaaaaaaaaatatatatatatatatatgtgtgtgtgtgtgtgtgtgcatacatatatacaccgaagctggaggtggtagttatatttgtcagcaaattttgcaacaaatttaggttttgcttcagagttgtcattccttttatgtttcttttttttttttgagacagagtctcaatctgtcacccaggctggagtgcagtggcaccgttgtcagctcactgcaacctccgtctcctgggttcaagcaattctcctgcctcagcctcccaagtagctgggattacaggcgcccatcaccatgcccggctaattttttaatatttttagtagagacggggtttcaccatgttggccaggccagtctcaaactcctgacctcaggtgatccgcccacctcagcctcccaaagtactaggattacaggcgtgagccactatgcccagctgtttctttgtatagtattctttttttttttttttttttttttttggagatgcagtcttgctctgttgcccaggctggagtttggtggcgcaatatccactcactgcaacctctgcctcctgggttcaagcgattctcctgcctcggcctcccgagtagctgggattacagctgcctgccacccacgcctggcaaatgtttgtatttttagtagagacagggtttcaccatgttggccaggctggtctcgagctcctgagctcagatgatccacctgcctcggcctcccaaagtgctgggattacaggcatgagccacagcacctggcctctttgtattcttattgtgtaaatgtcatgtacaaacttagagttattaggtgttaaagctgaaggtgatgctactgagtcaatgcttgtattttatagaagagaaaactgttacccagagagggtcaataatgtgtcaaaattcacattacttgctagttgcagaacctgaacccaagcccagtgacctgattcttagatcatgagatcgtggtacctggttttaattaagtattattgaaacaaaataataaactacttggctaattttgatagaaatttgcagtattttctaatttctgaaaatccttgatcttttacagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttggtaagagttataatattacaatggtggtttaaaatgtttctatggacacagagtcatattaagcactctttaaaaagggccatattttgaggctgggtgtggtggctcatgcctgtaatcccagcactttgggaagctgaggcaggaggcttgcttgaggtcaggggtttgagaccagtctgggcaacataacaagccctccacctctaaaaagctttaaaaaaatcagtcgggcacagtggtacctatagtcccagctactagggaagctaaggcaggaagattacttgagcccagaaggttgaagctgcagcgagctgtgatggtatcactgcactccagcctgggtgacacagaccttgtctctttaaaaaaagaaagaaagaaaagaaaaattgtttctcaaataataaagtataggtgtttccagaattttcttttttacctttacgctcagttggatttgaaatttctagaattttaacaacatttctagttatcagaattattttctgagcaaaaatttgttttatctacttagtcatatgaattcaatctgaattattacattaatttctaatttcttcattttaaagatgttacactttgctgtgagagatgtagctgacataactaaatttttattttccctttcatagttgccagtttgccaaattttatttctctgaagatattaaatcttgaaggccagcaatttcctgatgaggaaacatcagaaaaatttggtatgtttacaaaatagtgctttttacgtattcttattctctttctgcccagaatcctttttctcctattctgaattagccacaaggaagcaagatatgcattagctacccttgcttaccagaacgaagtgatagtcatgctcaacttctacccaccaaatgccttcactacagttttacctgcagacttgatctcattcaaagcagaatgacttcttagagtacatatttggtcattatagcactatgcaatataattgtcaggtatctgttccaaatataagacctcatagtttcaaaggttactagaatataggtaaaaatctatcttttaaggttaggaaaactcaatacgtgaaaacgtgtatttcataaaatgatagctatagaatttaaatactttttgatttttaaaaaacgattatgaaagtaatgtatgctcatggaaaacattctaacaggaaaaaaaaaaaataaagggaggcagtggagatagggactgtagagctgtgctattcaaagtgcttctcaaacataagcgtacataaagattgccaggatcctcctcttcccttccttggaggcagctaggtgggtgggggctgaggtggcagaggtaggatcagggccaaggggatggctggcatacatcataggttgattaagcaaataatacagtgagtatagccagatgcagtggctcacacctgtaatcccagcactttgggaggccgaggtgggtggatcacctgaggtcaggagttcaagaccagcctggccaacatggtgaaaccccatctctactaaaaaatacaaaaatttgctgggcgtggtggcacatgcctgtagtcccagctacttgggaggctgaggcaggagaatctctcgaacctcggaggcagagattgcagtgagccaagatcaggtcactgtactccagcctgggtggcagagcaagactctgtctcaaaaacaaacaaacgaacaaaacagtgagtataatgagagccacgtttcctcacagttggaaaaggaacttacaaatattgaaaggtgaggctagaaagagctttgaggtgttggattagaattggaaatattggtctggcctcatggttttttctaacctatgaacatacatagagatctccatatatatacattgatctccacatgtctatagatacacacatacatatttctcagctcaatggagagactagaaggcactgcagtaataatgaacacaccaagtgcctagatactgatttctaaatcctgtccttccgtaaaggaaccagggtccttgcaaaattggctgattcaagaactgagacagggaaagaaaatgataagcctgggacattgatttatgctagaaattattcaatatatttccatgtgtgaggcctcagaagttacctttctaatgatcaaatgatctatcgtgtgccatgctaggaaggagtcgaagtgaaaaggaaggttctaagagtggtggactgtgaggctttagggccaggaggccggtgcagaatcactgagcatgacagcgggaggtggaatgggaaaggaggtggctgaaggcattgcagagctgggaaaggaacctgcaggtcaggaaaagcttcattctaaacgaggaatggagatttaattggcagcctggactttagtgcaggagagattggttggtagggtgtggtggaggaattgtctggaggagcgaggaagacggaagcatgtgctggcccttctcttgcttcctggactgtgcatgatgtttagaccatacatgattttcagattactgttgcataggaacaaaaagtacaaagagaatagctttttggtcttttctgacagcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattggtgagctagtgtttcagcttgcatggaagccagtggtatagccaagctttctgctgcaacatgtctatgtaaacatttgcccctctagaaattttcaacccgcttcctcattttcactatcatactgttccttctagtgtccttctgtggatttaggcgcattctggtcagatttggaagtacaaaaaggtctcccatttgtggatatacaagccctcaaatctgcgttcttgccacctggtgttttagacacctggccacatactctcctaagtactcctttttaaaactgaagatgaatatacacacagaaaagtacaaaaatcatgtgtactgctcactgaattttattttcttattttcttcttttttttttttttgagacagagtttcgctcgtgttgcccaggctggagtacaatggcacgatctcgggtcactgcaaactctgcctcctgggttcaagcgattctcctgcctcagcctcccaagtagctaggattacaggtgaacgccaccacacctggctaattttgtatttttagtaaacacagggtttcaccatgttggccaggctagtctcgaactcctgacctcaagtgagccacagtgcctggcctgaggaactgagatttctgtcgagacctgaagggagaatggcccaggcatagttggtagaggaggaattgagacatcatttcaaacagaggtaatcacttgtgtcatagcctggagttaaagagaaccagatatatttgaagaacttgggggaaaaaaaggaatgtctggagcaagaggcaggagtgagttgtgagaagaagactggagaggaaagtaaaagcccaattggagaggctttgtcgggtgtgttacaagggctggatctcattttcttactgctcagcactgttattttacgttatttaaaacagctgggagcggtggctcaagcttgtaatcccagcactttgggaggccgaggcggatggatcacgaggtcaggagatcgagaccatcctggctaacatggtgaaaccccgtctctactaaaaatacaaaaaattagccaggcgtgatggcgggcacctgtagtcccagctactcgggaggctgaggcaggagaatggtgtgaacccgggaggtggagcttgaagtgagccaagatcatgccactgcactccagcctgggcaacagaacgagactccgtctcaaaaaaaaaaacaaaaaacaaaaaacaatgacaacttacaacgtttttcttaaaggccttgtttcttcctccttatgaggaagaatttaataacattaaattttgtggtctctctcatcctcatttactataaattatttgtgttttattcttctcactacattaggtcaaagccttccttagaacttcaatctcacacacagatttgagccagtaacccctgtcgctctccctcctgagagcaggtgttttctcttcccggcgcccagcagagtatgcctggcctatagtgggaactcagtaaatatttgttgactgaataaagaaaacttacttttctgtagcttcttctgatggacagctgagaggccattgtttgcctatagtcagtaatgcttaaactttacctgtaggagacagcattcagacacatcacagaaccggctaatcacacaatatgaagtgggagttatgctgaaacaggggaaagaagggaatggatgtgaaagacctgagtctttcttcaagtccctccagaagtgtctttcatgtgggggaatgagaaatatctcttgaatgttactgaagatacctattcaggacatagctgaagacattttctcagtacctctgttgtttaacctcagtcaagctacagccatggattctagattgaaaccaaacttaacctttgcccaagttagaaaaaaaaagaggtttagcaattaaaaacaaggctgggcatggtggctcatgcctgtaatcccaacacgttgggaggccaagatagaaggactgcttgaggccaggagtttgagacaagattgggcaacatagcaagaccttgtctccataaaaaattgaaaaattagccaagcacggtggctagtcctgagtagctaggactcaggaggctgaggcgggaggattgcttgagcccagaaattctaggctgcagtgagttataactgaaccattgcactccagcctaggcaaccaagtgacaccctgtctcaaaaaaaaaaatttttttttttttaaaaacccctaaaccaaacaacaagaactctgcttggtacccattccaaagtctagtcagcctgtgttcattgagaacacagggtgtgcccggcttccatttccttcagagcccttagtctcaaaaacaggagggtcccttctgggcaacagaaatagggcatagcagtggacagtcggatgacatggctttaggaatgtcacacccccttctctataaaaggggaagacataattgctacactctttgaagtcccttgtaatttagtctggatttttttttttttgttttctctttttgttttttagacggagtcttgctctgtcacccaggctggagtgcagtggtgggattttggctcactgcaacctctacctcccaggttcaagctgattctcctgcctcagcctcccgagtagctgggattacaggcatgtaccaccatatccggctgattcttgtatttttagtagagatggggtttcaccatgttggccagcctggtctcgaactcctgacttcaagtgatctacccacctcggcctcccaaaatgctgggattacaagcgtgagccactgtgacttgccaatttagtctggtttgtaggcatgatgtaccttggcatgtgacctcctgtgagaccaaaagagaagctcatatttgtccaggatggtgaaactctcagcacaatggcgtcagtgctttaggcttggctgtacttctttggtttctgcttctcccttagatttttgccaggtggttctttattaacccatcagctctttggggtttttaaggagatattttcaaaatattatattaagctgggcacagtgacacgtgcttgtaatcccacctacttgggaagctgaggcaggaggatcacttgagtccacgagtttgagaccagcctgtgatggccaggcgcggtggctcacgcctgtaatcccagcactttgggaggccaaggcgggtggatcacaaggtcaggagatcgagaccatcctggctaacacagtgaaaccccgtctctactaaaaatacaaaaaattagctgggcatggtggcgggcgcctgtagtcccagctactcgggaggctgaggcaggagaatggcatgaacctgggaggcggaggttgcagtgagctgagatcatgccactgcactgcagcctgggtaacagagcgagactccatctcaaaaaaaaaaaaaaaaaaaaaaaaaaagaaagaaagaaaaagagaccagcctgtgttaacatagcaagaccccatttcaaaaaacaaaattatattgagtacttcctactagcagtagtggtgggagaggaggctggttcaaataaccttgtctaccattattgaaatggaagtccttatgattctattttcatgaatgttttgttcttgtagccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtctctactaaaaatacaaaaaaaaattaaaaaaaaaaaaaaagccaggcatggtggtgtgcacctgtagtctcagctacttgggaggctgaggcaggagaattgcttgaacccaggaggcagaggttgcagtgagccaagatcgtgccactgcattccagcctgggtgacagagcaagactccatttcaaataaataaataaataaataaaataagatgctcctcaacttacaacagggttatatcctgaaaaacccattgtaagtagaaaatattgtatgtcagaaatgcatttaatatacctaaactaccaaacatcatcgcttaacctgacctaccttaaacacgctgagaacacttatattagcttacagttgggcaaaatcataaacacaaagcctattttataataaagtattgaaaatctcacgcaatttattgaatactgtacagaaagtgaaaaatagaggtcgtatgagtacttgaggaacagtttctactgaatgcggatcacttttgcaccattgcaaagtagaaaaatcctaagtcaagtcatcatgagttggggactgtccgtaagagttattaacagaggattggaatggggattgggtagtaaggaataaagagaagcctgggcagatgcagggaacagccgatatgggcttttcaccccaggctgagacagaacaactcaaagaagaaagctcagggctgagatccgggctgagatccagacttcgtgtgagaggacacagctgtgaaagacagaggtttgctgaggctgtggagttgcagctggagaaggtgctgggcttggggcactttgcagagaagggaccttgtgcatgtcaagggaagccattcatgtgggggtactgtgcgctgctgaccattgggtgctgctgaagttaggcaccgcccaagaagtgtgcagccagaacgaggtgctgcagaggcagagtgtatgtgctacaggagctggtattgcagatggcacaggtgttgcaggtgtctgcctagaggagcacaatggaaccaggaaaagcagcccttgccccttcagtgtgtcagcagcaccctcgattgacaaagtttcactctgtgcttactgtcatgggagaggtatttacagggcccagatctattattacagaacagacaatgaagactgaatgtggatataagaggcaacaactagcataactcattaaatctaatagtgcacacataaacacaaaataacctagtaatttcttaatattgactgacaggatatatgcacgtgatgtatttataaattcatggaaaacttatataaaaaacaggcaaccataattgagtttagggaggagaacaggatggctggtggacagaaaagggagagagggaagtttgctttttttctcctgcatacccttttataccagttgagttttgtcccatgtgtgcatactattaaaaaaccataatacttgaccaggtgcagtggctcacgctggtaatcccagcactttgggaggccgaggcgggtggatcacctgaggttgggagttcgagaccagcctgaccaacatggagaaaccttgtctctactaaaaatacaaaattagccacgcatggtggtgccttcctgtaatcccagctactcgggaggctgaggcaggagaattgcttgaacccaggaggcggaggttg

SEQ ID NO: 698 - DNA, 28976 bp, Human; identical to SEQ ID NO: 689

SEQ ID NO: 699 - DNA, 11603 bp, Human
ttctaagagaagggctcagttattattggagggtgggtgtgggggtgccagattctaaagagtacccaggccctatagaaaaaggcccaaattcttaagcagaacctagattcgataaacagggatatatcttttctaaaatggaatttaaagtcctagaccaaaccagcaagttcctgttcactatcaatatgagcagcgtctctgccaactgtgggcccctacagagagaagctgcccttgtggagcagggaatatgatttgagtggagggggctgggatttgtggcacctggagtaagcaggttagcatcatttgggtgaaacaaatctctctggggatgaggagcctgcagggagggagagctgtttgcagagtcccccactcccatcccaaggggcctaatttatttgctggctcctgagaaggaagaagagatctcctggggtggagaggagcccagagaaaacagagactactctcacctggcagcagtcagacactgaacctattctggatagcaccgcccctgcccccagcctagcacctgaggctgacttgtggtcaagactctgtcctgccacagataagcagatagggaggtgcctgcatgttccctctcctgaaggatagaagcaaagtagcagcatgcctgtctccctggacacaggtggttggcttgcgttctgagaacccagtcaggcctggttccgcctggtctgggcctctccaaaagagaagagataagggacagatagccctaggtctggtttctgaacccttttcctgaacttctacttcctagaaagagagaagaggagagcaaggaactgtgtgtgtcaggatgcatgtgggtttgtgtgtgtgttgtgtgtggatggatataggtgtgtgcttgggtgtctctgtgcctgatctctagcagtctgatagtaccctttcctatgtgtgtctggaaggtgtacctgtgtgtccatatgtctgtgtcaggcacctgtgtctctatgttctctgcctttgggtgactgtgccttttttcctgaatgtgtgtgtgtgatgtgtgtgcttgggtgtcactgtgaggacaatgactgtggtgagagctggaacacaaggtgctctgccctctgactcaggatcagcgtctctgagagtaggagtgagaatccctggggacaaccctggctgccccgggaggggccctgcctaagtgccagtgaggaatcctttgtaggtgtccagggaaccctgctttgccccagctgactctctccttgaccccctcctgcgccttgggttctggaccactgaagactcttacagctcccagtattgacattctcaggggctgagctcttttactctgcctccaagataaacaagcctcatgctcagctgggggcttcaggtcaccagctgtcaaagccttggtgccagctgaggacttctccaccacccttctgtgcccacctgagtcctcatgcacacgggaaaagggggcatggacgcagcagagggccacagttttcagaagggaaggggtccagccctacttactaagaggtcctggatccccaacttcttctcaagtcttctccttcccctcattcccagagatgattgggcttccctgagatcgagatccttatcttgggttcccaaatccttctgggaaattcagcctggggagcaaaagacccaggaccagttgtagcaaactgaactcaagaaggagagacgaggcacgcgctggtctttcccgagggggcagtacggtccccacctcccacgcgtcgcgcgctcccgaccggagcgggacggggcctgtcgggggcgcgccaggggcggggcttcgggggcgcgcccaggagggcggagggaagggctgggggcgtggcctaaggctgggggccgacggcggcggcagcagggagctgggaagcggagaagccgggagcgcggggctcagtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcagtgagtcggggaccctgggagtccgcgcgtcccgtctcagtgagagggggagccggtgggcccgagaagtcctgggggatcccggggtgggagtcctgggagaccagagctgggggctgggaggggacggagagggggacgcactctgtgggcgtctaggaaactcgggggtgtctgaagaggctgttgggctatagtaaggagcgctcgggccgtgtggaggaggctgctggaggggccccccaccccatcttggcttctctccgcacccgccgctggaatagcatgcccctgtcccatagtcccaccagttgggctggggtttgggggtagcgctgtgctggggataggccgctgcattttggggcccagggatgacctgtttttggccatgagggcttccaggggttctgtctaggactcctgcttttaaaagtggggtccagagctgaggcagggagtccgaccgagcacctccctagaaggaaggcgaatgggttgtcttggttgtgtggataagcccggctagggtgagctagggctgggtcgctgagttggggggccctgggaatgctgcttggttaggatgggaacgtggggtaccggcgagacggaaggcggcagagagatgtcggtgtgtcacacacgcacacacacgcccgggctggggacggcgaatggctccaagtgtgagcgggcgtgcgcggctgtcagtgtgcgtgtgtgtctgagtgtgtgatttgtgtgtctgcgtcggcgatcgtctgggggtgggagcgggctgcgggtcggggaaggggctgcggtcgctgtccgcgcggccagctgcgtctgggctggggtggctgttggcgccgccgcggtctgggcgggtgtcagggcggccgtgtggtttcccggggtgtgtggcgcggtggccgggtgctggctgcggggccgggtcctcattctgctcagtccttgctgcccttgtcttctcctccccgccaagccgccgtgtgtatctccctggccacatcagtgtgtgtctgtgtgttagtagggggagatccctggggacgcgggggtcactgtcacacctgcccgggcggtggcggcagcactgcctctggctgcccaccccagggaccgaccgaccagggagcaaatggccagaccccaggggaggggaccgggagggccgggcggccgcgacccccaacctctcggaggaggggctgccgctcgccgctccgctctttgttgtttggggctccgcgcctccccctctctccctcctcgcgcccggagtgtcagactgggggtggggatgagccaacgacgcccccctctcgcttcccatggaaacctcgggggtggggacgtggcccctcccccccggagcgggactccaagaactccggggggcgctgggggctgactttccagctctatctagctcagccccctcccccagactcacacgtccgccccccaccccgctagagtctggcggggaacggagagctcgcaggtgaggggccccgggttccccgccacccttggagcacctcagcgttcttaggggaagccagagccggggaggatgcgggaataggtttggtggggggaggtgttgatcaggttcccctcccccgcatacacctgggcgcaggtgaaagctcagggagcgggtgggggagcccgggttccgggagcctcctttctgtcctctctactccgtgcgggcctgggccggcagaggtaggagggggcgcacaccgggccaggaggctgccgccgcccccgcctcgcttcccgggcctttgttgccgctgcgcccgggctccccggctccctcactgcggcagccgcggccccataaatcgtgagagcgacgtgctccggagccgagaatggagagggccggggagctgggggcggggccgaccgagccacaggctcccgcgccccctccccctagtcacgtgagctgggctcctggctcccacctcccgtcacgtgcggagggtctctgccccttggggtcacgtggggagggtcttgcgaccccgcctcctgggggggtcacgtgcgtcggcctcctttgacagacctggggactgtgccttgcacaccggccgcgacctagccctctgccccccactcagtacttccatttagtcccgtggaacaggagagacctgttcccaatctggcccagaaactagggatggggggactgtattggagcgatgcattagagtatgaggtcgaggagtcccctaagccgggaatcgaacttggtgaggggggttgggacggccgatggccaaatatatgccccctggcctgtgtttcatttctttgcagaactgagcaaggatgttggtatttgctccgttctcaaggagcttcgggaacatctttctatatagctgtctctcgacctatctctgaaatgcttctgttgctgatctctctttcattcatgcattcattcaacaaatatttattgaggctctactacgtccctgatggtctttctctgtgttttctcccagtctctgagtctcagccttgcacccttccctgtccctgcttctctcctttgcgtctctgtctccgtctccgccgtctgtgggcctctctggcctgcctgtctctcctgttctccaagactctcggttctcgttctcttccctgcctctctcggtttctgcgtctctctcgcactgtgtctcccttcctttcccctttcagtgaatccggcctctgccaccctccccttgtcggtgtgtgtctccccctcactccgtctctgtgtctcgctttcggcaggtctctcgctcctctccgccgctgcagatcaataaaccttcgccgccgccgccgccgctgtcgcagggaggaggggcggaggtgtcgggcgcgctgattctcccccacccgacgcggcccagggaagccttgcgcccagacctgggctgtccagactgggacgggcggggcgccgaggcccagggcgcctgaggggcgcagaggtgtcagcgtgcaaccgccgccccccagcgttcccgccaccaccgccaccaccctcaaagcccgggcgcgcggaccccacgccgcgcacacgtggtccggcctcgcctgctggagcgggcggcgcgcagcctcgggggcgcgcgctagagggaagaggaacccgggtctacattagtcctccacccctgtaactctgcagcccggcgtctaagaccggggctgggggtggaggatggcgaggatttgacaagttcagggccccctgggatcctttccctactccctggtcttgttggacaccctgtttacctgccctaattgccccgggctgggggagaagtttgctccttccccgctccgcccgcctgccccctccgcggacactccgggttaagtggagccaggcgcgggccggcagggcactgaaagcgagagagaggtgtcgggatgcgcctcagaggctgtgagagccaggagagaccgaaataacggggtgaggggacaccccctccaaatggggtgtgtcggcattcgcctttctgcaagagaggcgagaggctataggggatgaagtggagcaagaagagagaacagtacgaaggggcagggcacaacccggtccccaggtcccagcccacccccacccttccgcaggaggcgcggccctagaggcggggttagctgcggagcttcgcgtgggcccagcggcacctctctctccgcactgctagggagaaggagggaggatgacagattcaattaaagtgcccaagccaagcagacacgttgggtctccaaagagttgtggctgggaattcctggctctcaccccgtttgtccccgtgccctctgtgtaccaactgggcccagccaccccaccggcaggtctttctctcacatgcccagccttgggggggcatttcaggagctgttcctgccacccagcgcaggagtacataacagatggcttcccttcacctgtggtcgccctgcaaccttttttataaggctagtcctgccctgttgaggaaatggaattacctgtaggaataccttgggtgttggcttcctccctgctggaatggggtgtgttgtagggggaactgggcggtacagcagggaggggctgcttcagagtgggactggaaacatgggtgaggctcaaagacagagatcccagtgtggctgtgcagctgctccagacctggcaccctcaccactggaggccccctccccaaggcctgaggggaggaacagactgtgggttggtgacggacaggcaagcctaggatggcagtttggagccaggcctggtctaacccgttttcctgctcccagtgccgcaggccgaggctcctgcccacctgagtgccagggcaagggaggggcctgagtgacccattaatcccatgggaacagagtggggctggtggcattcctgatgaccaaaggaggctgtgccaattcttactggggtacccaaacatcagctctctgcctgcctcactgtcaggcttggaatgggttgctggtggaggggacagcacaagcaaagccaaggaagtggggtcaggggggagggacccccaaggccccaccgtgtgcagaagcctccacgctcatttctttaatggatctaattactgtttggggaactgggtggtgcctggtgacatagggagccagtctctccccccagggagctcccagggactagggaccccgtggtatgacattttgccaaggaccccatgcctttctgtgtccaccactctccttgcactgccaagatatgtgcattcttacgctaaagaaattagggaaaactcctgccccctctccgagtttctttctccattcagaggtttctccatccccacaccgctcactactgccatcgagggtgttaagaccaacactttgatggtgactagcaaggcaggtggggattacaagggacccagcatctgcttctctgtcccaaagagggatcagggaaataagaggcgcagccatcttgtctaggccctgtgcccactgctctgcccagcatcattaaggggggccgttgtgccaggttgaggaaggaggtgcacaatgagacagaagtttgggctggttggcatgatgccatgtggagtcttggtactgagtcccttagcgccctcatgtgtttaaagttcctgggagcctaactgtccttggcctcagggtggggtctctgtcacgggactcaaggtacagaagccagtgatactgtagtatggggagggcagggggagacccccagattggtggggtcaaccaatactggcatgcgggccagcacacatacagcccagcttttctgtgtgtctgctgcctatgagtgggcggtggacatatttgtgcgtgtgccatagaacttatgcatgtatatgcatgaagccgccatacatgcgtctgtaagggcaggtcctgttggactggcctccggggtggactggcagccgcagggaagcatggtgggagaagcgatggagggtgtgtgcgtccctcggaggggatccctcccacgttcacccttggcttccatccctcccatccctcctcccggctgctgaattatgggggatggacggaggaaatccgggcctgggtctgagagtcgctggggcctgcgccgtttctgtggcaaccaaagcgtacgttcccttcttccctccgcccctctccctcgcctccttttctttggaggcaggccgggcttccctgcgcctttgctaccctctggtggccaacaggagaaggacagaccaagaaggagggcacggaaggagacttaggggagcggcggcactagggccccgggggcagagacagggctgagccgcgaggaagctcggaggaaaagtcggaaggctacgcggaccctggggaggggctgcggagcggtcagatggaaagcggctttgctctggggtttcttctctctgagccgcttcctcttccccacagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctgtgagtgacggcggccgggcgggcgggtctgaacgcgagagtctgagtgacagccggggggtggagcccctaggctccggggcggggccggcgcggcgggcgccaggtctcgcggctgagaccagggaggaggcgtgggcacgggacgcctgaggggttcagctcagacgaggtcgtggggccaagagaggagtttggtgacagtcccaagtttgggctgcggagaatcgctgtttctgtgagggacattccggggttggaacatcagggatcccagtttcttgaggggtgggaccaaaggggcgtctagggccgacggcagagctaaagtgacccgtgtccaaagggtaggggagctcctgaaggagaccgcccgacggggacagtttggagggggtgagaaatagagccgtcgagggagggcacaggcacacattgggcgaaagtgactcaggcccggtctcctccccagccacgcccactcacaacctgcactggaagtgtctgaggatgaaggtgttcgtctgctgcgcctccagtgagtagaataggctccgagccgcgcccccatcctcagctccctgctttggggctcccctggcttcctgggggtgggggcggagggcacaggtgaggggggcttgctccccagccgtagcaaggggagggaatcctggccctgactctcccctcctctctccccacccgcaccccaccccgcagcatcgcactccggggagaagccggtccccactctcccccagttcaccatgggccccaatgtgaagatcaacgtgctgggtgagtctgcgcagcgccctctggtggccactgctggaaccgcagccccccgccccggtgcctgctcacctcgcatgccttccctgggggcactgatacttcctaccctgtgggtggtcacgtccctggctccattgctgctgccgcgtgcccctgccctggcgcgcaacccagccctcaccagtctgtctgttcctctgtccacagaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataactgagtgtgtgtgatttcaaggggccatcacccttctgttacactggttaaacctcacagggcacagggcctgagtaggagagggaattctggggccaaagagtcacaacgaggtgttcaaatcttgttctggggctcatcttcattacaaaggcagcgctgcttggaaagagcaagaggggcctccaggcagggcctggttgactttgggcaaatcactcaacctctctgattctcaggtatcccaccagaaaaactggttgtggtatctctctcttagggttggtgtagggattaaatgacgcagggagttaaaggctccatcaattatggtttccaccttttcttccccttccatgctgtaattgaggttcttgactggagtctatggatttcaggggatttgagaacctagacagaaaaaaaactatctttattttcacttgcctataactaaaatttaacattctcttgtgtgcttgggcagcaagccataatagtattaatagtacctgtgactttgtaaccagaaatcacacgttttcaggctgcattatagttgttgaagatatctcaaaatacaatttacactcatcagtactttgaaatgatcatagttgttaggccttcctcatttttaatgtgttaataagaaagcatatatattactatatcaagaaatgtaaatgttttgataactctttcaatataattagctttctttataaccctttgtaattttactcatttcaaacattatgcccaaggtgctgggagtttgctggggctggggctgctcataactacaccaccctgcatcgctcgggagggcagagaggacagaagggcaaaagacaggataatggccgcttcccaggggccccagagaaggtcagggtttacagaccagcacagcataagggagtgcggataggggctgaaatgtacctgcaacttcacttgctgagccaagtgcctggcccagggaggggacaccttattgcca

SEQ ID NO: 700 - DNA, 34621 bp, Human
agaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtccgggcttagaaatgctcttagaaatcaagtcttttgtttttgtttttgttttttaatcacttttaaaaggctttaaaataacgtattttttcaataaaatcttacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctataccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaggtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggcgtctgtcttcctgggaagagggagcagcctgaggcaagtccagaaggcaggctcaagactggaatgctggggtgggtggtgatggccatgggaatggattcaggccccttcctcagcctcattggtcccctctgccccagatgtggatgagtgtgcccgaagccccccaccctgcacctacggccggtgtgagaacacagaaggcagcttccagtgtgtctgccccatgggcttccaacccaacgctgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcagggcctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgcgtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctgggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccggtccttctgcggtgcccacgccgtgtgccagaacctgcccggctccttccagtgcctctgtgaccagggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgatggggaaagcccaggggggttttggaggaggcgcctggcccagcatgagaagaggattagggagttcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctcggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcaggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttatatatatatatatatatatatatatatatatatatatatatatatatatatatatatatatatttttttttttaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggtgagcactgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcactacaggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcagtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttctccaagtctaccccagtttgtgctttgagtcactaaatgacattcccttcccttctgacccctagtttcgtctgtctctctgcctctcttggtctctgtcttccttctctctctgtctctgtcgttctatctcatctctgtctctttctgatttgttttctctgcctaacctctacatcctgtcttttcatttctgtttctgcatgcgtctttctcttttcccttctctttgtttggttctttcatctcgagagcaatcttgcctctggattttttttttttttttttttttttttttgagatggagtctcactctgtcacccaggctggagtgcactggcgccatctccatccactgcaacctctgcctcccggtttcaagcgattctcctgccttagcctcccaaggagccgggattacaggtgcacactacaacccaggctaatttttgtatttttagtagagacggagtttcgccatgttggccaggctggtctcaaactcctggcttcaggtgatccacccaccttggcctcccaaagtgctgggattacaggtgtgagccaccgcacccagcttttattttttagagatgaggtctccctatgttgcccagtctggtctcaaattcctgggctcaagtgatcctcccacctcggcctcccaaagtgctgagattatagatgtgagccaccgtgcttggcctagaagtcttaagctgtcctggaacaagtggggcaagagcagggagcaggagtccctggagggccaaacccagacctgacgctccagctaggagttggctgtggatggagtatggagcggcagtcctgacagctggaggcgggaatgagctctgtgtgtgatggtggagtgcccagcacggacctcctccatgtgccctgcctgcttactggccatgttcctagtccagactcctcctccctaaaaaacaagaacggcctagatcagcataaacttagggcaggagtaggggtcggggatcgtgggtgatcaacttggcactgggccaagctgggaaaaaaaaaaaaaatgtacctcagccaggcgcgatggctcacacatgtaatcccagcgctttgggaggcccaggcaggcggatcacgaggtcaagagatcaagaccatcctggccaacatggtgaaacctggtctcaactaaaaatataaaaattagcccgccatggtggcatgcaactgtaatcccagctatttaggaggcggagataggagaatcacttaaacccaggaggcagaggttgcagtgagccgagatgacgccactgcactccagtctggcgacagagccagactgcatctcaaaaacaaaaacccacaaaactgtacctgtcattcttcacccacctgtcaattcttgtgtccccagggtttcaaactcatatgctgcaaagaccagaaccggaatgttagcaggaagcagggaaaattgaggcacacattaccttctgcctaaggcttggttagactaggaaggggaattttccccattgttaatacttttttttggcctggcggggtggctcacgattgtaatcccagcacttcgggaggccaaggcaggatgatcacttgagctcgggagtttgagaccagcctggcaacatagtgagaccccatctctacaaaaaagtagctgggtgcgatggtacatgcctgtagtcccaactacttgggaggctgaggtgggatgattgcttgagcccaggaggtcgagactgcagtgagctgtgatcgtgcctctgcattccagcctgggtgacaaaggcataccttgtctccaaaaaagttttttttaatgtatatttttaataactatctgatattgtttggctgtgtccccacccaaatctcatctcaaattgtaatcagaattgtaatccggggaaggacctggtgggaggtgattggatcatggggacagtttcccccatg

SEQ ID NO: 701 - DNA, 10319 bp, Human
tcagcaatcagcatgacagcctccagccaagtaatctggagtcatgagagctgctaggggagcaacatgaatcatgacggcccctgggaatttcctgataactaacctgggagtttcggggtaagtcctcaggctgcagcatctctgtttatgttctggtcacgtttatttacaattaatgggttctcaaatccaaacaaaactgaccacagtcttctagaggaagtagcaaggttggctctgaagcctatagcatctctgactcagtctgtcccctggaaggctggcagctcagcaagcacagaagtctctccagaagacagtgggtcacctgcctcccaaaagctgaaaggctaacttgtactttccccagcaggcagctggcatcctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccagtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcaataggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccatagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagtttgagtggatcatttgaggtcaggagttcaagaccagcctggacaacatggtgtaaccctgcctctactaaaaatgcaaaaatcagcctggcatggtggtggatgcctgtagtcccagctacttgggaggctgaggcaggagaattgcttgaacctgggaggcagagatctcagtgagctgagatcacaccactgcactccaactgggcgacagagcaagactccatctcaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgccaggaacccagacaaccggaggcgaccctggtgctatgtgcaggtgggcctaaagccgcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttccgcctcatttctccctcatctgcccctgtccatgcagcccatggccttggggacaagtcgtgctttgaggcctctagggagggaaggaagaagtggcagatttcatgggactaagctgtttgatgggtatcttctcccacagtgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattggtgagggggaaccccgcgactactgtggccataatggcttggggagagtgggacccagggagagactggagctgaggttgaagctgcccggtggggcaggggtggggcgagggaccttgaagcctcgatatacatgacaaagggagtggcagggaagagttccatgaagtctgaggggcctggtgctcctctggagagaccctgaatttccccaacaagtagcctcttgcgagtggaaacagccctgtgggtatatggcttgggctgggaaggccctgtttatatgaattagaaaaagacacaccttcctttgtgggatgcagcctctgtctgtgctaggatatagaacttggagaatggagccttgggatggattccagcctaactacctcagctgggagtttttgcagaaacgacctgtacagctgtatgcagtggctctggccatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccgttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagtgtgatcaagggaagactgcagagttagaggtgggagcactgaggcggtggcagatgggtccagggatggatgaagagtgttgtttagggagcgatgggctgcaaaggtaaatagatggtaggggctataggtggagtaaaggctcagatttgcatggaagagaataagggccttccctggtagagatactttatggttcccctctctggcagactcccagtggacagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgttccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttaaacttgatgtggtagaaaatggggctgcgtcaggcacagtggctcatgcctgtaatcccagcactttgggaggccgaggtggatggatcacttgaggccaggagtttgagaccggcctggccaacatggtgaaaccctgtgtctactaaaaatgcaaaaaaaaattagccaggtgtggtggtgcctgcctgtaatcccagctaatcaggaggctgagacatgggaatcgcttgagcacaggaggcaagtttgcagtgagctgagatcacgtcattgcacgccagcctgggcgacagagcgagattctgtcctccccccgaaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgacaaatctccctggtgcttgtatgggaaggagttggagtacataaaaaggagaaaataacaaaggtggactgcaccctagagtttcttatgggactgcatctctggacttaatggagctttgggaggtagaggttaggagagctgtagggcagggccaccacagcacttaatgtatacaaagtttccccaaaccacaatcccatggctgtgtaagtagtgtacaggcttagtgtcagctcccaattgcctccttaacctgatgcctttgtgcagtgcacatcttgtacagctgtacatggtggtcttctttagggttaactccacaacagtctcttcactctgcccccaacaatccttgagctgacctcaaccaagaagaacacctgtggccaggtgtagtggctcatgcctgtaatcctaacattttgagaggctgaggtgggagaatcgcttgagcccaggagtttgagaccagcctgggaaacttagtgagaccctgtctctgcaaaaaataaaaaaattagccaggtgtggtagcacatgtctgtagtcctagctacttgggaggctgaggcaggaggatcataagccaaggagttcaagtttacagtcagctgattgtgccactgcactccagcctaggtgacagagcaagaccctgtctcaaaaaaaaaaaaaaaaaaaaaagaagaagaagacctgtaagtgaaaattgctggccaggctcagtggctcacgcctgtaatccagcactttgggaagccgaggtgtgtggatcacctgaggtcaggagtttgagaccagcctgaccaacatagtgaaaccccatctctactaaaaatacaaaaaaattagccgggtgtgggggtgggtgcctgtaatcccagctactcgggaggctgaggcaggagaatcatttgaacccgggaggcagaggttgcagtgagccgagatcgcaccactgcactccagcctgggcgacagagggaagacttcgcctcaaataaataaaaaaataaagaaagaaagaaaattgcttatccagaatgccagcttgactctgtggcattcaggaaacaaaaaacataatttcccatcatctgtgtgtgggactgatgctggaattttctcagtgtgttaacagagcttgtgaccagccattgctatgcctatgattagggggcccagaatctcaaagctggatgatgtcctaatgggggtgactatatattttgaacaaaacatcaagttctgaaaagctggggtgtagaaggcaggttgggagataattgggtatcaaaaattagaattgccaagctgtgttaatgggttggggcagtgtttcttaatcgagtcatctgaggaccttttaaaatatgcacacctacactccacctgtagagattgtgattcaggtcagggctggctccaggtctcgtggttttagaaaagctccctcggtgttactaacatgcaccactgattgacagcctttggggacaattggtcagaatatatgaagtgcccagaaaaattcaagatatggtcagcatgagttctctgcatgaacagccagttttctgagtggggtttggtggcacaaggtctcctggatttcctggttaaaggctttctggaccgtgcttccctagagggcaagaactccaagtatttggctttttcttttttttgaggcagggtctcactctgtcacccaggctggagtgcagtggcgcaatcttagctcactgcagcttctgcctcccaggttcaagcgattctcctgcctcagcctcccaagtagctgggattacaagcatgcactaccactacccggctcatttttgtgtttttggtagagatggggtttcaccctgttggccaggctggtctcgaactcccgacctcaggtgatctgcctcccttggtctcccaaagtactgggattagtattcggcttttgatccccatcatctagtgtgctgttttacacaggtt

SEQ ID NO: 702 - DNA, 23776 bp, Human
ttcttcaaggagaactataaaacactgctcaaaaaattagagatgacacaaatagatggaaaaatattccatgatcatgaataggaagaatcaatatcttaaaaatggccatagtgctcaaagccatttatagattcagtaatatttgtattaagttatcattgagattcttcacagaactagaagaatcatatggaaccaaaagttttaaatttaaaaattcatatggaacccaaaaagagctcaaatagtcaaggcaagcctaagcaaaaacaaaaaccgaaaaccaaagctggaggcattatgttacctgacttcaaactatactacagggctacagtaaccaaaacagcatggtactggtacaaaaacaaacacatagaccaatggaacagaatagaaaacccagaaataaaaccacacacctacaactatctgatctttaggaaacctgacaaaaaaaaagtgatggggaaaggattccctattcaacaaactgtgctgggataactggctatccatatgcagacaattgaaactggaccccttccttacaccatatacaaaaaaactaactcaggatggattgattgatggatgtaaaacctaaaactataaaaacctggaagacaacctagacaatacattcaggacacaggcacgggcaaagattttatgactaaaatgccaaaagaaattgcaacaaaagcaaaaattgacaaatgagatctaattaaaccaaagggtttctgcactgcaaaagaaactgtaaacagagtaaactgacaatctacagactgggagaaagtttttgcaaactgtgcatctaacaaaggtctactctccagtatctttaaggaacttaaaccaatttacaagaagaaaacaaacaaccacattaaaatgtgggcaaacgacatgaacacacgcttttcaaaagaagacatacatgtggccaacaatcatataaaaaaagctcaacatcactgatcatgagagaaatgcaaatcaaaaccacaatgagataccatctgatacctgtcagaatggctattattaaaaagtcaagggacacatgttctcaggacctcctgagtgctgatcactcatatttggctcagaaaaatctcttctaatatattacagagtttgactctttttgtccacaataatttggtgcctgaacacgtgaggcctcagataagactcaggaccccaaaggagttgtctcaacctggagctaaggtaccagcaggggcccactgaaagcctccaggattttgagcttcttctctgccagaagtggtaagtcctcctgagccccgacctccctttggttgacggccctttatttattctgatctactatttctttttctttctaggaagttgttgtttaaggatcctacttctagttgggagatacattctaaagggtcttctccattgcttttctccccaaattaatctcgatttggcttgtctgttcacatttgcatgaggaactgaactgttgttttcatagggaaacgagagactgtgtttcctcagcttaaaaaagaaagggcattttgctcctcccagccaaaatgtgggaagtgatgaggggtgcttgtgggaatgtctgggggtgggtggaccccatcgtgatgtgagtggcctacagggaacacccaacaaaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaaggtaagagagccctaatggcagcttgcacgctatagagttcctaagttctctctttctctattttcttttctgcctgctttacatctgctgttacctttctactgagataaaaaccactgtttagatccaaattttttttgcaagctggtaaatttatattaatatctcatggctagagttttgaagtaaaagctacaggatgtctgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtactttgagatgtaagttttgctgattttttctcctaaaaagtgtttcctgtaacatggaaatttagggttatttagctgacaactgcctggggtaaggaaacaggttatgaagagtttgaaagggttgggcgtggtggctcacacttgtattcccagcactttgggaagctgaggtaggtgactcatgtgagatcaggagttcaagaccagcctggccaacatggtgaatccctgtctctactaaaaatgcaaaacttagccaggcagtagtggcacactcgtaatcccagctacttgggagactgagacaggagaatcgcttcagcatgggagatgtaggttgcagtgagctgggatcatgccactgcattccagtctgggtgacagagtgagcccctgcctcaaaaaaaaaaaaaaagaaaaaaagaaaaaaagaaaaaaaaagagtttgaaagtttgagatagaaaaaaagaggttttttgaatctataagatgtactactatcagcatgcctaatgcgtccatgaatctgtgtgtggtgtacataatgtttcactactaaaaatatacaaaagagctctaattaattggcttaaagagaataaaagtgcttaaatcaaatactttatcaggacaagatgcttcttcaagttcacttaagtaaaatctttaataaataagctggctttaaaattattggtaaaataagattagaaatgtcttaagaattgttagcatttttgtttgcacttattgcacaagtggttttgtgcttatccctgcagaatagtataagattttccataagggttataaaactataaacctggccgggcacggtggctcacgcctgtaaccccagcactttgggaggccgaggctggtggatcacctgaggttgggagttcaagagcagcctgacacacacaaaacaaaattataaacccagcccaaaacagaatgatctttgcttgtataatttttaataaataagccatgtaatattgttggttaaataaaaacagctaactactgagatattggttaaaaaaaataactttatatttaaccataagtttccttacttaggtaaacacctgaaattcatagtttataacattggttaacagggaattaactttaagtgatgactgtcacagtgttcataaataatctaggtaaactattaaataagtttatcaagtaaatgcaatggaataaatgcctataaacaaacttgtcacataatttacaatctaaagttatattaaataatagatattaattgactagctgggtaatttataatttaaaaattacaggaaaacatttttaaaaaacaattcttattaaaagataaatatctgtgtttaattcaaagcttttttaaaagttatgtataaaacaagataaatggaaacaggaaataagagatgtaaagacagttataaatataaagaggaattttggtaaaaaagatgaaaaggaaagtaattttacacaagaaagtcttatgtagtgaatttttgtcctgaaataaaataactgatagttcaagaaagagggatatttaggacaaaacaggcagtttaagcatgttgtaagtggtctctgtaagtcacaataagactttttttaaaaaaagaaaggtagtgtaatgtagttggttatgattaagaaatataatagtcattctacagatgggtctttgatatttaaaaaacacaccctaatccaaaactaaataattggttaaaacaaggttttagtaaaatattaacttattcttaatgcaaaaagtttttaatttttaaattctataatctgtctttttgaaattcttccaatgaatatatcaaagttcagctttttctcttttgaaaggccttggatgatagctctctccttcaccttgtgttggcttctgtaacttttattaattatctaaagtaagagaggaatttttatttaaaaacagaaaaatgaaatatcctttagacctgctttttttattctgtatgcctgttatatctgtatcttcatatgtgttatctggaagtgatatttcactaccaaactacatgaaacagctcatcagttgtcttttttaaaaaaaagtaagtgcttatcagattggcagacactagctaagatgcctttgaattcacctgattttaatatttagtaaaattaatttagtaaatttaatcttaaaactctctccagtaattagagctatgttatgttaaacctcgtttttttttttttcacttgaaatttgggttactaaattaaaatagtaggagtataaaatgtttttggtgatgcatataaaacacaaggatataggttttgcaaaaaaaaaagtaggtttttttctagttaagaaactatttaagagttgctttaaaatgaagaaaaaattacggagataaaactaaataaaaagaacaatttagccaggacaacaaaagttaactctgagacctgtgattaccaagaagatagttgatatagaggaagggcaaaaacaagtaactattaaaaccagagggtataatgcaaaggaattgttctgctttttagattgttataatcagtttcttaaaaataatctatgtggtagattgtaaaaaataaccactttaagggccaaattcttaattttttttttgagatggagtcttgctctgttgcccaggctggatggagtgcagtggcgtgatttcggctcactgcaagctctgcctcccaggttcacgcccacattcttaattttaaatgcttcagaatttaagagcttgtttggattgatgcaggacccgtagctcactattaaacaatcactaatgagtatatgagatccaaatgcacaggaggttattccagagagaacaaccagcttagtggaccagacaaacgccactgaaaggtctgttggccctgagaaggggactagccaactctccctataaaacaccaagtgcagcatcccagatgaagcagtgaatatgctttgtatgcgagccaggtggggctggtgtatgaagcatatgaaccaagtaaccattaaaatcaatcaaccgttggtggacacttagtttggtttcatgtctgtgctgttgtgaatagtgctgcaacaaacataatgagtgcagttgtcttatttatttatttattttttattttttgagatggagtttcattcttgttgcccaggctggagtgcaatggtgccatctctgctcactgcaacctccggctcctgggttcaagcgattctcctgccttagcctcccaagtagctgggattacaggtgctcgccaccatgcctagctaattttttgtatttttagtagagacagggtttcaccatgttgcccaggctggtctcacactcccaacctcaggtgatctgcctgtcttggcctcccaaagtgctgggattacaggcgtgagccaccacacctgacccaattgtctttttaatataatgacttttcctttggctggataccatgtaatgggattgctaagtgaaatggtagttctatttttagttctttgagatagctccatattattttccatagaagataaactcatttacattcctaccaaccatgtatcttgctaacatctgttggttctgacttcttaaaagtagccattttgactggtgtaagttgatactcagtgtggttttaagttgaatttctctgatgattaatgatgttgagcattttttaatgtgtttgttggccacttatatttcttgttttgagaaatgtctgttgatggtctttactcagttttccataaagttgtctgtgttttttgtttttttttttcatgttgaattctttgacttccttgcagattctggacattagtcttttgttggaggcataatttgcaaatattttcttccattgtgtaggttgtctgttcattctgttgattgtttcttttgctgtgcagtagcttttaattttaatcatgtctcatttgtctattcgggggtttgttgcatttttaagggtctttaccataagttctttgcctggactaatgtccagaagggtttttcctaaattttgctttaggaattacatagtttcaggtctcacattgaggtctttaattcatcttgagttgatttttgtacatggtgggagataaaggtccagttttattcttttgcatatggctacccagtttttccagcatcctttattgaatagggtgtcctttccccattgtttactttgttgactttagcaaagctcagtatgttgtaggcatgtatctttatttctagtttctctattctgttcccttgatgtctgtgtatatttttgtactagtaaatgctgtcttagttactatggccttatagtataacttgaaatcaggcaatgtgatgtctcctgttttgttctttttgcatagaagtgttttagctgttcaggctggtttttggttccaaatgaatttaaaaattgctttttctctaattctgttaaagaaatgacatttgtaatttaataggaattgtgttgaatctgtagtatgctttgggcaatatggtcattttaacaatattgattcttcccatttgtgagcaaggaatatttttctatttggttgtgttgcctacagttcctttcatcagccttttgtcactctctgtgtagaggtctttcacctccttggttaaatatactcctcagtgtgtgtttgtgtttgtgtgttcttaatttgattctcagcttgaacggtactgatgtatagaaaagctactgatttttgtagcttgatttttttatccagagactttactgaagtcacttaccaagtctacgagtcttctggaagaatcttcagggttttctgggtatatgatcgtgtcatcagcacacacagataatttcactttctcttttccaatgtggatgcactttctttctttctgttgcctgattgctctggctaggacttccagtactgtgttgaataggagtggtgagagtggacatccttatcctgttccatttcttggggaaatgctttcacttctccccattcaattttaaggttggctgtgcgtttgtcatataaggctcttattttggggtatgtttctttcatgcctagtctgttgagggattttatcatgaagggatattggactttctcgaacgctttatctgcatctattgagatgaccatatgctttttgttcttagtttatgtcatgagtcacttttattggcttgcatatattgaaccatcctttcatccctggaatcaagccaacttgatcatgatgaattatgtttttgatacactgttagattccgtttaatagcattttcttgaggatttttgcacctgtgttcctcaggtttcttggcctgtagttttatttttctgttggatccctgtctgattttgctatcagggtgatattggtttcatagaatgagctaggaaagaatcccatcgccttgattttttggaatactttcattatgattggcaccagctcttcgttgtgtatatggcaaatttcgactgtgaatccatctgttcttgggcttttttgccggaagatttttagtactgattctttttggttacttgttattggtctgtttagggtttctattttttgcctgtgcgatcttaggaagttgtatgtgtctaggaattcatccatttctctaggttttctagtttatgtgcataaaggtgttcatagtagtctctgatggtcatttgtatttctgtggcgttggttgtaatgtcaactttatcatttctgattgtgcttatttaaatcttctcctttttttggttagtgtagtcagccatctctcaattttatttatactttcaaaaaaccaacgttttctttcattgattctttgtaatgtttttgtctcaatctcattctttatctgtcctttcagagtttccattgttttcagcatccatcactagcaagccagtgcgatcctttggtggtgccacaatattcagatttttcacagcgtcagaatccttacactgattccttctcttctggagaggcctccacttactctcttcgaatttattttcatttggatgggatttgttttgcacattttcccccggccccgcagggagggtgactgtagagcatgttgggaagggtcttttggcttttcccatggctttgggagcttctgcagcagggtttgtgttgggctgtgcagctcaaattgcaggccaggagctggtgcttaagggtaagagccaccctcggcacaagcaggtggatatggacctggtgtgtttcctgtgaggtgctgactgttgtttcaggggaagggctggaccgtggagtgtcaggtgccctgagctttgtgttccacaggggcgagggaacacccctgggcagagctggaacccccggcttgcccacagatatcccagtgatgagtgcaggcactagtcctgatggacatggctggagcagctcctagtgaaatgccctgaggtctctgcggggggtgaaggagctacaccgtttccagtcccatagggaggaacgttgtctgtctccctatcacacccgtgctccagggctcatgagtctcagttcagacacacactcttgtctctccccaggccacagtgtggctgagggccgtgggaaacacctgccttgccactctctgcaggcgtggttccaaggcagagcctcctccctcagcccagtgcagaccctgagcggctgtctgttgtctgacgtggtagctgcttcatgtaggtgggatgtggggcttctgcctctctggatgggagagtggacgtcagttgtggtggtgttgctggctgggtgggcccgacctcaggccctggggtgagtggtcaggtgccagcagggtaggaaagggcaggtagttcccggatcacaggcccctaggtggccggctggacagcgtgtgtgagtcctgaaggggctggactgggttttggctgctccggggttcagatgctggctgtgatggggagggatgggctggtccccagggcacaggcagaaccctcaggcggggcaggcagaaggctcaggtggtagagcctgcggcagatcacagacctgtggggactgggctctcagaagggctgggggctgcagctgaaatgtccaggtgggggcagggtggctgtgctgtgggcctgtcactagggagggcagcgcccctcggctggggcactggagactggcagctgtgaggcacagggcccgctcacacttccctcctgaagaagtgtcactcggttttgctctggggacacgtgaaagtgccaggcctccccacaccctccctgggcctggggcagcaggggcagaggcagaggtggcagtgactgcaaagggcttgtcaggggcctctgagcattgggctttcagagggcactgagccagggccaccgtgttcgggtgggggcaggacgggtgactggggccctgcagctggcaagccccattagcaggaaggaagccccatttcgcaggaagcaacagaggtgggcagctgtgtggtgctcagcttggctgctcctgtgccccagctgtcatacttattctggggcccacagaggtgcctggcctcctccctccctgctaaggcagtggcagctggacccaggctgctcagggatcagaagcctgtgggattccacgtgggctccagaggcgcctctgcaccatctctgggaactccctgtgcctctgtaggccaaggggggtcaggggctctcctgtgaccaggattgtaaagggccaagacaggggtgtggatcccaggggcctcacacccactcaatctttccctttgttaaggagcctctcactcactcaccccttccccgtgttagggagcctcgcactcactcaccccttccccgtgttagggaccctctcactcaccccttccccgtgttagggagcctcgcactcactcaccccttccccgggttagggagcctcgcactcactcaccccttccccatgttagggaatctctcactcactcaccccttccccgtgttagggaccctctcactcactcaccccttccccgtgttagggactctctcattcactcaccccttccccatgttaggagcctctcactcactcaccccttccccgtgttagagaatctctcactcactcaccccttccccgtgttagagaatctctcactcactcaccccttccccgtgttaggagcctctcctggctcccaccttttctcttctcttctttccatgtcctcatgtttctcaggtgaaccccagcatcctcttggaagatccacttgacctgttggtatttactcactattttgggtcctcttagtgagtaggcagactccagccctttccattcagccaacttgaacctcagcccacaatcattttcttgtcactttttactcttgggaaatccggtcccaatgtgcttgtctttcatttgagaataattttcattttctccagtagttttaaaattactttgtatctattctaggtatcttttactctatcatagttaagacattgatgttatttattaatttgttcacattaaactcatgttctttcttcatttctgtaaaaatgtcaaccattttctttgcaatatttactgaataacgtactccttatttccttcattctgaaagtgtgatccatagagagatacctgtttcctcttctcattccatttcttgtgtgcattaattatgttttctactttattcatttctagtttttctctgatgactaatgaaaaatttaatagatattccacaccaatactatgctcatcatttcagctgtgtcttgttcttatgcaattatttctaaatgtgttgatatgatttactatttttcacctcacagtagcttcctaattcatttctataattgcctgttttttctgtaatggactttttgatttttatttctcttgggtgggtttttctcccacacatgtgatcttccatacagtttctccccgggctgactcaggaaggaaagctgatgaggagcattgctgtggtcactcctgccctgcggtgtccatgctgccaagcttagaatcagctctgtgttctgtccggcatggtggggcccatgtgagcctcacactcacgtgctagagatgcctggtccagcagtgataaagcgcatctgtgtcatgcacacccgggaaggtggctcaatgctgagtgtggcccgggtcactgaggggagctatcccagggtctgtccacaaacacagaagagggagaacaacagtctctctagggtcccacggtttcctccattttttgctttgttctgagagagagacaaagtgccatgactgctctgtgggttggacagatgcatgctttcacctgcaggctggaacccaagctgaggtcttcagcatccccaagtactgataaagcactttaggttgtttttagaaaacactgaaaaattaacccttttgctaaagaggtagaaacaagccctcccctcaacgaaattcctgaaactctcaggttaaacttcgtaacccaatcccttcactgcagacacccaataggaaagtcacatgtgcaaggatgagatgactttggtcaagctcagaccccacagggccaggaaggcctgaaggagaggaggcccatgcttccagctctcagataagagctgcttctaaggactttttaaaaaccccacaagaaacccttccatgtccttcaccccctcctgctttgacaaggtttatcactagatattctttaggatgtcaggaattcagataagatgctctcgagaaaaaacttgcccagcaacggcatctcctccaatggactgacagcaactctggctttgaacctctggaatcagggaactctgtttctaagcagctctgtcagcctctctcttgttgctgataagaacttcctttacttctgtatgtcagagagctctctctatggtgcttttcctctactctcacaccacaggaatcatcctcacagaagaagacttctaggaccagatgtgtgggattttttttcctagacccagtagcggacgccagctgagtgtttaaatgcttcttccccagtgccgtaaacaaatagcacttgaacataaatttaatttactcagcaagaccatttttattttctgcagcaagggtacactcaccagcagttttgcttcgagagtacacaaaacaaaagagacagggtcatttataacctgacacgtccaccctactgctctgtccggtttccactggctggaacaggacctcacactctgtatttgtcccgattggctagtaacttagaacttctgaaaagaggcaaaggtagagcagaacaaaggaaggaggaagtaacttgtggaatgctgagaaaggtgaaaacaccttcaaataaggaagaggaacaggctatgacctaatgcttgcttggaccagtataagcatgccagggcaaatatttaggctaaattgtgggagctaataacataaagtacattgatttatttatcacggctagcagatatttgagaatgttagcatagctctgacactgtctacccagagacagtcccagatcccacagattgaatggttcagtccccaacactgcccccacaccattcccaagtccagacctccagaacttctgactgactggcttcaagttggggaccctatgaccacctctttgggtttgattaatttgctgtagcagctcacagaactcagagagacactgacgtttcctggttgaatacaaagcacactgcagaggacacagatgaagagactcataggaggaggcatgggggaaggggcgcagggcttccataccctccctgggcatcaccctccaggagtctccacatgctcaaccacccagaaacccacgaaacccagtcttcttgggtttttatgaagcttcatgatgtcagtatttcctcccacaaggaacaggctgagaccatcttctgggagggtcttaagagccaccatcagaaaggcagggacattagagtcttgccttgggcaggtgaaggaagggcaggaggaggtcagaggcctcccctaaggcctaacacagccaatgttataacaaaagactgtaacaagggctatggagctatgagccaggaaccgcaggtgaaaaccagtgtgtatcacaacatcacacttccctctccggacacactgtggcttgccatgccatgcactccagattgtaatccttgcttctcactcccaaataaactcaaaatccagacaaccctggagcaacgcagccttgaattcctggggtctcttatatgcacacttttttcaaccaaacgggggtcaaaactgtagcatttgtgggatgcaagacttgtgtatatgaacggcagacttttcctatatgcaggcccagcagagacaatgtcggggctggagtacgagcaggtgttggtgcatgtagggggtactgaaacgaattgcctgtgtatcccaagaaacaactctactgagagatcatattctctaggggtttatttttgtttttatttttattttaagttaaagcttcgggtagaacacccagtgtctccttgtccatctgaagaagatgctgctatgtggaagcacatccttgagatccacaaggagacactgggcaaggagacgagggtgccccactgtgcagaagtctccctaataaatgatctatgaacaccctggtgtttagtgcttctttctttggaatcccagcagctctgtcactggacggtttggtgcactcccttgagggaattcccctgggctgcttggggtccactccagcctcaggtgtagctggaggacgcagcctcccaccttggtctggagccctgagcccctcactgtcattgcagatcccgaggttcctctcctggctccactcagtggtggaaacctccaccctaatgagcccttgatggtcccaggtccctgtggcatctcacctgtggcctctgttctttcctgtggatccatctacacttgggaacttccacatctctttttctgctcatgacattgatgctctgggtatttcagaaatgcccagatagatggacaaatacacgtccatctatccattagggtcagatgtgagatccagagtggacacatcaatcacctacgtagactgtggagtccaacgccaagatcctcttatgtcccaaacacctcaggtcttaccctggtctggaaatcaagcacaaatgagcccctcctaatgttccagcaccactgaccgtacaaccactgtcacgagtgggatttgtgacaacagtcggcaaaggaagaatctgaggctcagagatggttcattaccgcccgaggtcacgtaggcagtggatgataaccagtcgttgaataaatataactcccccccaactccccaaatcaaagctcaaatataagtcattgttcccaaagcgttgaacagggattgaggtgcagagggacggccaagtaagcaaagggcaccgaggaggcaggaaagactcagagatttgttcccggggggtggggttggacactgtagcaaaatattttaaaaaggggaagttaagaggggactatttggttgaaagaaaacccacaatccagtgtcaagaaagaagtcaacttttcttccctatttccctgcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatggtaaggaccccacaacgctgagctgatggacggctgaaggagggagggtgaccatgtgggaggctgtgagaaggaaggagatgcctccgctaccctcgtcaggaagggcagacacaggaaggaaccagttttatttgctgctacatcctggctctcagtgggatgaaaacaaaccagacagacggtggctgggggtcaggaaagggcccattaccatctgaaatgatgcagagggcctagtgactgcccccacctcagccctaatggaatgagagcaagggtcctggggagggcagttccacttcctgtgtggctgcagatgacagcaccccatgagaagaaggacccagcctccgattggccacactctgtgtgtctctctatcctgccagcaccgagggctcatccatccacagagcagggcagtgggaggagacgccatgacccccatcctcacggtcctgatctgtctcggtgagatttgaagaaggaggggagcttctaacctaagagggacctcaccccacagccaaactctggtccctaaggagaccccaggggctcacaaagatcccagggaggggaggacctgcccaggcttcagggggcaaatccctcaccgggaactctcttccagggctgagtctgggccccaggacccacgtgcaggcaggtgagtctgtccccagctcttccaggtccctcctcctcactggggacaaggggccacccccgtgccgctggggatggggaatagcagttctgggctgactgatcggggcgtctggagggtcctgggctgagagctggaatctgctgggttgggtgggaaatgagttagaatccgactcctgatttccttccagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcctaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgagaaattcacagcattgcctggagttccctgagtctccaggcaggtggggagcagccgcgtctcagggcagttccaggtgggatgatgttggggcgagagggctcagggctcctggggccagagacacaggaagatcagcagtgatgtggccccgggggaaagggaagatttgtggggaagcctgagggtcggctcctggaaaccatgaccaccttttcccaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggtgaggagcccagcgggttcagtcagggacccaggctccgcacaggccctgccgggggagctcaggtagtgatggccgggatgagggatgggggtcccaagggagggagagacagacagagacaggggatgggcggggagggggagactcagagaaaacagagacagagacactgagggtcccagagggagacctggggaggtgtcagctcagagcaaggtggggcagcccctcgcccatccttcttctctccaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggtgggggccttgaccctgtcctctctgagctcaaagtctcagctcagaccctgccccaggagagctctgggctgggatggagtgagcgggggtctgagaggggctcagccagtgggagactcaccctcagagggaaggaggagaacagggccctcccaggcctgcccaccctcagtggcatcgccagcatcatggacaggagaggcgggtggagggaggggcctggggaggccacaggtcccatgtagagaaatttggtttgaggtggagacttcaggaaagccccagctcctcagcctcctctcattcttttacccaggaccgtctgggggccccagctccccgacaacaggccccacctccacatctggtgagtccctgaggcttctgaactcaagggagtgcggcctcccccagggcagccctgggtctcccagagaatcccattcccctcaaagactcgagcttccctccagggagccgggcagagccagaggaggggccacagggtccccagggctctgaggctgggctggtgaggggtggggggtcaaggcagagagaaatgttggggcccagcctgggggaggagcagccgggctgatgtggggagcagggcagccccagccctcacctccccgtcctgacccagcaggccctgaggaccagcccctcacccccaccgggtcggatccccagagtggtgagtgacgggctctgagtgggaggtgggcagggtccaggggaggcaggggtgggttctgtcctaggttcagtctcctctggaggtggtgatatagacaggctcctcccctgcttgggcctcagtttctccaaatgtaaaggtgagaggcctgcgggtgggaaagttcctttcagctctgactcccagctgtgacctcctgggagaggaggcctcccagggaacctcccagacccgattccgcgggggcctgtcccgtcccacctgcagcagagacggtgacctggggcaggggaggggagaagagtcatggttcaggacggtcaggctctttccctgcagctccggggctcggctctggtgcaggaacaagggctgcaggtcagactcctgggcttccttcccagctctgccgcttcctggctgggggccccgggcaggcgattcccctctctgagcgtcagtttttcatctgtacagtgggtggggtggatgtttctgtgctgcacgactgttgtgggggttggaggtggtgaacagaaggtccagcagtcacctgcacacagtaggcgctcatttcaatgacatcacccccatccctgacatcatcgtgctcaaggtctgggaaggcacctgggggttgtgatcggcatcttggtggccgtcatcctactgctcctcctcctcctcctcctcttcctcatcctccgacatcgacgtcagggcaaacactggacatcgagtgagtagggaatggggggaccctgagggctgaccgagggtgggctcagggcacagccaaagagaatccaaaccactgggcaaatgcagctttgagaaactgttccagcatttctcaccaggccaatcgacagtcagtcccatctacaaatgtaaagtgtccttcgggctcagtgccatctacaaatgtaaagtgtccttcgggctctgtccatcctatgaggcatttggaacatggaggcaggagtgtttttaggtttccttccttaccttcgagctgtgtgtgcagggcagggggctccaatgttcccagggctgaggctctgtccttcttcccccagcccagagaaaggctgatttccaacatcctgcaggggctgtggggccagagcccacagacagaggcctgcagtggaggtaattctgcccgaagaccccagactcccacctgctcgtggcccatacactgcccctaaagctcccattcttcccccaggtccagcccagctgccgatgcccaggaagaaaacctctgtgagtgagaggaagaggtgaccagccaggagggagatgggggccccgaagtttccgtagcaatggggaaaggggcactggctggaaagggtctggggctcagggtgagatcatctcaccccacactgtggggcctcagggacatcgcagcccctccctgcatctcagtggccccatctgggagctgagcaggggctggcaggactcagaggtcccagggaaccttcccaagagacaaaccccttgctctgccccagcagatgctgccgtgaagcacacacagcctgaggatggggtggagatggacactcgggtgagaccccgcccctgtcccaggcaccaaaggcctcctggtgccagatctaatcctgcagaacttctctgtcctccttcccccggctctcagcatcgtcacggtggacccctccttgtccagcacgctgcctcccgcctgctgcgacctcactctctcctgctgtcctgggacctcgtgggcctcctcccgggtccccttcctgctcctcatcctctgtttggccgtctggttgttagagctctccccaggcctcaggaggatgaggaataaatgaaccaccccggtcccccgggctccccttcattcattcaaccagcgagtgttcccagggagctcactgtggatggggctccccatgggagctgcagacacagcagggagcaaagccgcccccgcctcctgagctcacctcatggtgggagacaaaatgcaaataaatgcatcgtgtccaggagtgcaacgtgctgtaaggaacataaaccagggaaagggcagagagtgtggggcagtggggccagtctgaatggaaggggagggctgtctgctcagctgtcatctgagaagcctggacagagtggggcacacgatcctctgatggacgagcccctgcaggcagaggaaacagccgtgcaaaggccccgaggcagcagcgagctcttgcaggaaggcccgtgaggctgcagccaaatgggcaaggtcagagtgaggagcagaggccagaaccacagggagggagcggccagaccctccacggccttagggcgtccctgagattccatcaggaaagggatgtaatcggatcaccccgggaacagtgaggaaaattgactccagggggtcaggaggattcaaggacaccccccaccactgtctctctccagcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggtgagtcctttcctctccaggcccccaggcctcccccacccccaccacgttccttccctctcactctcccccgctgcaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaagagaaaaaagaaatttagaagaataacaagttattccaaatgaaggcgtaagaaagggaataataacaataataagaggagttgttcatgaggaaaaaccaaagcttgaaaattcaacaaagccagtgaagctcattcttgaaaacatgaatcacactcatgaattctaactacaatgaaaaagagaaagaaagagcaggcatgcatttccatatgggagtgagccagcagacagccctacagatcgtacacacgttttccaaaactaacaatggaacaggcggcaaacctatgccaatatactagaaattgcagattaaatagatgaaatattctaaactggagtttacataatgaacataagagtaatcagagaatctgactcattttagatgtgtgtgtgtgtgtatatatatgtgtgtgtgtgtgaaaaacattgactataataaaaataatctcgagttcacgaagcttcattggtgatttcttacaaatattgacacactaatgaaacacacaaacacacccagagcatcacaaatgtttcttgagaatagaaaaagtggcaatgtgcccaggtgcggtggctcacgcctgtaatctcaacacatagggtggcagaggcggcagattacttgaggctgggagttcaagaccagcctggccaacacggcaaaaccccatctctactaaaaatacaaaaattagtcggacatggtggcgcacactgcagtcccagctacttgggaggcagaggcaggagaatcacttgatcccaggagatggaggctgcagtgagctgagatcccgcccctgcgctccagcctggtcaacagagccagactctgtctcaaaaaattaaaaaaaaaaaaaagtcatgacatataaaatagaattttccattctataacaggcatattttaaactctacagtttttctgtttcaaaataatatttttttaaattttattttaatgttttactttattttatttggcagtttaaaattctacatatttaggatgtgcaacatggtattttaatatgcctgtgaaatcgctaggtcaagctaattaacatctgtaacatcacgtagttatctttctgttaagagaacatttaaaatccactttcttaccaattttcgcgtatgcaatccattgttagcaactgtagtcaccatactgtacaacagatctcctaaacttactcctcctgtccaactgaagtgcggtatccttcgatgcagctctctgattccaccccagcccagctcccggggaccaccttctactctctacttccatgagttcaactggggcaatccgcacataagtgagatcaggcagcaggtgtcttcccgtgccttctttattccgcgtagcgtgacgtcctctaggctcgtccatgttgtcacaaatgaaacaatttccttcttctagaaggcggaatagtttttcgctg

SEQ ID NO: 703 - DNA, 18999 bp, Human
aaatatttggagagaggaggtcagaagcagattcttggcatctgatttcagccctggatcacagaagccagtggagtgggaatggagacaggcagaagctgcaggtgcagataggaggcagcttgggctctaaaggcattttgagctgggtcgggggcggggggacctgggcagggagtcagtagtcccagttctgtcctaattttgcaattctgcattcccatgtcagctcttctctactgtctggggctctgagatattaaaaaggatggggagggcatggtgaaagtagaatcctggtgccagccctgctgacagcatatgtatttccttatagtacctgtttagagatgtgttagtgctctggaggggatagccacaggtgtagtattggaaaacagagggccagacttccaaatgtctgttaacttatccaaggcaaagactgtcccagggcagcagagtaagaacccactttttttttgttttcaaagaagtataatcctgaacaatgaagtaggaaagacagaacacaggaagaggaaggaggtaggacacttattggaacttttaagaaagggaaagagaagaaagaatcgtaagaatatgatagtgtttgaagggcagagacaacactagaaacattgagaaatactctgagaaagattccaagtgtggcagagacaagaatgatgacaaaatagaatttgggatgagacaaaatcagatagtgagagagagaagggaagatggacagatgtatattcacaagaccaacaccagtaagcaaggggagtaggaaggggaagtgggagcattcgaggttcccattatgccaaattatttcctgtctctccttctggccccatttctgtatcggagttataaatagcagagagttggaaagtgtccccccacccccttgcctctgtcccagcctgagggaaagggagaggaagagggacaggccaatgggtccctgtggagatcccatctcagccccacccaggtcctgctgagccagtccaggactctgccccctcccatcccctttcatggataggaaatgtgcagtcctgggacgggtctggtagctggggacaccctttacatccctctgcctcttgggtccagtctctttcatctttgccttctttgacacccactcccctccccactgcttaatttcctcttcctgtaatcatccccagtcgttttcttttctcccttcattccatcccttgtcaattaatctcttgcccttctttcttcctctctattcctttcctttttccatttctccatttgctccccgtatctcccgagtttctctctctcttcttgcctctttttctctgttcccttgaatcctgacgatgtggctagcactgctgtggtcattgccgggctgggggcgggggatgggataggatgggggagggcagcggtctgatcccaacagcagaaagagtgctctatgtgaccatgggggaacagggagcactaagatgccacgctgcacccaggcccaggacggctcccctttcatttcctctctatctgcacatctctcttcccaggttgtcttttagcgtcttcccaacttctcatctcttaccctccttcctctgtttcagcccctctctttctatctgtacttctctccctccgcattccaaggcgccgcctccaccactcccggggtggggatggggttgggggagaaggggaggagagcgccgcgcaggggcggagccggagacggtgctgggcttggggggcgtggtggtggggggtcagcaaggctagtttccaccccagccaccagcctgggcatccccttggagacgggcttgggtctccacctgccgcgggagcgaggggcggggccggaggcggggcctgagtggcgtccccgggagaggaggcgggagccggagtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggtgagtcaccgcacccgcccagagtcgccatgcccgagccacagatcgtccccctccccactctgtgggcctcctcatttctctgttttctagccccaccaagacctagactgcccacagacatcccacatcccaacctggagccttgcctcatctggcttgcgtctgaagctgcacttcccggccctgagaccagtattttgctttagggatgagttggaaagcaaggttcttgtcttggcagcgaaccatctccttcttctgggcctttcccccaacttgcatccttgatccagccccagggcctctggctcccctgcttcttccaagggctgaattccccaagggagggagactgtctgtctctgcttagaatgggaggagatggaaaggacatagaagttgagggtgccatgagagggatgcatgcagggcagactccagaaataacttcctgctagagcattgccatggatggaatgagggcagcagggcactggaaggccaggagagagcttccacttctgtggcttaagaccacgggaagattgggagaggatctgcaggtctgccaacctgcagtaggtggcttggtgatagagagtggcagcaaactgaaccctcaaagtactagtagcagtagtagtagccgcagcagctgtagcagtgagagagatccaggaaggatgctggccaggctgctccccttcctcctccttagcaaatttccaactccaggaatctcagcagctgggaagggccaggaggagtaaggggtggaggacaattctaattttttctaatcagttcaggacccatgggagatggatatacttttgtgaggggcctgtgactggtcatgttgcctgtatccttggctcttgctacatgtctgattgtaaaaagggaggccagaggtgaagaaagcttctcacctgctcctgctagggggcttttctctcttcaaccagtgcctaagccacattaagtatccattactgggatcaatgctgtccactgggactgtcttctgcctctactgtcggtctgggggcagggggcagggacaagagctcatttctcctcacttgcttggggagtgggggcctagctctaatctttcttcttccattatccctatcatctggtagcagggtcggtggtccccaaaactttgggagagatagaaagcaacggacttcatctcctcttctgtttaccatctgcttcctcattcacctttgctccctccctcccttcctccctccttctccatctgtcagagttcgaggactggaggcctttttaggacatgctgaactctctaagctatttccaggcaaattctaggttatttttaatagcttggtctcttgtcatttccccctcctctctgaaggtggcccctggttccgtctcccagagccaagctggggcctttcccagagggcctgactgcctcaccctgcttttgctccagcagggggtgctctgctgctggggggcggggggtatgtgagaggccaggcacctgctcagtccctagcttttgagttgcaggtggcctgccttagcactcactgatgaaaaaaacttcttgcctgttttgatgtcttttagtctagctctgggatgagactttaaggtctaacctttgctgtgtggttccagcctcatttacttccctcaactgtaaaaaggatataaacatagtattactacatagggttgttgtgcagattaagagttcttaatatatataaaatgcttagaatagtgcatagcccgcagtgagtgctgtgaagtgttagtagtattgctattcttgtattgtgattcacagagcgccttacagagattctggatccaaaggcttggctagagggcctccctggctgagccagccttccaggccaagcatcctccccagagggccacccagattgagaggggccaaagaggggctggacttgggctggggccctggagtgtgtggagaatcgagaagtgcagtggtcgtgggctactcctttgtcttcacttagctgagctcccagggggtccctctgccccccagctgccaacacttttttttttttttttttgcttttctctctgcagtggctacactgtggctgtccagaagactggggtggttagggcgtatggcatgaagccaggaaggagtgtgtgtggctggaccagaggtggagggactagagaggatgctgctgggtgctcttgttccactaaggatcgattggtctcttctccaccaagagcggactgggcatatctatgcactcagcttctttcttccacatgggcccctcccctcctccctacttttggcctccagaggagatgtgaacatagaacaaggataacttatctgggtgcttagctatgcactgaccagctgtgacactgggtatctctatgagtccacaaaatgtgtgtgttcagtaaacacattctgacactccctatggggcaagcacaaagatgaaaagacagccccgacactcagagagatggccacttctatgtttggaggctgggggtactgctgacttgcctgaaggttgccatttatttatgcagggctgtatcaccccgtttccttttctgcccagggtaccctcatctccccactctctccttccctttctggggtggtctcagtgttctagagacaggtcagtcactgggtggagtgacaaagtgttggagttaggcccatgtggatttgaattccagcatcactgcttaatgtctttgagtgagttttctcatctgaaagacaagaaaagaatccttatctcataggattgttctgatgattaaatgacataatgcatgtgacttgcctatcctggtgcttggcacatatgtggacagtgatgaatgttagtttcttatatccctggtgtctagcctcggatctgacgtcatagtaggtgctgaataaatatgatttccttgtctcaccagcgcctgacacagggcttggcatacaatagactctcaataagtagttgaatgccaaatgtgtcttctcttctctactactccctataccccttctctgtcttgacactggctctgacaagggatggcagctgctaagagatgaggaggagttgtgggaaggaagaatggctctctgccctccccctccaccccatcagagctggcacagtgccccacagatgcctgtctgtaatactgcctaacatggttttgggccttgccccccaggaagggagatggaggagaagagtgtgggagagaggcgttgaggtttgtcccactgccacttctgagtctctccttctgcaaagagaggacccatggagccagctgggtgtcagtcatcttacctcacccccgccttcactctggcttgggggttcagccccaggggacccaggcagcctccattcccagcactgtgctcccctggggaagacggcttggctgtgatcatggaaaattgtcctgccaagaaagttgtagctgggaaagaggctgagggggaggcaggagagaagactgggtgggggtggaagggaaggagaaatcatggacatggggagaaggaaggatggggaaggggattcaggatgtcgggaagagaatggggtagcattggaggcagaaggagaaacttgtccctacctccatgccagccagagtgactgatggaatcctgggctggcacagcttctgggaggtggggtctttgctgggtccctgatgagggggcagtgggtccgtatctagcctcttgcctggcctctgaagctggtccctgagccacactctgatgccagtctggggccctgttacttttgctcccagcattcttggcatttctggctgggtttcaactggactgggttggggagcagggcagagcttggggatggggccaaggaggggatagggaaggcctactcaggaacaggtgctgggaacaggcagttctttcaaaccagcactgttggcctggctgcttgggttggcgtgtatgtgtgtgtgtgtgtgtgtgtgtgtatctactgtgtatgttgatcccttatccagatagtatgtacatgcaacgtgatgactgcatgaccaagcatattaatttgtccttgccagggtttgagaaaactgacatttgccccttctctttagtccttgaacactctctttagtactgaggggttgggcctgggcagctctaatgagattgggtcattctgacctctaactcctgtccctgtccctgcccctgccccatcttgcaggctgctggtgggtgctccccaggccctggctcttcctgggcagcaggcgaatcgcactggaggcctcttcgcttgcccgttgagcctggaggagactgactgctacagagtggacatcgaccagggaggtgtggccctgcatgaacagagtgggggaagcgtgtgagcggggaggagaggacttgggctcctcttccctcccctaattcccagtgtcctgcctctagctgatatgcaaaaggaaagcaaggagaaccagtggttgggagtcagtgttcggagccaggggcctgggggcaagattgttgtgagtattgcttctcatgactgaatgcacggatggggtgtgtgtgtgtgtgtgtttatggtgtgtgcatacgcataggtgtgcttagagaacacaagttaggaatatggtatgattccaagtacatcagggagatataaaaaggtgtgagacatggtccttgtccttataaatgtaaaaatgtctgtccattcattcatccatccatttgtcaaactcttactgagaaccttttaagcatcaggcattgtgctagttactacaggggaaggctcatgcctgtaatcccagcactttcggaggccgaggcaggtggatcacctgaggtcaggagttcgagaccagccggaccaacatggcgaaaccctgtctctcctaaaaatacaaaaaaattagccgggcgtggccgggtgcggtggctcacgcttgtaatcccagcactttgggaggccgaggtgggtggatcacgaggtaaggagatcgagaccatggtgaaaccccgtctctactaaaaacacaaaaaattagccgggcgtggtggcgggcgcctgtagtcccagctactcagagaggctgaggcaggagaatggcgtgaaccggagaggcggagcttgcagtgagctgagatcgcgccactgcgctccagcctgggtgacagagcgagactccgtctcaaaaaaaaaaaaaaattagctaggtgtggtggcaggcgcctgtaatcccaggtactcgggaggctgaggtaggagaatcacttgaacctgggtggaggaggttgcagtgagctgagatcgcaccattgtaccctagcctgggagacaagagcaaagttccgtctcaaaaccaaccaaacaaacaaacgaaaaaaccagggctctctgtttctctctctctctctatctttcagtaacacgcatagatacacaattaccaatacagatcactgtggggcagaatctggttcatgttaagtgagtggtctagtctccagtctataaaagtccaaaggaggagtagagagaagacttctgcagaggggatgatttgagccaggctttaataataggtaatacctagcctgtgcaacatagtgggacctcatctttataaaaaataaaaacaaattagccagtcatggtggtgcatgcctgtagtcccagctacacaggaggctgaggtgggaggatcacttgagccctggaggtcgaggctgcagtgagccatgattgtgccactgcactccagcctgggtgacagagtgagaccttgcttcaaaaaaaaaaaaaagtaatacttggagagtgaagcggacaggaagttctttgcagatgagatggtgacacttacaaaggtccagggacagggccaagcttggcattttggaggactgtgacatgatcagggagacacacatcctatgtggtggcttaattgtgtcttttggctccaggcagaatgtggaacaaggagatctccatttgagggcaaggaagtgggtgcagacaggttgctgggttatgcatggacctgtgtaacactggcagggtaatggtgcttgagtggtgccggcataggggtgtgtgtgtatgtgtgcatgtgcatgtgcatgtgagcacacatgtatcagtatctgccaaatctctgcatatgggcagcatgcctcaagcaggtccctggcccacagagtgaaatgatccccatcccttcctcccccagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagtgcacgctgggcctgcagctggggcctgcatgctccaacacactagcccacacctcatcactgccattcccgtctccgcacgctgctgctggctgagctgacactcggtgagtgtgatgccacatctgggggaccccaggaagcctgggttggggacagggtggggagagggctagaaagaagaggcagggcttccccgtgtgcctgtctaactcagtgtccggcctgaggggtgttccttgcgccctgccctgggcactaacaggtctgtccttgcaggcacggccagggtggagctctgtgcacagggctcagcggacctggcacacctggacgacggtccctacgaggcggggggagagaaggagcaggacccccgcctcatcccggtccctgccaacagctactttggtagggacctctccccggcccagaactgctctaaccctctgctcctctctcttgtcctctctctccatgctcccatccttctgtctctgtttctgtctctcaccttgtctctctctgtctttctgtctctggctgtgatctctctggtctctttttctctctccacctcttcttcttccaccattttctggcctttctgtggctctgtctccctactctgtggcccctactctggatgtcccctccctggtgtctcaccccaccccccacagggttgctttttgtgaccaacattgatagctcagaccccgaccagctggtgtataaaactttggaccctgctgaccggctcccaggaccagccggagacttggccctcaatagctacttaggtttgtaagctcccacctcctggactctaggggcatggcccagcctcccctccttccccagggaactcgacctttggtgccttataatctcctcctcccccaacacacacccagggagacatacattgggcccaaattgcagagaagagctgggtccaatgatcaggcctaagaggaggaggcccccagggtggtggcctctggggctgtgagccaggggtctccatggaggaagattcaggtggaatgagagggccagggctgaggatattttgggaaggacagtcctgtcttctagggggactttccctgaggggatggatggtgggcacatattgaagaaagggctaatgttgttggtaagtccctctcgttgtctcatctgcattcctctgcagaggaggaggaaaccaggcctgggagatgtttgggtgaagcaggcgctctctcactcccccttgtctccccctcatccatgtgaagacttcccctccctgccaggatgagggagttgggggaaagaggtgcactgggtgggattcgggcctgagagggacctctagctcttctagctccctgggtgtgggcagggtgaggccactgtgctcagcctcctacctgggctcctggccttctcagccatcacctttctctctcttgcccagtccctgaggctgacctcactgcactttttgtgccaagcttgtccctgggcctggtgggtgtgggaggctgccaggccctgtggggaggaagagctatccagctgtggtgctgatgacttggggggacctatcttttggctcttaacctaggggagggggcagggtgcaggggagctgtgacttggctcttaacctgtagggagggggcaggggctgggggagctgtgacacaccccagcttctgagtcttggggtgaagacttaggggtaagtcacccttcccccaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatgggtgagtgggtagagggccgtgccacctgagggaggctgggtctagtagccccagtctggctgaggccacttagcctcctgctggctcctctggccagggaggacccacactgaatgtttccctctctccatagctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccaggtgtgacggggaactggaaaggctcagggagggaggggccacaggagggatggggaagcccctcagaggtcagggtgtggtcttctgaggactcagggagagagggtccctgagcttatgtctgagctgtaccatttaccagctttctgaccttggcaagttcctaacctttttgcgttagtaatatctgcagggagtggccaagaggattaaagatgatgtatgtagagtgcctgggattttgtagcctctcaataaaatagaaaacatacctgagtgactggggggagttgaggcctggatcttgtctgcaaggcccccagccagcgtgactgccttttccctgtgccctgcagatattgcagtgggtgccccctttgatggtgatgggaaagtcttcatctaccatgggagcagcctgggggttgtcgccaaaccttcacaggtgaggggagtcgctgggatgagggaatgggtgtgggtggaatcagcagaggcatcaggggaggcagaggcctgcgggaggtgggattgagggaggctgacagctggttctctaggtgctggagggcgaggctgtgggcatcaagagcttcggctactccctgtcaggcagcttggatatggatgggaaccaataccctgacctgctggtgggctccctggctgacaccgcagtgctcttcaggtgagcccctctcaaccttttccctccctgaggccgtcagcccctccctgtgactctgaccccgacctcagtgccaaatctaatgctgaagagtgtttcccagcctcatgttctcatgtttcttgtgctcttgactccccaatcccagggccagacccatcctccatgtctcccatgaggtctctattgctccacgaagcatcgacctggagcagcccaactgtgctggcggccactcggtctggtgaggtgggatcgggtggcacctggaccctggcagcttcccctgccctccctttgatcctttatctccccagtttggggctggggctgtgacaggatgtgacagatggggtgggggtaggggccttggcccatcagcctcgtttggctcaggagccacctttgcccccgcagtgtggacctaagggtctgtttcagctacattgcagtccccagcagctatagccctactgtgggtgagtgcggtcccccctctgtggctcgcccttttgggtttcccagggaggggggtcacttcgaggtggtagaagagcacccttggaatggggtgagctggagcagctctgcagctcagcagctcctcctttcccaacatgccacagccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggtggacactgaccccttggcttctgagggtcattttcatggctccatctcttttccctgattcctcttagctgctttttcccgagcacactcgtgcctccttctaagacctagacacgtgggaaacctgtcttctgagctcacttcctcctcatctgctgccctctcctgtcatttctgcactccctggaggaggaggaggtgcaaggggcttcatgtcccctcttccagctgaatggaggaggtggcagcttttatcatcacatctggtcctcaaagccctaaaggtttcccctgtcccctaccccagtctttctccctcctccttgctcagttctccacctctctcattcatctccctaatattctttccaagttttagaattggtcctaggtctggctggggcactgagcagggctgaggcctggggattgttccagtgaggaatagaccttcctcttcctaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagaggtgagcatgggttctggtttagcccagggggaggagctgggagggcaaagatcatggtccctccccagtgacaccaattcacagctcacagagccctttcacgtatgctactccagtaattcctcatatctctaggtgcctaaatgaccatgttcctagtcaaggggacagagctcctctactccatgtagtcattcagggggctcaggttgatgggattctgtaatcttcaaatgcggccttcaagctcttgaagtcacattcatcccattcagctggaagggagaacatgaggccccttgcttgcatggtttttatggctggcccagaagtggtgcccttgacatcttttcccgttctaaatccggaactcagttacatgcatgtgagctggggcagtgtggcccagctcttgacttgctgctagtctctaccatggcatggtagtgctcccatcactaccatgatgagaggacccagaggagaggacccagttcaggatcacatggctaataagcagcagatctgagagttgaggacaggttgtttaatcctgtgatactctaacccaccatatgccatggtgacaggtttgccccctgccttgccccctaggaatgccccttatctcatgtctctccccagatccacttcctgaagcaaggctgtggtgaagacaagatctgccagagcaatctgcagctggtccgcgcccgcttctgtacccgggtcagcgacacggaattccaacctctgcccatgtgaggggggcagagagcagggtgggggtgggagggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggtgaggacctgggggcaggatggggtggggtcttgaggggctccagtaacccagactgaccttgccttctctcccattccaggagaagccactctgcctgtccaatgagaatgcctcccatgttgagtgtgagctggggaaccccatgaagagaggtgcccaggttggcacatctgcccttatccctacgtgagtagcctctccataagcccgtagaccacccctgactctaatctctttccacccttggcctaggtcaccttctacctcatccttagcacctccgggatcagcattgagaccacggaactggaggtagagctgctgttggccacgtaagccaggcggggccggaagggtgaggtgggggtagtcatattgacctcatctgaccccttgggaggtgcctgtgcctgatgcccatacttgcccctgcccactcaccaggatcagtgagcaggagctgcatccagtctctgcacgagcccgtgtcttcattgagctgccactgtccattgcagggtgagcctggcccaagggggcacctccattggagggagggggcattgacatttccaaaccttggccagggccctgccttcattgagccaggccccagaccttctcacccctgttctgacctctccacgccagaatggccattccccagcaactcttcttctctggtgtggtgaggggcgagagagccatgcagtctgagcgggatgtgggcagcaaggtcaagtatgaggtcacggtaagtgtcagggatgaggcccctccatggtcaccctccctccttggcacagaggagaggctgagctgtgtccccagggctggggctcttctaccatgtggcagcatgcagtttgaggcctctgtcctgcatatggaccttggctgtgggaaggtgttcctgctggggcctcatttgaccatttcctggtcattctgtctggctgtctcacctgctggtgtggtaggccatgagagtccagggaagcttctctgctgtgggcctcagctgggggatgggaacatggggcggggggttaatgtctctccctagaactctgcctttgcttggctggggcctctcctcacaccttccagggacacttccagggtttcccggatttggtgggtggagagaatggtgcctggtggggtctaggatcctgagtatttgttgaaattgtgtttcctgagggccttctcttcagcccttgttccttccatctctgtggatttaggatccacttgaaagctgagttccttggctgggcacggtggctcatgcctgtaatcacagcactacaggaggccaaggtggcaggatcacttgagcccaggagttagagacaagcctgggcaacatagatcctgtctctacaaaaaattaaaaaaaaaaaaaaaagaaaaactgaggtctctcccctcatactctctttttcccacaggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggtgaggcttaggtgggggtgggggttagatgtggggacagatgttatggggagtaagggtagtgagtgcagtgatggggcaggaggaaggcggtggggaggagattcgatcttagcactgctgtgattggagggacactcactaagaccccccttccgtgtccaggatgtggacagtagggataggaggcggcgggagctggagccacctgagcagcaggagcctggtgagcggcaggagcccagcatgtcctggtggccagtgtcctctgctgagaagaagaaaaacatcaccctggtgagggcaggccagactcggtgcagccagagctccggggtgctgcgtgtccaggaagggtacctgttgagacacatgatggtctgggtgcaagttgaccagatgttcccatcacaattcataggagggggtgcccgggaggcagctactgacactgcagacccccttcctgctcagcccctgcaattgctcactctagaacaggtcactccacctgaagccagttagttagccaagcaattgattcacattacgtttatataaagcattacattttatacgtgatgggatggggttagcccatcctcacactttgaggtctgtttgtcgttcttttgaactcttataagataaaaaagtcaatttgtgtaaggacacttgcttgatttttacagtattaaaaatgttaagttcttttttgttgttgttgagacggagtcttgctctgtcaccaaggctagagtgcagtggcacgatctcagctcactgcaacctctgcctctggttcaagcgattctccttcctcagcctcctaagtagctgggactacaggtgcatgccaccacacccggctgatttttgtatttttagtagagacggggtttcaccatgttggccaggctggctggtctcgaactcctaacctcgagcgatctgtctgcctcggcctcccaaagtgctgggattataggcctgagccacgcgctcagcaaaaacactaaattctaaaagttctaataattaagacaaccgtatattatatgtgatttattaagtttaccccttttgagcagttttgctttccccttttctgcttgttttgcagagttgtgttgtttaggtgaaggtattgagcagatccgcacatgctctgtgcccctccctgctaggatggggctcgcagtgagaatgtggtggggacttagattaggaggtctttggcttgattgtaaggaggtggaggtaaaccccaggtagagccaaggagaccctttgcaggggaatgtcagcagctgctgcagtccctgctttgggccctcagctcccctgggagcatggcatgaggcaaactgaagaacgtcaggggatgtaggaacccatgtcgtggctgttgctctattacatggataatcctcccttctccacgtgaccgatttcctctgagaggcctcccttttaaatgggaactttgaaatagattctttttgttttcatgttaaaatgtatttatttatttaaatgacaaaaattatatttatcatgtataatacaatgttttgaaatatgtatatactgtggaatggctatattgagctaattaacatatgcatcacctcacatacttatttttgtggtaagaacacttaaaatctattctcttagtgattctcaggaatacaatatgttgttattaactacagtccccatgttgtgcattagatctcttaaatagatatctcttccttctgtctaactgaaactttgtatcttttgaccaccatctcctccatctccccagccacaccccgcctccactccagccctaggtaacaactattctactctctacttctatgagttcaactttcagattccacatataagtgagataatgcagtatttatctttctgaatctggcttactttgcttaacataatgtctaaagtagattcttttttattttattttatttttttattttttattttttaattttattattattatactttaagttttagggtacatgtgcacaatgtgcaggttagttacatatgtatacatgtgccatgctggtgtgctgcacccattaactcgtcatttagcattaggtatatctcctaaagctatccctccccactgcccccaccccacaacagtccccagagtgtgatgttccccttcctgtgtccatgtgttctcattgttcaattcccacctatgagtgagaatatgcggtgtttggttttttgttcttgtgatagtttagtgagaatga

SEQ ID NO: 704 - DNA, 40976 bp, Human
gcctccacaaatggtggggttacaggcgtgccactgtgcccatccagattcctgaaaatttaacaattttatgagttggtacatgctgactcgagcacacaccactgggaatagttgtgaggaggacagttgagtgctggggaaaggaaggaagaaaacagtgaggataaagttcacatatctcaccagcttttattacctgatccccatggggaggcccatcagagagtgcctatgacctgttacaatggactctaaaaacacttccctactctttcaagtctccctgtgagcattggttacacttccagtatcccattcttatagtttaactcatgaaaaagggcgggatcctccttctgccaatactagttccttctcctcaatgaaaagttagacacaaactccaaaataaaggcaactcccagaatacaacacagccccaattaaattaaaatggcttttatccaaaagacaggtaataacaaatgctgacaaggatgtggagaaaaagtacccttgtacactgttgttgggaatataagttagtacaaccactgtggagaatggtttgaaggttcctcaaaaaactaaaaatagagctaccatatgatccacaatctcactggtaggtatacacctaaaagaaaagaaatcagtatattgaagagatatctgtactcccatgtttattacagcactattcacaatagccaaggttggaagcgacctaagcgtctatcaccgatgagtggataaagaaaatgtggtacatatacacaatgaagtactattcagctaaaaaagaattagatcctgtcattcacaatgacatggatggaattgaagatcattatgttacgtgaaataagccaggcacagacagacaaactttgcacgttctcacttgcttgtgagaggtaaaaattaaaacaattgaacttgtgggcatagagagtagaaggatggttaccagaggctgaagggtagtgggggttggggaagaagtggggatggttaatgggtacaaaaaaatagaaagaatgaataagaactagtatttgataatacaacagtgtgactatagtcaataataatttaattgcacatttaaaaataaaaatataattgcactgtttgtaacacaaaggataaatatttgaggtgatggatatcccatttaccctgtgtgattattacatattgcatgcctctatcaacatatctcatataccccatacaaatatatgcataccccatacatatatatatacatatacacacacacacacacacacacacacacacacacacacatatatgtatatctactatgtacccacagacgttaaaaattagaggagaaaacacacacacaacaaggagactgagctggaaggatggagctctgggatagatttgtcctacatccctgcctgggagggaatccacacacatgcaagaagacaaactaggagcatgggctactaaattataccacattgcactcatcggggtcacagggtttcttccaagtgacccgcacatgcccttcccatctctgtgtgacagtggcacctgcaccagactgcatgttgaggtgtcatctgaaattatgaaataaaacagaagtaagaggtctattagctcatcaaaatgcagttatctaagttcagctgtgaactgccaaatttgaggagtgatccaatgaaacatcttttctttgcaatccaagaagacttaccggagagaactgctcagagaatctgcaacatccggttcctggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgagtgttcatctgcctgatggtttgagtcccatgttagctgccaggaatcagcgtatcttcgtggatggagagaaggtgcagggctgggtattgtgtttggtcactcttccttagggactggctgtcagtttcaactgcctctttcaaagaggaaggaacattataagttcctgggcccttgggtttccaagactcagccccaccaaccccagtttccaaggaaatgaggggctctaagccaaaggctccagtcacttttctgaccagtcttagggtgacaggccctggtagaagtcttgcttgagtggttggttttacatgggcatcttctggcaaagacccagcctagagagactgagctggatggactgagctctgggagaagatttgccctacatccctgccctgggagggaatctgtgcacatgcaggctgacaaaccaggagcatgggtcaacagaaagcattggctagagtgggaagagagagtagaagtgaaaactccaggcttttggctgagaaccagcagtggccacagtgcggtcatactggtgtgtattttcttggaagagaaggtccaagaaagcaagagggaagaagttgggatttctgaaggctagggctggttacagtatgtgggaaatgcaaattgggaaccctcagagagtagctccagcaggaaggccagacaagagctacctttggatctggactctgttcctgtctttctgtctatcttcttcccaaggcaggctattgctttctgtttagaagtatcagggctatgagaaaaggtatttgagaaagaaaaagccaagcaagaagtggactttggactgcctgtgtgagtggggtgagaatctccttctgcttatttgtttagactgtgggaggtagcctggagtagaagaggtggcattacggacacggggggaaatcctgaggcccagggtgttttaagcttggggttttcaagaccgcaaatccaatatggacttttccaggaaaagcaccgtgatatgccagggatgtgggggtgctgcacaatggatgtgtcttttaccagacagccagacgaacagggcttgctcagcccactttcttttggaatctgcagatccatggctcgtacttcccaaggtctaggggaggaagaactgagctcggggctcagaaaaccaaatcgagccactttaagtggtcacagggaaagccaagcctccgttgttgcaaccaatttgtgactgcaccatttctggagcacctcttggtgactgtaaggtgtgatggagtgatggtgctgaactgtgaactggacttttccatctctgtgcttgctagcctcttggccagcctggcccatagcatcttaggcactgctgaccaatagctcgtcttattgaggctttggaagtcgccggtcagggagaagcaacccagccccacaaggcaagtctatccaatcggaggctgctcacttcattgcatgttttcttctttgaatcttcacaaaagtttttcagtgtttttatttttaaatacacacccttttgtgaagccccaataaaacccagacagaaatgctttgcaaatggggcaggttagtcatgacagatttgcccaagcaagaagcttgattcttgtaaaactggcatccactcccattctcatttctactcagctcaacttctaattcccagtcagaattgtaaaaatcaaaaagtccacatgtcccttccccaagtaaagtgaatttttcatttcccccgatgagatttgttttaatagactttattttttagagcagttttaggttcacagcaaagttgggcagaaagaacagagatttcccatatgccctctgccccatacatacatagcctcccctattatcaatatcccccaccaggatggtacatttgttataattgatgaccttatgtcaatgagttttttttattcctccatgcagttcctctgcacccccttcacacactttgggggaaggtgagggacaagtgcgtgggttctagacttggcctaaccttgcgtgttcagtggcccattctatcccaagatgtcaatctaggcacttctatttctcaaaaatattaatactgtgatgtgatgctgtcactttcactgtctccctcactggactggaaatcagagtatcagggctaattggtttaatccatagatttgactttgaatgatcccattcagcaactattaaggacacatgatgtggcagccactgtgcaagggtgcaaggtgtggggaaaacaaaatgaacaacagccactgcccagcacctgacactgtgtctgtactgagagcctgtccacaaatatttgttgagtgaataatactggtatatactgcatacttgccatataccaggcactgttctaaatgctttatgtgtgtcagtcatttcattttcacaccaaccctataagaaatgtatgtattattggtaccattacaactttataaatgaggaaaggggcacagagtagtttagcaatttctctgcgctcacatagctgcctgactccagaggcctcaatgagtaaaactggacaagcctatgtttgggaagcaggggtggagagaatgccaaaatttgtatccaggtcccatggtaaaaattagaatgtgctatctataattgaaaaatatgagttgaattgaattggaataaattgaagtatagaaatgtccaaaaggtgagagactgataaaaatcacagaagaacgtagagggcatataagaagtatttgacctggaatttggaaaatgaaaactttttttcatcatgcaaatgttcatttaatttttttttgttaactagtttgtttattgattatcacatctataaaacatgtcatgtctatgaaacttcaacagtacacaagagtatttagtgaagactaatttcccttccatacctcatgctggaggcaaccactgtgaccagtttcttgtgtgtctttccaaatgtataggtcttcgtgtttgatagatcagtacggtgactatagttaacaataatctattgtacatatcaaaataactggaagagaataattcaaatgttcttagcataaagaaaagagaaatactcaaggtgatacatatcccaattaacccgatttgatctttacacaacatgtgagtgtatcagacagcacatgtgccctgaaaatatatacatctattatgtatcaattttttaacatggcagagaagaaatcagagataaagagggtggggaaataaaacttctctcgacttttcagtgtcctggtgaagagtactagctctgacattttttcataccataagaattaaatctgtagttatttgcataggtaattgctctgatccaaacgaataataaaatttttcccgagaggagcaaatggttatagcctgaacaaggtccctaggtagagcgcccagggtgccatgaagcctggagtcactatcttcctaagcaggccagcataagcttgtgccatcattatgcaacatgcaagaaggaatgagccccagaacttggagtcaagtcccaggacttgccataaaagccaagacatgtaacggactatctggctcctggagagatttatctacctaccaaagtgttggaataaggagcagacctttaagacggggaggggggatagctgcctcctccctcttttataggtagggaaaataatttgtccttgtttcttacctatggagtgtctgtttactcacatagagcaattgaccttgctcttatcacatcatcctagggggaagggggggccaaagcatttactatttactgtgagtcatttaataagaaatttaactctaatccagtatatctcatgtgcacatttgggataaagttaataaaaatgaatattaaaaacttagccccaaataaatgggtccgatgggcttgatttttatggaacttgagaaggagcgttctagaaggaggcacaaatgcagaggtaaagggtttcaagtgttcttggcaagttgtctgttgtacctgaaacctagggtttatatttaaggcacttccatgtcctcagctggcaagtggggaaaagggtccccaccactttcttccataatatacctcttagggatactataaaggcaaatcagagtacattctgcttttggagggaggagaacttggactctgtgttgtcatttgctcatttttcattcatcccattctgttttattaattcacttgggcaacaaggatttactgagctcctactatgtcccaggtgggtgttagggatactgtagtgaataaaacagacacagtccctactcttggaagcttataagagtgggggattacaggcattgaaccagagttgaacacgtgatgaatgatatgaaggagtgcgttcattgtccattggaagtctgtgacaggaaaacccaacctaagtcaggagtcaggaaagtcttccctatgaaagagatgtcaaaatggagaccagaaagatggaagttgttagctaggcaaataaagagtggttatagcctctaaggctagggaacgtacatactaatagtctaagatagaaagacccagcagtgccaaataataaaaataggactttgactgatggggatacagtttaaaaagcaaacacagacaagatgtcttttctttctgagcctaaatttaccaaaagaactgtggggtctgtaagttctgttccttctgtacctgaaagaatactgtagcaagatgctaaaagcacatatgaaagtgtcagggctaggcaaaaaaatataatacaataaaacaaaaagagttatcattaggtagaagcccatcttgtgagagggttggctaaatcctactattaataatttttgaccaaactccataggcccatgtgaatcactcatttttcgaagtagaattacccatgaaggaaagtgagttggtgttaacagctacaaatgtttcctcccagactcttttagtaaataagggctggctgaatcacagacacactggaaaacactcatctagcaggatgtttcaggagcagggacgccactcgaggggttttatgaaccactttaaagcccccacttatttttccaccttgtgcttatgtgagggtgatctcaagtaccccctccagaccccaacactcacacactcaggtattgcgtcatcattctttatgtgggttgtggggtataagggtctcttcctgatgaagttttggttccactcctcatgactgagtgtgcataaaaccactcagcctctctcatctacccctcccttttcctcttcctctttctccttctatgttctttcgtttattttatttttttatttttttatttttttggttattccctacctctcttatatccctctttctcctcccccaatcaactccaagttctgaaagcaaccatggcgcaaagagtgtgcaaggttaggtggggaaggagtgcatgggagccattttggggagtggtggcgatgggttatggcctgaaaatgggattttttattctttttttctccctatcaaagttggtctttaaaaatcaacactacgctagcaatttttaatcttgttttgaatctcagatccctttaagagatggcatttatggatgtgctcccagaaaaatatgtatacgctcatctatacaactttttatacaaaagtctggaagttcatacttgcacatatggctttaaattttttctcatttctttatacacagaagtttaggttcaggattcaagaagttactcttttaggtactgtgcctacaagtcaggtatgtagccaccaaaggggtcacattatctagacagtcaggcatccataagtgtggtggaagaaaatccaacatgcttcccagtatattaatgtaaaaacaaccaccaccaccacaataactataatgttcctcatgtcatcaagcagcaggggagagcactctgttttaagcttaatatattcgcaatattttaaaagacaaatgcctaattgcctttctcacttttcctcaacaattaagaatttcaatcactctaggccagattttagcccagatagacttctttttcttcttccccaatcactgaatctctagtctactattagctgagccctttactgagcaacatggggatttcggggtattttggtgacaagaatatttgggccagtgtgtccaattttccaatagctcatcttagccacaagtcagttgtgaaagagtctcttctaggtagctgcattacttaagctgatggttctattttactctctgactttcttatcagctagaacaatctatgctctctttgagtcatgggctccttcttttatgaacactagcttatggttaagttcagatatatatatatgtgtatgtatatatatatgtatgtgtgtgtgtatatatatatatgtgtgtgtgtgtgtgtatatatatatatatatatatatatatatatatatgacaaacctaataacctaaataagaggctttggtcaggtattatggttttcagcattcattcattgaacagatatttattaaatgcctcctatatactaagcacatagcacctgtttgtaggtcttggggtcaaaatagtgaacaaaatgaagttcttcctcttgaggcttttgcattctagtgggagagacaaaaataaaacaaacaaatatacagtataatataatgcagtgataagtgcagaaagaaacacaaagctattttagatagatggtcagaggaggcctcttggaggagaaactgttttgagcagatacctaaaataaagtgaaagaatgagctacccaggtatggaagggaagaaattcttcagagagaggaacagcaaaagcaaaagttctgagacaggaatgttcttggtgggtttaagaaacagccaggagccagtgtggccgtagcacagtgagcaaagaggagggcaggaaatggagttggaacagtgccacggactgggcatgcagggcctttgaagccatatcaataatggactatggttttattctatcggtgctagaaagccacagaaatttaaaagcaggagagagacaaaataggacatggtttttaaagatgattccatctattgtatgaatgcagggagatcagctggaagaagacggcagtacccaggcctgggatgatggtggtggaaatgcaggaggtgaaaagggttcagataccagacatattttgaagtcagagccaggaggatttgctgttaaaatgagtgtggagtatggctgggcacagtggctcatgcctgtaatcccagcactttgggaggccgaggcgggcagatcacttgaggtcaggagttcgaaaccagcctggccaacatggtgaaaccccgtctttactaaaaatacaaaaaattagcagtgcatggtggcaggcacctgtaatcccagctacccaggagactgaggcaggggacttgcttgagcccgggaggcagaggttgcagtgagccgagatcgcaacattgcactccagcctgggcgacagcacaagactccatctcacagaaaaaaaaaaattgagtttggagtatgcgagaaagaaaggaatcaaggatgtttccagtgttttggcctgacaaattggctgaattataatgtttgcagaaggtgttctggaaccaagagtttgtttgctaagtttgaaatgccctttagacctccaagtcctgtcttgtgtaggcagttgggagtgcagtgaaggttttggttgggagatataaccctgtagcatcccagaaatatgtcagactgtgcaattgggtgagaaactggatgagtgtggatgagaatgagaactccgagtactgagatgctccagtatttagaagtccagaagagcagaaggctcctgccaagaaaactgagcagaggcaacctatataggataggagaaaaaccgggagagtatgttgttccctgagccaaatgatgacagcgtttgaaggagggatggatgaactatgtcaagtacccctgagaaagcaagtaagataagaactttgacttggcttagtggagtagacagtgaccttgacaaaggtggttccagcgagcagtggggaagaacacctgtttatagtgggtccaaggaaaaatgggtctggaaatgggaaaagaaactataaacacacattaaagcactttgctgtaaaggaaaacagaaatggagaggtatctggggatggacctgggatcaggggagatagttttaatataaggaaactacaagtttatatgttgtgtattgatggaaataacctagtaaaaaaaaacctgataatgtgagggacagaggcaattgccgaaacaaagccttgaagtaggtgagtgctccgtggaggaagaggctcgacttaagtgggaatgtagaccatccatccaggtaggtaggttgatttagtggtggtaataagtggaagttctctttttgtgttttctattttatacttcagtgaaacaaaaagcaaagtcgtcacatgagagaggagggggaaaggcaggttgtgggtttgaggagagaggaggtgtgaaataatcagcagcaggaaccctcatagtggtttgaaaggctcttggtatttttttttttaaccttgttgttggctcagcttttttggaaaagagaaatacagtaatatctcactgtcgacattattaactatctcagggtgtttggagagagaggattccacagtttgaacactgggcttatcacttcctgactccacattcctcagatttttctgttttcctcatgatctgaaatgcttcctgggctcatgagctcagaatcacttttatttgctctccatccttcatcctgtatattcaatggtggaaaaaaccctggtagaggaattagcagaactgaattctaatcctgactctgccacttactagttagggaagccatttaacttctctgtgctttttagatgcctgaacaataaatctgagttgataaagacccagtactctagttaatctatacaactctatcctaagtaatttgaagatttctattgacagttttgaagtattgagaatatagtggggatcctcaaggcagttcttatagaccacgaaggacttggcaaccccagggatagccaaagaggaagagggagagcctccagtctgtccttcctgatctgctgacacgatgttgtctaaaggccttaataataagggactctcttctcctccctcccacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatggtaataatggcggcttccccagtccacactaaagggccaaggtgctcctttgaccaagaatttaggtctctcttaaaagcaaagggtattcagaattggaagtaactagaatgatcttctagtttgggggtatttaaacctgctgcatggaagacgttttaaaggttgacatttttttttccaaattgcatattgatggtagctgattaagcattagttactcttactcccatttcccaaaggaaaggggcacagctccttgtgggctggagggccgatagacccaaggatcttggtttgcaagtaatattttatttgaaaataggatttttttctgattaaaagaagttgaataccacagatcaaacccagtctctcctacatgaggacagtgaaatctaaccagaagcggttagcacatttacacacatttgtgtaggtgtttcactgcactgggggttctggataaagatggctaaaattcagcccacacaccacttgttaagccctgcattccggcaccagatcatacctacttggtggaagaagtgccttttggcatttaaacaaaggctttggttataaagtcttttagttgctgtacttaaactaggaaccaagtccacctgaatccaaggccagtgcttttttgagcctttttaactaccagtccctcttgagtgcacccagggattgtgtctcttaggcccagagactcatctgaattcccagggatcctgatagccacatggggctttcctgcttcttcaaaatgacttccttatctctggggatgggacaggaattcccacctaaccagcatttctttgaaattctcaaatatctagagggaaggcagcaatactctcaccaatcctccctcaacccagcattccctttccttcaaacagtgcctgcggaattcccatggccctcccccaggtacctgagagtcatttccagcagtggctccaggcacgactgccatgagcgtggaggctgcacatgatgcattttccaaaacggtgtggatgccagacattctgtcctttggttcctatgtttcctgtttttgtcacatcttgtgatcaaattcttactttggaaaatgtggtctctgcaaccatggcatttttctcaagccaaaggaagagtttggattttgaagtcagacagacctaggttcagatcttaacttggccacttagaagctgtgagttgtaagatattccacctccctgggacttggctttctcatctataaaatggggaataattacaactagagttataattgttgagaagattaaaaaagatgatgaggtggctcacgcctgtaatctcagcactttgggaggccgaggcgggcggatcacaaggtcaggagatcgagaccatcctggctatggtggtgaaaccccatctctactaaaaatacaaaaaaaaaaaaaaattagctcagcatggtggtgggcacctgtagtcccagctactcgggaggctgaggcaggagaatggcgtgaacccaggaggtggagcttgcagtgagctgagattgtgccactgcactccagcttaggtgacagagcgagactctgtctcaaaaaaaaaaaaaaaaaagatgatgaatgtgaaacaccagcactgtgcttgtcctataatagttgctaaataagcaagaatttaccttttatgtggcctatttcatggccttagagtgggatagattgatgaggcctatggttataattgaggacctatcactatctcagacacacaaaagcacttactacacacccacccactcactcacccatgcgcccgtgtacatgcgcgcgcgcgcacgcacacacatacacacacacaccctcccacacacatcacgatagatgaaatcccaccactaaaaagccattcttttaggtctaggaagtaacaacgtaagccaactaaaaaccatggtggattagttgacagcaaactccactgataggagacaggagaatagcaacttaggtcaaggacatcaggaagggcgagtggagccctaacaatattggtagaagaggcctaaaaagcaaattcttattttctattttatcccaaggtggtcttagaaaggatgtagtggggcatgatggacagtgtgaagcaatagattccccactagaaataaatcacattgagggggagggaaaatgccattaggctgtactttgttctaacaaaaaggtcaagtgagaattcccaggggttcacttcagtgatggctcccttcctcccactcctgacagagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcaggtgagtacactggtggcagcctgtgtgccaccttaatgagcatgggctcagtcttcacatggtccaattgctccccagccatggcattcaccttagtaacaatactttacattttctttatagtttgcaaaagtttaccatgtgcatttagtgagctcactctcatattgaccagggtggcatttttatgctcagttcacagttgacgaaaccaacaggaggtgatagagccagacccagagcctaagtctccaaggcgtagccttctctgcctcttgccttgactccaacctgcaaggttggctgggtgagggattgcaggtgggagggcctggctcccaagtctatgctccactaatgctggggcagttctacaccgtcaattagtatttactgatcacctacctggtaagaaattgtgaataaatatgatatgtgatctctcctctctaacaattcattgtaaagataagacgtaaaacattgcttaataatgaaacacaggatatagtgaaggtcctcgttttatggaatggactgtgaatcccatagcagggccaggggagtcagaacgagagactaagacctggactgtgaagtttgaggaaaaataataaattgcacagcgcttcatcattagcaaagcactctcaactgtgtaatctcttttgatcctcacaataaccttgccagataggtgttatactttcattttacagatgaggaaattgacgttcataccatttaagtaccctcttcaagtttctttggcatgtagatagtggagttaacccctaaacctacatcttctgactgttcttcctctagaaagaaaagcatcattattctgtcagcaaaaggaagacagaacttactaagtaagcccatttaaccacttggatacaggacagaacacaggcccttttcactaacagatcttgtgtccctgcctcaggcaggttcagggactgtaggaccagggtgttgctctgcaaggcattgcttacaccctgacattctcctctctgcatccactggggggacataggaatcgttccaatgggtcttctgcctacagtagccatggtgtccatgtggagggctttcccaggtggtcatggttgagggacaggggaactcagccaagtaatgcccttccacatagcactgcctgtcacagagactcccctggagtattcccagatggactgctgggaaaatcccacctggcctccagtgtgcccctggaagttcttgaatgagtctaaccccctgcatgtttcctccccagacatttcatagccagagtcccccgtcctctcacttactggatatgtctggctgcttgcccaccttgcatacaaaccacattcagaggctaccccccagttcagagcgctctccccacccacagtcatttagaaggtgctggcaggacaagcaagctgtgcagcatagtgggtagcttacagaatgtgaccccggaagtcctagagccaatgctgccctttctacttacaagggcaagtgcctcaatccctctgagatttagattcttcatctctaaataacagcaactggcgggtcatcatggtttactatgtgccagttatgtggcatctcagttaatcctcacagcaacaaaataatattgatagtatccccacttcacagatgaggaaacaaagctataacatggttaagtaaggtcacacacagagcaagtgatggagctaggctttctgattctggaagcctcataggcattagtgaaagagataaagcacttaaaatgccttataaaccataataaaaatgtaatttttattataaaagctacaaaaatataatgtattttttaattgtaaatgaggaagcagtagcccttacctcagcacagccctctctgggtatagctgccctattagagtacaaaaacagggcactgaatattttaccctggcctaacccaaaaaaggggcagaactttcttcatgctcctcaatgtagtttaaaaagaatttaattagggcataccaaagtgttggtgggccataaagcttatactaagggcactcagctcaggacgttctaagaaaacatgtgaagatggacttacccatctaagccactctgaggaccaagaatgcaccagtgggaaccagatttactgagtaggaagctggttcttgtgaggagtggagggacaggaagcagtagaaacctggcaccacaggaagggccctgtcaggatctcggctcggtttgtaagagaactgtccagccgttcccctctcttgggtctctgtttcatccccagtaaaatgaaaagggcgaacaaatgaagtccctcccagagtagacagtccttgattcagtgtgtgtgtgtgtcaataagaactgccaatagaggcttgccactgtgtatgagtttgctaaggctgctgtaacaaaggaccacacactgagtggcttaaacaatcaaaatgtattggctctcagttctggaggctagaagtctaaagtcaaggtgtcagcaggattgttcttctctgagggctgtcagagaaggatctctcccaggcgcctctccctggcttgtaaatggctgtcttctccttgtctcttcatatcatcttctctctatgtgtatttctgtgtccaaatttcctcttctcataaggacaacagtcatattggattagggcccacctgtctcagtttgctagggctgccataataaagtacaacagattgggtggtttaaataacagaaatttatttttctcctggttctggaggctagaagtttgaggtcaaggtgttggcaggtttggtgtcttctgaggcctctcgccttagcttgcatatggctaccttctcactgtgttctcacctggtctttccttcgtgtactcacaccctgatctctctctctctctctttctctttcctggtgtctctttgtgtgtccagatttcctcttcttataaggacaccagttaggttagattaggggccaccctaatgacctcattttaacttaataacctttaaagaccttgcctccaaatacggtcatattctgaggtccttggggttagagcttcaacatagaaatttgggggaggggagacaaaattcagcccaaaacatctccctaatgacctcagttttactcaattaactctgtgaagacgctatgtccaaataaggaaatcaacatatgaatttgggaaaacacaattcaacatgtaataaaagtagagatgcctcctccccaccctgccagcctgcagggataggggaccagaccttccctgcctcagaaccagatcacacagctggtttgtggcctgccctgcgcagtataccagattgcctaaatactgaaaacagaattgtatcagtaccttgatttgtgtttgcgcatgaataacgaatactaccagttcttaaaacactgcacttagtttgacaaaacatttacactctacattgtgctaggggccagtacacaaagataaaaaagacatgatccttgccttaaggcagaagacagctgtataagtaaacaatgatccgagattagacagtgtgacggatgtaaaatggaaatatatgcaaggcaacaaacaggagggaattattaacactgtctcgggggattagagagagcatcccagagaatgtgacataaactgggttttaaaaataagtagaaattacccaagctgatgaaagacattccaggcagagggaggagcagatacagctgggtcttgctctgtattatcttgtaggtgataggaactaataaagagttttagatagaggagtgacaccatcagtcttgcttttcaaagaggaactccagtagtatagagaacagactggggcagggaagtggggaagaaagagaaaccagttcctgggggccattattgcagtcatccatcaaaatgatgggacccgagccaaagcagcaactgtcagttaacaaagacatttttcctagggcatacaaaggaaaaccccagccttgggatgaaagggtggggtccgagggtttattagaggttgctttgccatctgtcatcaggacagtgattttaagacatttttcattttcattaatgaaaacctcacagcggttaatggtgtgatgagacggaatgcaatgtgatgtgagcactgaatcttgacaggactcacttaagcgaaactgtgcaaaaacttatatgttccttgaaatctttttctttaggtgacatttgttcaggtcatgtattcatccttgttccaattgccatttcagtgtgttaatgtctatcataatgaagcatctttattgcaaagtccaattcttagggtgctatgaagtactctggctaggtcatgtgaagccagtggatgtgggtcagctgtggacagtgtgtgacttgctgccatcctcgatgactgtattctgaaatagatatggctgtgctagaatgaaggaatctagaaaggaatgcccctggaagctcatcttgaagagaggatctttttcagcagatcagcaaaccgctggctcagcacctctgagttagctcagtgaaagaaaaggctgacgcctgccagtgagctccggaggcttcccctttctaacaaggtcatttcttcaaatagggagttcccattgtttcagagtcacttagatgttccaggcactaagacaggtctctctctagggtcttcccaatttagcgagcgtaaaaacaatggtggaaaggaaaaacctggaaactttgcacagcccagagcctggtcatgggccacacccgctataagggaagctgagacacatagctcctagctgagcagctacatgcccagaaaagactcgtattaccacgaaagcatgagcgcaatctcactggagctagtagcctctgcaatgctgggtgggataggcaggttgtaagtgatttttctggaagctgtgaactccgtaaaaatgtttacttggatggtcccagaacttaaattagtatatggttcatgaggatccttccccacccccagttctgaatggaaactgccacgaacaagaatgtatctcttgaagatggcagcctttgctgacagaaccacatgaaaggcaggaaggagatccggcacgctcccaccgttacgctaacgtcgcagtatctcctaggtgaactgcatttgtttctcagattctttttagttttctttttcatcttccctaaaaaaaatattaataataagattttgggacttgagaagagagagagagagagagacacgcttctgtgtttctgtgacaacactttcagagacaagaaaaaaaacgccctctggctttttccttggatgtgtgactgtctgccaagttatcacgtttaaaccacagacaataggtggagagggcccagggtggagactcgagcaaagcactcttcccaaatggcatgtgagttattgaccagcctgctcggccgcctctaagagcctcgggagtagggggagttccaaacctctggttcagaaatgttcaggtagcatttctttgtgaatgaaggagtcaggagcttctagaccccaagacaactttgatttctcagcatcaccatccagagaggcctcactacatgactgagcaaagagaagaagagctggagcttctgccacaggaaatggtggtttgaaaatgggagcacaggtgaagcgccgatggcacagacacacacttgcctcctggctccatcttgttattgtaaagtataagccaagtgggtcacttctccttccctttgattcctgccttgggccattcagcaggtgaccctgcattccttctggtaatttttaaacagaaagctacgtgacagtctttttctagatccatttttgtggactctcatttaatttaacttagttcatcgagtgcatattgagtgccctcctgccctatattgtttccggtggaatggaggatacaaataaagaataaggtacagggcctaccttcatggaatttgcaatcaaagtgggacttctacatcttactagctagaaaaatataatatttaaagaaacatattataatcaaggaactgctactagaattcctctttgaaaaggaattgtatttgtttatgatagtaccttaataaatgctagaaggcaggtggagaccccccaggaatctgggtgtgggttggatggttctgtatgagaatggaggaagatgatacttgtgcagaaatgggaagagaaagagagagtctgaacctgctaggtggtgaaagctgcctggttcacaatggaatttgctccctgggacccttcaatcttcagcagagaacttaaacccacaaaattattggtgtaagtttttaaaaaaaagtttttttggtttgtttgtggaaactgattgtattagtccgctctcatcctgccaataaagacatacctgagactgggtgatttataaaggaaagaggtttaattggctcatagttccacatggctggagaggcctcacaatcatggttgaaggcgaatgaggagcaaaatcatgtcttacgtggcagcaggcaagagagtttgtgcaggggagctcccatttataaaaccatcagatcttgtgagacttattcactcccatgagaacaacatgggggaaaccaccccatgattcaattatctccacctggccccacccttgacacatggggattattacaattcaaggtgagatttgggtgggggcgtggccaaaccatatcactgatgaagtgactaaaccttgcacccaaggaagcacagagtagagcaagcagagttataggagcaaagacttagagaaccatgaggaaattactcccagaaattacagaaatcatgtgcagcttgacctgaacaaactgtaatagtagcacttttttcatacttatccaaatttctaagagcatggggtctctgacatttgatttccatgtaaatataattaaagaatagcaacaaatggatgagcaccaagtataaaaatacttgggcctactatacaggtagggaaactaagccataagtaaagaacagatgggactgaagcatctctggacactggtgaagagactcctttggacttaagatcaaactcattttcttgtctttccaatcaatcaacaagaatttactgagactctattatgtactgagtactaagagagctgttaaagtagtgtaagagatggtctctggcctcctagaacctagcaactatttggagaattgaggctagcagaagtaattgacacttactgaccacatgatggattccagatattgctctaggcactttccatacattactatatgggtttctcagaacaacactgtgaacttattgttatgctcattttacagatgaggaagttgaagccacagagggtatgagtagcttatctgtagtcacagagctatcaagtggtagacccagaatttgaacttatctatctggctccaaataccatcactgaaaatggtctgcatggtaaagatgatgttgccaaaactcaggttctaagatacatgacataaaccacaggtgctgcaggagtccaagggacagggaagaacaagagctgggatggtcaggaaaggtgacacaaagaaaggaagattggcctgggcatcaaggctaggcaggcatggtggacagcttagggtgcagcaggaaggagagtatggagtggagcctggggccaggaatgagcatgtgttggatggaggatgatgaaggatgggttggctgctcagagggcttttgactcaaaaggtttgagtcaaaagggctttgacatcactactgccttctttatggggaccgcatctccagaggctaaagcacaaaccacaaaatctgcagttcccatcttatccagctctgccactgactttttctatgactctggatactcctgtctgtgtctcagtgtcctcaaaataaaattagtgggttgggtgaaataagcactatactatagttcccttaaggttaaaaaggtctatgattcatatttgtatccaaagatgaggaaaaaaattagagtttatgaaatatctttcaggaccatggccaacttgtctctcagatctagatggactggcagaagcttgtcataggacaaaggtagcagattgctttcatcctctagagaccctagaaaagatagagagggccggcgttgtcatgtcctgaagccttggtgctgcacccagtcatcgttagtttctgtgagttggtgggcagcagagcaaccggcgtcgggcgcgagggagaggaggctgactcaccaggcattactggtgcagttttgtcttttattttccagttcagaggtactactttgtctgttggttttatttttttaatctcaagtgaaattggaaagaaatattatcttttaaaatgatataaatggtgggggtgtttcttctcaaatcagttgttgtattggaagttcccaaagtatctatgatagaagaagaaagaggaactagtcaaaatagtaagtgctactataatggtttgctggatcagttccataggctgacgaaacacaaagttcaggctactggctttgcttcttatcctagtattagagtgatttctccagtggttcctagtgtcgatatcataaaccttgaatgaatcaatctgtctcaaacacacacatacacacatacacacacacacacacacacacacacacactcctgcacagagggttctcagtgaccataagtcactcagagtggagctgctccttcctccagcatcagcaatgattcaaaatgtcatgctttatacaaattcagaactctctgcctgcctcctaacttttttttttaatcagagcataagactgttgaagttggtatctggcaaaattaaaacatttaatttaggggatagaacctataaccaaggtgtttgcaaagtcagttcagtgagattccttgggctaacttgatgtgtgaaaggcctaaggagaaaaagaatcttttcaaatccagaaggcaacttcttgccagctatcaggctggaggcccctttggatcttgtgggctgcattttatgaattcattgagactgtctgtatctttggtcaactctgtaaacatctgattgtgtccaccatgattctttcctttggaacccgactatttttctttcaatttctgccccacaaattcctcacaggttcaacaacaagcaggcttattccacaatcatccttataagtttcccttacacattaatgttaacatctggtgttactctatttagaaccttagtgcgaatattctacttagaaccctagggcttcagctcggtccccactgttcattaccccggtataactttttccaagcccataagtctctctaactctccaagaagtctgtctttagtattcagccacatttctactactaaaccaagctctagttcttgaggttctccaggctgttttccttctccataaaatgagaataatgagtgtacctaccttgtaagattattgtgaggattaaatatgttagtacacatgatgcactaaaaatatgtggcccattgcaagtgctcaataattgttcattataatcttattgagctacatgtcttgtttactgggggtgataattctcattcactgtttgtcaaagtgttgctcctagttcaaaaggatttgataaagtgggtaaaggagagaaaacaataaaagttttctctctgattttgagccttgatgattagttctcgggctaattttaaacatgaagatgatttagaggaaagactaaatactttcctttcagttcaggtctgctgggttcaacccagttatttgcatgaaaggacaacaatagcactattatgtttatttttaaaaaagataagtagatctttcttcctcccagtgtctcatgagaatagcgtgaattcacagggacggcacatggaaccattatattctctttacccaaaatggatacaggacacattagcaatcttaagatggagaaactgggcagagagattgacttaggagagatgaagataatttaatgttagacatgtggtagttgagttaaaaataaagcatttggatagaaaaatcttcatgaaattaagaatgtgaaagtatagtgagagaaattagaataagaaaacagatacaaaaattttcagtggtctaaagctgacctctaaaaccatgaaaacaaacgtctcccttgggagagaatgcagaaatagaacatgaggctccattatcccactttcatgtaagatgtttttaagctcagaatacttttgagattgctctttgacttctttttttttccagaaacaaaaccatgggcagtgtatgctgggctgttagggggtgtcatcatgattctcatcatggtggtaatactacagttgagaagaagaggtaggtgtctggcaataaatagattcttatcacactctctgtggtaagcaggggacctctctccacaggctcggacttgctctcacaactctggctttctgcatggggccacctttgcaaaaatagtagataaacatatcctgggaccttgcttaattcagtctaattcaacatgtcttgatcccctctactaggctgtggaaagaaatagaagagccacaggtttctaatgtgagagacattattcagataatttcagtttagtgtgactagcactgccatcagggtaaacacaggatgctgaagaagtgaacaagaggtttaagagtattcactgggaacagaattcagaaaattattggatctcatccaaaaagtcaccagggttagaatgaaaccaataaggcacaattattcccctgcagttgaagtgcctagaggtaccatcccctgtcctctcttccaaatttccctatgatacaatatctcagggcattgtgctcccctcagccaccttgactactaccaaccaatactggagtcaaaatgtcctgacccaagaccaggagagatgccccggctgccttcccatggtaaggatagaacttgatcctcataacactgagctgatgactgatttcattctcaagtagatcagtgtcatctacacacaaccttcttagaaaagcccttacctcagcactctgatgttggttttgcatatataaaaaaatctagatcatagcacagcgacctacttgtgtctcatttcctccatctaagagttagccaggtaggagggatgggtgattcagatagaaattaggttgacagcctatggggctcggggtagggcaatcacatttagctcatactataaggaaatagtgagatgacccaggatgagaaaactgaacttaacttatccacattaacctacctagtaaaattgctgggatcctacgccatactctttcctcaaccacacttggcttatcacatggttgtgctctaagggaatagtgctccccatcccacaattccccactaccttccccaacacacatacccatcctcacctcaaccccattcaccatttgtcccttgtaagttagcaacacacaaaactgcctcaaacttgcggtaaaatttatatttagttgctgcacctttcataaaaccttgctaaagaaattatattggcagcttctaatgctataatcatcagaatgcagcctgacgctgaaggcttttcaatttcatgactctttggcaatttcatgtccaggagaatacactgataaagaatgtgggtataggcattagacaaacttacattcagatgcagattttgctactgacaagctgtgtgatcaaatgacttaacttctcgtctgcaaaacaggggtaatactatgtacttcatggtattgtggtggagattggtatcaatacacagaaaacactgaacacagtggttcccatcgatgggtgatagatagatagatacatagacagatagatacatagacagatagacagatctcttagtgtagatgaattaaaatggcaatgtgtaagtgctatggccaggagaagctgcactggaagcatctggaaacaatacctagaacagattgaaaatattttaagtcatggtaacataagactttatgcttcaggtaaaagctgaaaaggatattagatactctatgccctcattttacagttatggtaagagaaaagacccattgagatgacgtgatttgtccaatgccacacagctaatgatggctacaatgtagatgtcctaattttaaggccaagactttttccttagagcctaagaccttgctgacttggagccgagttaagcttactcctaaaaacctgttcttgcactggggaaaataacctgagactaaattatcttggtccaatggtccttttaagcagcaacaatcaacctcacctcttccatctgtctgaccatttaggactgtccttccagttctacatttgactctgagctgacctgcaagactgaaagtctttgaggactgtagtctgttctctactctatttgtagccactacagcacctaggagagtgctgggcaggcatgtcttactttgcaaacactcgtggggactaacttgaacctcctctgctacctccaactgcttcttgagtcctcccctccattttacacacacacacacacacacacacacacacacgcactcacgcacactcctcagtcaggatcaactctgaccaaaaaagcgaagttgaaaccactaggcacaccgtgctcatacccacacacaaaaaatcccatgttgactttccttgaattcctggaacttcatcagtgtctgccccacatttcctccccaagactcacaccctcacgcagcacattccaccatgctcaccacatacacactgggcctttcccttccaaagaaaaatgtgcctctcctaaaaatgctatttcctcagagatgtgcctttttttttttttttttttttttgagatagattcttgctctgtcactcaggctggagtgcaatggcatgatctcggctcactgcaacctctgtctcctgggctcaagcagttcttctgtctcagcctcctgagtagctgaaattataagcgcgtgccaccatgcctggctaatttttgtatttttagtagagacagggtttccccatgttggccaggctggtctcaaactcctgacctcgtgatctgcccacctcggcctcccatagtgctgtgattataggcgtgagccactgcacccagcccagttttttaagagaataaattaactggtgttaaaataagtctaccttaaaggctgtgattttctgggtccagcctccattgcctctgcctggactttgcaataatcccataataaacctccatccttcagtctgccactttcccaccatccttactgctgcatgatgtatacaaaggatactgtgcaactttagaaagaatgagataggtctactgtgctaacatgaaaaatgtcctcaatacattttaagtgaaaagatcaagttacagagaagtgtgtgcagaatgacacctcttgtgtggaaaaaagtctatataagtatagcaaatatccaaaactgcattgtctaatatggtagtcactagccacatgtggctttttaaatttaaattaatttgaattaaataaaatttaaaattcagtgacattagtcacagttcaggtgctccatagccccgtgtctgtaagctgtattagacactgcagatatggaacatttccatcatctcagaaagttctgttgcacagagctgatctacagggatatacatcaaacttttaaaaatggtttcttcttttttttcccacttcttttcacaggtattgaaaaatacggtttcttttgggaatgaaattgggttggttaatggaagaaggggatttatactttttactttatactttatatatttcttcacaatttttattttatgatgagaataaattactcctataatttaaaaagaaagctttttaaaattggctaaaaattaaaatattctgcaacttattaatttccagagaccctaggccctgagcaaaatttccagatggtgggcaacagaatgacattgttgctttattttctaaatagtcccaggtggaacatccctcttacacgtccccccgcccttacctcccacacatcaattcccccagaaatagggaggtgagaaagctgtgagtgaagcaacatactaccagctggaaaatacaaaagaggtataaacaactagccctgccctcaaagaacttagaatcctattaggagaccagatatgcacattgagcaacagagattaaagtaattgaatggtacaccaatgagaaaaacacctaatgcgtattgggcatttgttatgcaccaggcagtgttctaaacactttacaagtggtatctcatttaattatcacaacagccccgtgaggcaggtatttcaaatcccatttcacagataggcctagagtgatcaagtaactaacctaagacaatatgacaaatgtgcaggggggctgggactcagggctttgtttccattgtgcccttggggaaagtgggtatgcaaaggacagtaaagaccaggtctgagtaaggagctcctgctggggaccagagggagataaccattatggtttcttttcaccaggtaaaacgaaccattaccagacaacagtggaaaaaaaaagccttacgatctatgcccaagtccagaaaccaggtgtaagttctatattttgtttgagatgaacctgtcatgtttcctagagtattcctggccagtctaccttgcctgttggacattcacagttttccatccagagcagaggaaggtagggaacaggagtcaagaacaagagttctcctaaagtcactaaacgtcagtgtttgaaataatgggcaacactggataattttctggtcatgagtcttcacaggaaaaaaatgaagaagctggaaatacatactgtatgactctttccagctctggcattgtaggagtctaggttccatgttagtcaattatttccttttctagggaaaagagtgcaggcttgaggagagaggaggtttggaaaagctattgtgtgacatgttggactgatccaagtttaggatttactaagtgcaaaagtgacaaggaaggtaggatcttcaaaattctagctagagtgtggttaaagagatgaaagatgagatggaagaaagaaaactgtgacagagtgatcactggactaagaagtgaaggatggaaaaactggatgcatggtgaagttgagaagcagatatgcttgaaggaagggatagagacgctaaaaggatcgtggttagatgtagagacactgtagtttttcaacatgaaggcaattcttggtattgtataggccagaatctggacatttggggtgtaggtagaggcaaattcttgagtaaaggatgtgaaggtaaagatggttttgatagtaccttagaaaattgcatgaaaagacagcaaatgcacttctgagaaccaggagatggactcttgaacaaagttcttatttctgctgtcccctagtggcctggagggcttattacacaacccagctccatccttcccccaactaaactccatttaaatagatgagaatcccaagagtaaccctttcaccccacgctctcatctgcctgtttaggtaaccaggttcaccttgaccatagtgtcttccctcactactctatcctatgctgctagcatccctcttttttactgtgaagcatgacatatggtagtcactagccacatgtagctttttaaatttaaattaatttgaattaaataaaatttaaaattcagtggcattcatcagttcaggactgtcctcccagttctacatttgagtctgagctgacctgcaagactgaaagtctttgaggactggagtctgttctctactctatttgtagccactatacacctaggagagtgctgggcaggcatgtcttactttgcaaacactcgaggggactaacttccacctcctctgctacttccagctgcttctaatcacacttttagtcctctcctccattttacacacacacacacacacactcactctcacatacacacactcatgcatacccactcctcagtaaggatcaactctgaccaaaaaaatacacaacacattaatgtcagctcagtgaattacccttaaacacatatctcgatatttggtaaagcaagtcttcctaatttgtttttctgcaaaagtttttggctattcttgttcctttatactttcatatgtattttagaatcaacttatcaagtaccacaaaaagaaaaaaaaatattagaattgtattgagtctacagatctatatgaggagaaattacatttttcagtgttgcgtgttttttgttttttgttttttgttttttgacagagtcttgctttatcgcccaggctggagtgcagtggtgtgatctgggctcactacaacctccgcctcctgggttcaagtgattctcctgcctcagccttccaagtagctgagattacaggcacctgccaccacacccagctaatttttgtatctttagtagagatggggtttcaccatgttggccaggctggtctcaaactactaacctcaagtgatctgcccacctcagcctcccaaagtgctgggattacagatgtgagccactgtgcctggcctcagtattgagtcttctaataccataaaactaccactcagatcaaagactagaacattgcccgtacttcctgaaggcctcctgtgccacttcccaatcattacttcctctctcctccccaaagataaccactatcctgacttctagaaaaataggttagctttttccttttttatttttgaactttataaaaattgaattctttattcttttttctctcatgtctgatttattttgctcagtattatctttatgagattcatatatgtctttgaatttagatataatgcattctttttcattgcttcatagaatataaacgtatgaatatactagagtttatttatccagttgactattgatggacatgtgggttatttccagtttgaggctattatgaaagttgcagctgtgaacattcatatgcaagtcgttaagtggacatgtgcacatatttttttgggtatatacctagatatacctggaagtagaactgctgaatcgtagagtatgcatacctccaaattgactagataaggccgagctgtttttcaaagtgggcgtatccatttacttttctatcagctacatatgagagtctcaattgctatgccttttttttttaaatttttttttgagacagagtttcactctgttgcctaggctggggtgcagtggcgtgatcttgtcttactgcaacctccgcctcctgggttcaagccattctcctgtctcggcctcccaagcagctgggattacaggtacgcaccaccacacctggctcattgttgtatttttagtagagacagtatttcaccatgttggccagggtggtctcgaactcctgatctcaggagatctgcccgcctcagcatcccaaagtgctgggattacaggcatgagccaccactcctggcctcaattgctatgcattctaatgaaaacttggtattaacagtctaattttagtcctactgttggatgtgtcttattatgcttttattccacatctctgtaattattaaggaagttgaacaacttttcatatgtttattggccatattaaaattctttcttaaagtgcccatttaatctcttgcccatttccctttgaggtttagtctttcttttatggactagtatatgcttttcatatattttggatatgtgccctttggcagatatgttagcaaataccttcacccatctgtagcttgcctttggaatttctcagagatacctactgataaagagaaggtcttaattttgttgtagaccaatttagtctagtcctttttaagcattactggattttatttgctaatattttgttaagagtttggttttccacttatgtttctgagtgaaattggcctgtaattctcttgtataatgcctttttttttttaagaaggcactgcagtggctggtatatagcattcttgtgaatatatctaactgggatacaagttgaggtagaaatatttcaaatgtccttaaaaaaataagtaacagagttcttcctggactcttctttaatcacaagcctcagattgatcccaaaatgacacacagctactctacctaatacccacatcacggtaaagttggtcgctctcctgttaaaaattcagactttaagaactggaagggacctgggtagtcatgcccaaccagtggggttttgatataaagatttatgctaattcacataaggagttggggtatatgttagtttcctagggatgccttaacaaattactggaaacttggtggcttaaaacaacagaaatttattctctaacagttctggaggtcagaagtccaaaatcaaggaggcacatcctcagggccacactccatctggaggctttaagagaaaatcctctttgcctcttccagcatctggtggctccaggctctccgtggcatttgttggcttgtagttgtgtatctgcaatttttgccttcatcttcacatgacctccctctctgtgtcttcttcttttccatctcttataaggacagtcatcatcagacttcggacttattctaatccaggatgaccttattttgaaatccttatcttgacatctgtgaagacctttattcaaataaagtcacattttgacattctgcctggacatatcttttggggccacagttcaacccaccacagggtgcatttcctttttgttattctctgcgatatttgggtaggatgtcttatttctccccttaaatatttgctagtagagcaaattgctagtaaagctatctgagactggggtttctttggtggaaatttttttaagttatatttttattattaaattttctcctctacatattagtgaacaacttttttcagtctttttagtggctaccctagaaattataaaatacaactttgacttaccaaagtctaaggtttacttccctcctgcataatacttcaagtccacaataatttcacctcttgatttaagtgaccgttttgtcattatttgaatttcatatatattttaaacacacaagacataattattattgttttatatatataaatatatacttatacccacattttcacaattttctttgttcatatttgcgatgtctttattatatcattataaagactgtaataatgtagacaattatttaaaaactaacaatgcctttattcttatttttaatggctataaaataatcttataaagaatataataacatgaaaatcactaaacaagtgtttactgtgtgctaggaactcttctaggacttatcagagctagtatcttgcagaattaattccagcggccaccattcacaaaaattatgtgaaaataatgcctctggagttgcttgtaaatgatgctccctaaagatgtacaaatcagtggtcctaacagaagataataagatacaaaaatatactaacttattatatttatgtttaaaataattccctatgcctggataaaaatcctgaagtgaacatttaagcacacacagagtcttaataggactatgggtgacttcttttacatatttttctcctttctaaaacttctgaattaacgttaaaaatgtaagttatttgcctccttctgcctctaggtcaggttatgctaaagttctcccaaacaggaagaccagcagaggttgcatctgttgataaaggtctctcttcttttttttttttttggtgaggcggagtctcactctgtcgccaggctagagtgctgtggcgccatctcagctcactgcaacctccagctccctggttcaagggattctcctgcctccgcctcctgagtagctgggattacgggcatgcaccatcattcctggctaatttttgtatttttagtagagatggggtttcactatgttggccaggatggtctcgatctcctgacctcgtgatccacccacctcagcctcccaaagtgctgggattacaggcgtgagccaccacgcccggccaaaggtctcttaataaactgttttgatagcctctttatctcatcactgcaagaaattctttcttaaactcaaaatttcttcaaaatgtatttaagaattgtatgggatcttgaaagccatctatctgaaccacccaattactgcttgaattatctgctacaacattacttccaaagtgttgcctagctcctttttactgaaatatagtttgtgaacaagcagcatcagcatcacctgggactttattagaaatgcagaatcaggccctgctccagatcttccgaaatagaatcaaccctttaacaagatccccaagtaattcatatgcataataaaagtcagcagcactggtctagaccatgcccaagcacttataactataggagctcattgcctgccaaggcaattcatcccacatttgaacatcttttaccattagaaagatcttcattatattgaatcaaaatattttccccaaatcctaatcttggtttaaacctgagatactttataggcaaattgaattccttttctatatggcaattcatcaaatatatgaagagaaaaattatgtcccatccctttttcctccaataaactttcctaattccttaacccttccatcacatgacaaaattccaagttttctcgcattaaaacacatgtggtgtggcttcaagtctggctctatacccagggagagtggacagcagcattatcccataaccagtgtccccaaaatgtgttgaattaatgacttccctattgtaagtgatggcatccgcatcttacaaggatgtggtctcaatttattttgaggtctttgtccaggaattgtggattttaattcgttcaaagtaacatcaacaaatatcagctgaagagtttatttttatgtgtccaatactgttctgtggggagtacaaaaatatatggcttatttctcaaggaatgtatagactggagaaacaacacataaatatatcagaatgttttaaatatagcatagagtgccataaagtgtaaattagactttaaatacctgaggaatttaagtaagggataggtcattataagttgagtgaccaaaaaagaatagtgatagaaaggacatgcaccttaagttaaaagagcttaaggcaggggactcccggctttgacacttcttgcttgtacacattaggaaaacatttggtctttctgagctgtagcttcatcatcggtgaagtgtgagtaacaacagtatttaacacagagtggttgtgaggcaaatgagaagacatatgtgaggaggaggaagagtaggaatggcagtgtgggatgcaagaattctgcatgtagccggtgatatgagtgagacggactaaattctgttgctattctgtcccctccagctgcccctgtaagagccacaccaatttcagtttcttgtgaggaagacatttaaaacatttgagaagcactgacaatggatgaggctgccttgggaggttgtgcaccccaagacgccacttggggagtccaagcaaagcctggggaattgagttccagagaatttgggggagaattcccacctgagaaggaggttggaccaaatgactggaaggaactttctgcctcaagtcttcttgagtctgtgcttctctatcggagagttgggtgagaactagctctctctgttcagctaatctgctttctttgcttctcttgtagcctcttcagaagaaacttgactccttcccagctcaggacccttgcaccaccatatatgttgctgccacagagcctgtcccagagtctgtccaggtgaggcatctctctgcctactctccgtagagagggaatacatgaaggaggggaaaatgaggaagttttttttttttaaggtgggaagagggagaggatcagggaaaatagctattgggcactaggcttcatacctaggtgacaaaatactgtgtataacaaatcctcatgacacaagtttacctatgtaacaaaccagcacatgtacgcctgaacttaaaataaaagtaaaaaaaaaaaaattaaaacaaaaacaaattaaatgaaacagattgatgagtcctggactggggaagggaggccacagcatgcaggcaaaaaggagtctctgtggctttggttttccagtttccatgaagcccccaatacctgctcacacggggccactgctaaccccctgctggccagtgtttccctgagagttgtccaaggaccacatcagaatcagccagcgtacttgttaaaaataaagattcctagggacttccacctaggattctgttaaatgaaaatgtctatggagagtagccatagacctacgtatttaaaaaacccacaccccaggtaattctgatacacactcaagtttaagaacagcagctggagtccaggagttctcaactccagctacaaaacagaatcaccagggaagcattgtaaaaatgctcatgcctagactctgtgcagccccatttaatcagaatatttaggggtggagatctgcataggtgttaagcctagaagagaatatggggtgcagctcaaaatgatacttgcatattctaccctattgcaagatcagcagggactaagtttacttcggacaggaatctttcctttactgaatgaatagaaataaattctgggctgaaatctttgctccatttgggctctttcagaagagagcccaggatgatagaggcacaaaggtcacacaaatgcctgcatccaccttatttttcaaagctcctaccgcacacacactcatccagaaatgcctgggcaggtgccctatatttcaagatgaaaccaatcttcaacttgaggtccattctcacttcactgtcatatctaagaaggaagtaaaaatataaacctgacttcaaagcttcaaaaaaatacatagatttttaatgaagtttacttaaggacaaaaacagtatgctatagttaacattttatggcaaaacccttaaattctattttctttgtttctttgacatgagagatctttgcgcataaccctcttctccccttcctctctcctgccaataccacttttctcttctccctttgagtcccactagactttttaaaaactcaataatttacaactctcttggcttcccagattgtgacccatatgtaacagcaaaacaaatggttttccttacaaggggatggaaggggagagggcaaagagggagacagggcactgagtgctggtcctcagatcatgctccccataatggcatgcttatgcttggaagggagctgtggcccttgttgcaggtggagaagcagtgtgggaacccaagtgctgtcccagcaaggccctgtctgtgacagaccctgcacaagccatgatctctaagaccctttccttttcctcagcagtgctgttttcatttgcattctgtgaagtgagtatccagtccctctactcacagacttctgctttgtccccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaaccctgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaattgcaat

SEQ ID NO: 705 - DNA, 179905 bp, Human
tgtttaagaggtaggatagcaaatatttgctcaaggatcggatttgatgattgagggagagaaacaaggaagcctcaagaatgatgcccatgtgtctggtgtaccacctgcgtgcaaagtgatggtattcattgaggtagggaactcctgagatgcaccaggttttccaggaaagtgatacatctcatgttagacatgatgagcgtgtgttgtcactgggatgtgacaaatgaggatagccagtaggcacttagatacgggaatctgcaattctggaaaagatcttggctaaagacccagatttgggaggtgtcaggatatagatggaatttgaaaactatgggagttcctcagacaatcaaggaatattgcgctgcactggaggaaaccacagagtgttcaatgtcaaggaggcctaggaaaaataccttcaaagacagagttcaatgcttccaaaaggtcaggtaaataagaactgaatcctgtcttttggcctgagcacaggccttggagaccgtgacctccactttcagtagaatgatgaggcggaagccagatggcagatacttagtgatgaaggggaggagaggaggagtaacagcaggagtggggacataggttgggggaggtttttaaaaaaatactgaagagacctgaaattgcatgaatgctgagaagacccactattagcaagcaggagcttgaagctgcaagaggaagagtacgtaagagtcacagcaaagccccggagaacaaggcaacgcagaagcctggtttggagatgcagagggaggagggacctttccaacttcagtaacaagaagaaagaggaaaagatagataaggttgcaggcaggttcatagattggtagcagaaaattgagagaatttctaaccaatggcatctttttttttcttctttataacattgggagattgagtggcagggtcagaaatttgaagacagtaaagaaggttagaaatagccatgtttgactgggtgcggtggctcacgcctgtaatcccaacactttgggaagccaaggagggtggatcacctgaggtcagaagttcgagaccagcctggccaacatggtaaagccccatctctactaaaaatacaaaaattaggcgggcatggtggcatgcacctgtagttccagctacttgggaggctgaggcagaagaaccacttgaacccgggaggtggaggttgcactccagcctttgcaacagagcaagacttcatctgaaagatagaaagatgaaagaaagaaagaaagaaagaaagaaagagtaaaagaaaaaaattaaaattttagggggaaaattttctaatttttgaacatgcactaaaatgattttcagagaaaaccaagtgttattttctaatctgcatggcattattaaagatgtttactcatcttccttggggctaggcatcccattcctgcaggaagtcttgtggttaggcggtggctgtggctctgggatgattcaggaatgcagaccatgccttatttgcacaggagggacacgttgctctcactgcatgcatggtcacaactgtctgtgtgacctgtctgtgggagggcagacccccctcctgccaagccacagtagcagctgacctgccaggcaaaagcattcctttgtaaaggaaaccctcccagaccctctgaccaaaggggacgggtggggacttcctggcactgcagggccccttgcctggtactcccagcaactggttgcggtggggagggcagatctagggatggggatggggaggagaagtgggaatgggaaattgggagtcagaggggcaagtgggagagaagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggaggggagcgcctgcaggtaagccaccgcccctgcaccctatgagccagggcccgctgcgtccaccttctgcacctcggtttcctggttgaaccagcaagcggcttgctctgggccctgtggcgccggtcacaggcagctccacttgcccaatcctggcttcccgcccccaactccgcacctgcccagcccagcttctaagcgggacttctctcaggctctcgaggcagctctcccgaagccgttgcttgcttagaatgccaccaaatggggatgggggagttggaggtgcttccccaagggacgagccccctttcctcagggagcagattatggagctggaacacaaaaggtggagggagtggggccaagtgagaacagcctgctagactggaaccccgccggcttggctccccactcctgcgcgcctccccactcctgcgcatcgcctgcctccatcccaatttggagctgaactcgagccacttctcctccttagacccgcccagaagcgagggctcctgcccgccgcactcacccagccaggcgtgcacctggggctccccccttctcccccttagcactgtgtctcccgacagcgcgccacactgttctgcacccctggcaatgccacagcctaccttcggtatttctcactagaggatggctctcgcagccttctccctatcattaaccctttttcgctcttctccctcccttcccccgtcagctcaccaatgactgtaaatatatttatctatacttatggatacccattcacaccttatgcatccaaacactcctgtctccttctcagaccagacaccttaggcgtggttgtcttttctccagcatgttgttagtgctccacatgtctctggaaccatctctctactctggtggcctctataatggggactcttcacctcttgtgggtgtgcctggtttttgaaaatagccaagtctccaggagtcatgactgggtaatccaggggatcaagggggaaccttcactgggcccagaaacaaagtcccccttcatttggtcatttggtcaacaagtacttactgggcactgaccgtcaggtgtgtgttgtttaaactggctcagtgcctgcacaagctccaagggaaggggaagcaggcttggggaatgggaaatgttggcaaccctgacttcttaagcctattgatagccctattgaaaattgcatgcccaacctctccacctccttatcctcctccatgtggctcaatttccaaagcagttcctacctcctcacccctaagtggatttacttatggctcttcttgggctccaccctaaccctatcagactataatctatcagagcaaacattctgttttgttctctgatgtatcccatgtacctagatcacagcctggcatgtcataggccctcaataaatattggttgaattaaattgcaaatgtaaacgctttagaagacaacatttgtctggacatggttgtgtgcgtttattcttaaaagtgacttataatctcataaatctgtatgaaatgaacatagatacagcacatgcatataacaggaaacatttcttgcgaagatgctgctgtaggattatggagggtgggggaatctgggtctccaaaaatcttttaatttttaaatttctttgaataagccccttttcttctgctttccatatgttttgacacatacaaaaatctccccaagatccttggggaactgtattccatcattagactaatccttgctgccacttctcagtttttatttatgcaaacggcaaaatgtgttgctcaagtgctatcacacacagatatatctgtttctctattttggaatccttgtctcaaatgttactcactttacatgccttttctgttgtcttctttttttttttttttctgaaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaaggtatgagcataccccccttccccaccactctgggtccaggcacagccgggccctggcccctcttccctgcaggtaaacatcctctgtctccactggggttcccacaaaaggaagccccctgccaatctctggttttataaaggaagaaagcaaaagctttcttttaagtggtgaaagcaccgaagacccagagccttgtcccagttctgccccttactgaccttgtaacctcagagaagttgctttgtctttctgcctctcaactatttcctctacaaaaccagagtgctggattagctagggcctcttccagccctactgctcaatgctttagagaattttctctagctggaatattccacttccaaaatattgtggctgttttgattgtctggcttgcacctccttccttctccctcctccctcctccatccattgctgtgaatttcagagccggggagaagtgccagactctgacagtaatagagatagaagccctctatttctctccagagcagcctggtgagctggcaaggcaagctgcttccccagcctcttgcctctgcctgatccctagaaacctgttccgggtacagcagccggcagctgacctcctctcagccctgtcagtggtgacaaggtccaggtgccagcactggtttggtgatacagacatcattcccctgggccatggcagggacattcagactcatgtccccgagtggcattgagcagggagtcttttttgtcaataacattcatgcaccaaaatctaattttactcctaagggtgttctgtgctgggtttcactggggataaacacctatttgctgggataggtgagcatggtcatgctggagctgtgtggtcgattcccctcattagaaggagaccaatgcctgaaagcccagattgatgcagctctccatatagcaaagggaaaggggaagtgcagtttatccagcaagccagacacttgcccaggtgttgtggactggtgtcattgtgttactgtcacactagatgatttgatatcaaatagtgaaatcagggaggtatccagtaccatccaagtttgggaaaagaagttcacagaacagaagggcatcttcagtcaggtggtagagtttgaggggctaagacgaacttgtagttctgaaatctgtctcccagctggatgccactctctaaaaccccaccttgacagccacagaactgagtttaagaggacttgctaatcaatgaatcctcatccccatgttatatgttaggaaatagaggctgaaggtaagcagttgatattcactgcttacccagtctacgagtctttttctttaagaatgcaaataaaatgcaaaagcctacagatatcaaattattaagcaggttgcctttgtgtattccatcttctagcaaaattcccctgtggcccaaaagactctgggcccccggaaagggggtgtaggcactggaagaagtgggcagtaagaacaggaggagtaatgacacaaccgtccttgccacgaggagtcaggacacagccacccttgccaggattgggaaaaacgggaacctctacaaaggcagtgcagggaagcagggaagcagagagcagaggcagaagacctggcttcctgttccacatctgccacttcttgctcactctgggaaagtcatattggtgcccaagcctcagtttctccatcagcaaaatggaagcaatgcctacttcacagattgtcgtgagcatctagtgagcagtgtctgtgatcaagtctgacccacagcacgtgaccaataagtgttcattgactgggaatgtgcaacttatcatatcccagcaaggtcaggaaagcactccagggaatacttgttcctatgaggaatatgtacgacctgtagcccccataaatctgacatctgaacaaaatgctgctagtaagacattaaaactgtcagagaacatgtgcaggtaggccaattaagaaaaataaaatctgggattactgcttttgttgatttctggaggcacaggtggggagcagcataactgaattactctgaaaaaatcagtcattatttacttggcagacatatgtgtccacaacccaagtgacattctgggatatccattagaggcactggcataggaatatgaatgtccagtggctgtagaatgaatgaacgaacagtcaatcacttgtgaattgaatgactcatagctctagtggcattataatttattattaataacaagctacagatttcatacatatgcattcatttaatatttttcacagacaagataagtgttacatgctctggggatacggtttctgaagcccagaatcatgacagcaagtcccagatgagaaggacaggaaaaaaactatatatatatatatatgcacacacacatagcagcacacaaaccatctgaacaaggaggtctatctcctggttaccttttgcatttcagatttatatttaattgttctaaagcaggttttctggcactatatatcaagttttctccaagtcactaagggacgaaatttgctaagcgactaaaccttggaaagaacactcatttttaaaatgccatcttcatgcagttcacccagtggccactagtggcctctaagaggccttgtatccgcggttaccaatctgcggatgatgactttggctccaggaacaccagccccaagttaaactcttgtctccatttttttcagtggccactcttccagttagcaagctgctcttgtaatactgactgagaaatgcagagaggcaagaagaggaaaaggggggaaatggcggctttttcatttctaatagttctgtagcagtgagtcctgcccatcactgtgtgtgatatatacagtgttctaaggtatactgagtgtatataacgcccttaagtcatggctttggtaacatttggttaagaattattttggtaaaatctgtattttaaaatgtataaactcatgtaagtttcctctcatacacaccatgatattcaagaaaaaaaaaatgaaatatttgaggtaggcacggaaatcccagaggtgggaccagccattcagtggtagcgtttgacatctttgcatgattttaggcatctttaatgtcaccctttgaattcagttgtagccaggaaaggtactgagacgatctcctcagatttggatttgtatcaatttctaatagactgttctgcaggcttagttggtgtttctgaaaaatctctccactgccttcctggtctgaaaggttatgtgtagctggaaatgtaatattccagaagaaaccttatgttgttggtctgctttggctctatattgttaacaataggcgaccatttgtagcagtaattggaatcatttaacagttctattgtattgaattaaaactggaaagcaagcctggccctatttaaaaactgggttctagtagtttttcaggctaatggggtcttatacctttctaagaatctcctccatcccaccactccttgtcagaattaaatcaaccaattaatgataaacctcctctttgtgcagagtaaacctctctggattgaaggttactgagagactaagaggcattcagtgtatgactgagaaatgctattgtccagcagcagttcctcctttcattcagttcctggaaaaatatacactggttttcacatatgtgtcaggagctgctccaggctgtcccttgggacatgaagttgagtaagttagtccctggcctcaagaaactctcagtgtagaagacaaaataaataaaagatcattgcaattcagtgtaataaagactgtgactgtgatttatgcaaattgcagtgaaataacagaaatcaatgtctagcggtgtggtggagtggggaagaggatgaggagggcttcctgatgcaaggatattggagccgagacttagaggatgagtatgagtgttcctgacaggcaagcgcatggaaaagtgtttgcagtagagggaacagtatattgcaagtgaggagggactaaaagatgaaagagaagatataagcctgggaaaagatggcaggcatcacaccataccaggccttggggatcttgctttcctcctgcagataatgggggacttgagaaggattctaattagcagaaatacataatcagaattatgctttacaaagtggtagggagggctgggcacggtggctcatgcttgtaaccccagcactttgggaggccgaggtgggcagatcaccagatcaggagttcgagaccagcctggccaacatggtgaaaccctgtctctactaaaaatacaaaaattagcctggtgtggtggtgggcgcctgtaatcccagctactcgggaggctgaggcaggagaatcgcttgaacctgggaggtggaggttgcagtgagccgagattgtgccattgcactccagcctgggcgacaagaccaagactctgtttcaaaaaaaaaaaaaaaaaaaagtgtaaggagaaaatggagaacaggagatatgtttggaagctgtagagatactccaggctagaagaggaatagaccagagggattttagcccctggaggtatggggctcatttctcttgttccagcttcctctgagcacctgagcaatccttcaacattataggttccaggatgtattaataacaacactttataaattaagccacttaagaaaatgcttttaatcattctaattaaggacatgttaaaattctgggtacccaaaagaaatgtgagaaagagttatttttcctgtttttttttaaataaataaaccagtttctcatggatagcatttatgcttatagttcaataataatattaccaaaaattgcatggagaattcagttcactagggaattcctagtatataaacctaaacatttaacttatttcaagatcccatctgtgacaggtataatcattctctgaagaatattttacaacctagggagacaataatttacattttgttcatattagacaaaaagtaggaggacagggaggcagttgctcctccggagatttttttcttttctttaacagtccattttccgatatgtttggaattaggctaaattgtgttaggtagacagtttgaaagctgtcactttgaaagagcgagctgccaagtttctagctaccgtatttaaaaaaaaaaaaaaaaaaaaggcggcttagcaatgagctgttccattttgccaggaactaggcttggacaggggaagcaaattcatttcctgtttgtggcaaacggagtctggatgatgataagactttttccatctaaactgccttgttaacccagtaaacaaagcaaaaatcaatatgctagattcatcaatgcttgctggaacacactccatggcaagggacatttcctaggcaaaatggacaatggaatgaacaatgatatttttatgtctatgttcatattttatacagtcatcttcagagtctttgatactatcagctgttataagaaccaaatacttggttgacctgtgtgtggctgactcatgggcaatgaaataaattttgttgaatcagtggtattggggacctcacctctatccccaatactttggacaacccattaagcttcctcatgtcttttccatttgactacagtctggaacattatttctttaaactctcaacctctctgtgtagcttttaatcttccccttcttagccaagttttattttttttttatgaaatgtctttctttgtttaaatcattttaagacagactttttttgtttttgttttgagacggagtccggctctgtcgccaggctggagtgcagtggcgcgatctcggctcactgcaagctccacctcccgggttcaagcggttctcctgcctcagcctcccgagtagctgggactacaggcgcccaccaccactcccggctaattttttgtatttttagtagagacagggtttcaccgtgttagccaggatggtctcgatctcctgatctcgtgatctgcccctctcgcctcccaaagtactggaattacaggcatgagccaccgcgcccggcccccaagacgcacttttaagagattatacaggaaagttttacttatcactgccttagtttttccccacttatagtaccactgtgattttatgtttttcctgaggcattggcttgttgaagttatattgcaacagagaatcaaaagatcacttagaaaaagtaacatgttagaaaacatcatgcttagaattaaatgtctaaagtataccagtatagatgatataatttaaaacaactgatattatcagctgtcataagaaccaaatacttggttgacctgtgggtggctgactcatgggcaatgaaataaattttgttttatacgtataactttatatatatgtaactttatatatataaaaaaagtttgcttatatataatatatatacacatatcatatataaatatattgtttataatatgtaaacaatatatacataaataatatataaaaagtatatattatatatgtaaacaatatatttttaaaacccaaactcatgggtttatagttttttcatagtgaaaacaaacaaatatatagtttgcttatatctattatatataaacagtatataatatataaagatataaataatatataatatataaatatatatttgtaatatataattatatttataatatatatcacatgtttaatatacataatttatatgaacatatataatatatataatttatatgaacaatatataatatataaacaatatatgtttttatatattatatataaacatatatattcatgatatatatatatgtttgtttacgctatggaaaaactataaacccatgagctggggttttgtctttttttttttttgacttaggttttctattctcaaaggcattaatcagcaccctttttctcacccttcgttatcaacatataagcaggctaggaagacagtattttattccgatgtgaaacaaaactgctgatctggagttcttatgttataaattcccacatcataccttcaactatatatatgtcctgaaactagcatattttgagaataaaatgggaaatgacatttaaaggacacctatggttaatcctacagtaaatgagataatttattttgaaatgaatgatcaactctacgctccaaattttcacgtaaaaggtgttcaggtgaaaggaggcatatttgctgtggcatttctgcacactgccccaggcactatagcaagataattaagacatggtccagtcttcaaggggattacaatcccatggctaaaaaatcacctatataaagataatacaaagagacgatgatacttttttttttttaaaaagaagacagatgtttcctgcgaatcaagaggagaaatgctttctatttacctgtggaaattcaaagcaagcctgtctgctcagaagataaggagtataaaatggcatgcttccctgggaaggctggaaggccactgctaaaaagcttcccagggacattctttaccttgtgacttccattgctcagattccagcctcgcaccatgccttctcagatacctgactacttaatgattggtcctaagggccaatccaaatgctcagtgctattatgattattattgccatcaatttctgagcatttaccatgtaccaggccctaggatagagcactcggtgcattttctcatttaatcctcacaccaacttcattttgcagatgagaaaactgaggcacaggacatttatgtaacttgccaaggtcacaaagacagtacgtgagagttgggatttgggttcaggcagcctagctccacagtctatgctcttactatgctcttctacttctcttaataataataacaacaacaataataataaacatttattaagaatgtacttggtgtcagccactctataagataggtacttcattcccatattaaagataagaaaactgaggctcagatagattaaataacttttctgaggctgcacaataagtaagtagtgaagcatttccaaaaacatattctgaaaaatgcagatctccaaagaaaaaagtttccatagtcatttacatttggaaaccattgcccctctgagatatctgtggtatacatcagcatattaaagtctcacatgaatgcttcagtaaagaatcctgatcagctttggttaggccagcattttccacactggtttaaacatggagctctaattcttccaatacctgtcaatatcccataaaactagcactatgccatgatggactgactctaaccagtctcactagacattaaccaggtacactaggctaggaggtaaagctggaaagccaggttttcatttgcaatgagaactaggatggatgagacataccaatgataccaaagaaatactcgaatatttctccgtctccagccttactttgccttgtaggtagagctgcttgggaagccaaggcaggactcatttcagggacacattatcatgcagggagggagggtaggaatagagaaggcaaatccaggagtaccagaggagcagtgccttgaacccctacatgcaggctaaactcacgtggcccctcacccagaacactgcaacagcttcttaactgggttcagcttccagctttgccccttccaatcccttttccactctgccaccagaagcagtttcaatatatatataaatctaatcatgtcagtttgctgtttcagattcttcactggatccaccatgcaattaaaacccaaactccttcgcatggtctccaaggctcgtgtgatgagcaggctcctccttactcttccaccgtggctcccactagtacatttcagccaaccatcatctttcaatttcttaagcaactatgcactctcttgcctcagtcttcacctatccttctttctccgcctgaagcattcctctccacccccctttccacatggacaactgactcctcttttgctcactgcttatgtctcacttccttcagagaaattccttattttctaccccctaaatgtgggttaggggctcctccctgatactcccctcagttctctttacttcctttgtcagagatgtctgacactgtgtcataattatctgtccacattttagcatctactgctgtgcgtttacttagttagtagttattagacagttgcctaatcaacatttatacccatgtcttgagtggcaacataaaatagcacacttataacattcccagaggacaagaagctagggagaatattaaatatattaaatgcatacttaggggttaaaatgatcttaagagcatgggacagtgagccaaattcaataagaagaaatttaacccatgcaaagtcttaatatcgaactaaacagaagaaaacaattgcacaaataaatatagccaaatagcaacatgagtgggtgacttgtaggggcctcaactgaattttgatccattgttgctagaaataacattagaatgtgttttaagggaggctgaggcagggggattacctgaggtcaggagttcaagaccagcctgaccaatatagtgaaaccccatctctactaaaacaaaaacaaaaacaaacaaattagccaggcatggtggtgtgagcctgtagtcttagcaacttgagaggctgagacatgagaattgcttgaacccgggaggcagaagttgcagtgagctgaaattgcaccactgaactccagcctgagcaacagagcaggactctgcctcaaaaaaaaaaaaaaaaaaaaaaaagaatgtgttttaagggttttgctttatcagatgcataatataaatcaacagtgagttaagagtatccaagacactgacaatatcttgatttgaaataatagactgtttattttaaaagatgtaatggtctcttttttttttttttacagaaaaaccacaactagagtaatgtacttaattccagaaaataacacttcaaaagagaaattgacaaagtggaaaatattccaaaacagagcgttggataaaagttctagaaataacttcttaaaaacagttaaataggctggatgtgatggctcacgcctataatcttagcactttggaaagccaagccggcggatcacctgaggtcaggagttcaagaccagcctggccaacatggtgaaaccccgtctctattaaattttttaaaaatacaaaaattagcggggtatggtggtgagtgcctgcaatcccagctactcaggaggatgaggtggggaggattgcttgaacccaggaggcagaggttgcagtgagccgagatcgcgccactgcactccagtctgggtaacagagcaagactctgtttcaaacaagcaaacagttaaataaatgaagaatgttttactcagaaaaaaaaaaaaatcctatgagcagtctttaaatacctagagagtgccagctaaaatgaataagaggacttattctatatttatctagaagtcagaacgaggacccatggttagaaaaattacaaggaagcagatgtcagtttatcttaagagaagttttcaaataattagagttgtttaaaaatggactgtttgccctatgaaaaaatgagttccctgttcaaatggaagctagaagcccaagtagtagggctctcatgaaaatgtttcatgcagggtatagtagttctaccagatggctgagaaaatgctattgctgttctgtgagattctgtaaggatgtaatatcagtatattccttccattggtgctggtaaacggagaactgatgaaacccatttctaaggactttggtgtttagctatttttaaaaaaaaaattttaaagcccctgtgctaagaaagaggaccagaggagttgattgctaagctccttttcaacaggaacatttgtgctcctccagctcattcttgggctggtttatcacggggattgtggtcttaataagaccagaggacttaggagaaaggcagcttggaatagagaggtctagagaattaaacatctttagctcacagcataatggaaagaaagtgcccttcaggggaacatgtatacaacagggttctgagaagaggtaaaaataaaactgcatcctgcactttctgcttgccgtaatgctgcagtcagggtaacccggggagcaccacgccctgtgaaatggctgtcacagtttaggggcagtgagccacagtaagcctaggacccactatgtgccaggcatagtgccagacccactgcaccgttatctcattgagccttcatagaccttctcagggtattagtatcctcattttaaaataagaaaattcagattctgaaaggtaaagtaccttaacgcagtaattttgacacctgagattcaaactcaggattgcctgaactttgaattgctcagcagtgtttcaggaactcctggactttaggaccgaagaggatcttaaagagcccaacttcttggttttgactatggaacacaatggggtccaaagggaccaggcatcctgcacaggatttatgtgtggaggtaaaggaagccattcgactatggcaggagatgccccggcatgggtacaagctcagcaactgtgctttctgcgcacatggtgcttatagccatgaaggcaaatcatgcatcaggcaggggcagggagggggagggcaagaggccagggcacccctgccgacccttctaccctcccaccccaccttctccccaataactctttacaatgccaaatgcacatgcagaaaccagtctctagactagatcttctaaagtacagtgaggacagggagttaggatgacccccactttcagtcatcattcatagaggggaaggggaaaagggcaggaagagagctgactttcatgtgtcagaccctttgctaaatgcttgcatacgtgtcatctcatgccgtctcctgtcacattcctgtaagaagtggaacatgttaggctatgaaatgaatattagtgtctccattctatgatgaagaaatgaatttaagtcacacatacaaagttagacaactaagaaacatgtgatttacgtttacactcctgatgccacaaatcaaaagaaaaacctgtgaatgttggcatcagacagtccaggttttgacttttgaactggcccattagtagctaaggaaagctgaggatagtttctgtgtcactgaaaacaatcacacttatctcatggaaatcttagtgtcctttctccagacctgctccctctctttcctgcatttgagggatgagatctacttttagaattacagagggaggaggcatttgaccctttttgaggtaaaaggagaattttagattaatggctaactttgtccttcgaatgtccccttgaggctttgtcagatttgattccttcctttggaaagataagaaaattgaagtggctattccctgcttctgcctggttagtcacagagtgaggcagtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtggcaggagctggaatgacatccagcccctgaattaccctgtgctctaagactggtctgtatagtgccaaatattgataacttgggcccacccaaggagaaaatctcatataaataaaagtaaaactggtataatgtgttgcttaactaaattattcttcctcaaacaaatggttttggcatcctatgattctaacttttatctccatgatttaattggtctcgtgctgaaaatgtttgtaaatcttagcatgcaatccaagtatgcattccgaaagttgattctgctctgatctagtcccatgggatggcccgtgaaaaatatagtccaataaacttcactaaacactttgtactttaatcacccttttttttttttttttttttgagacagagtcttgctctgttgcccaggctggaacagtggtgtgatctcagctcactgcaacctcttcctcctaggttcaagcgattctggtgcctcagcctccagagtagctgggaccacagttgcacaccattacgcccagctaattttatgtatttttggtagaggcagagtttcaccatgttgtccaggctggtttcgcactcctaacctcaagttatccacccacctcagcttcccaaagtgctgggattgcaggcatgagacaccatgcccagcctttaacctcctcttgaagattaacgatgcacattagcttcaaaggtctggggaaggaccatttaactttggtctggtgcttcttaaattaatttgatcatggaacccttttattaagttatagctattaacttttgacacattttggtaaacatttctataggaatttataagattatcaaggaaatacatgcacagagaagcaggggtggcacaacataggaaatctgcccatataatcctatgcacaaattaaaggaaaaaattaggcaatcaaatcagcagtcacagaaaggtacatggtaaaattcagcatccagttttaggaagagtttaaggggaaaaatttagaaaaaaaacacctcaatgataataaagattgcttacatcaaaacaacaacttttgatatctaagtggaaaaaagttaacaaatttcactgtaatcagaaattagaaagaaatgcctgctatcatcattccctttttaaaaagaagtactttaaaggttttagtaaatgaacaatgtaagagatacatctgctataaatgctggaaactaagaagtaaaactatatatttgctaatactatgattgtgtatgtagaaaacccaacagattcaagggaaaaaagcactgtattaataaaactttgtaagttggctagatagaagataaatatataaaaatcaataacttttatcttccccagcactaagcacccagaaatagacataaaaaaatttcacatgaccaaaactataaaatgtaggactaaaacctgaacacgcaacctatataaaccagctattaaatcttaataaaaaacatgagaaaccaatgaaaagtcaaacatgttcttgagtgggaagtctttctgtatacatttttagtctcccaaggggttggtcaaagaatacaaaatttcagttagatggaaggaatgagttttagtgacctattccacagcatggtgactatagttaataataatgtatatttccaaattactaaaagagtagattttaaatattctcaccacaaagaaatggtatgtgaaggaatgaatatgttaattagcttgaattaatcaatccacaatgtatattttgatcaaaacatcacatattgatcaaaacatcacatcccaaaaccccataaacatatacaattatgattgtcaatttttaaaagcctcccaaaattaatatgtaaatttaatgcatttccaattagaatcccagtggagttttgagttgtctttggctttggttttggttttttggacttgtataaaataatcttaaagttcatttgaaataataattacctggtgataaccaaggaaatcatacaaagaaataataagtaagagtattttctttctgaagcggctatcagaacatactatgaaaaatatttagtaggacataatagagaatccagaaatggatttcagtatatgagttaatatgattgttggtttcatgaagtaagaagaccatatgagattttatctgtttgcttgtttgtttttacataaatgatgcagaaataactgactctccaactggaagaaagtttaaaaattgaccctcatcttgtcccatatacagtagtaaatctcagatggaatgagtattaatgtaaaaaagacaattttttgaggaaatttaacagacttaactaaaaactggaaactctgacactgtagaagaaagcaagaaccatgtacagttatgtgccacatagcaacatttcagtcaatgacagatcatgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctacttctggtcctgcacgttccattcatggtaagtgtcctatgcaggtgtaccattttttactttttatattgtatttttactgtactttttctatgtttatatataaatgtttctatgtttatatataaatacttaccattgtgttacaattgcctgcagtgctgtattcagtacagtaaaacacactatgagtctgtaacctaacagcagtaggctctgccatatagcctaggtgtgtagtgggctgtaccatctttgtttctatgatgttcacacaatgacaaaatcacctgcctaacaacatattacatcccgtgcatgacaacaaattcacgtttgaagctctggaccacagttctgctgcaattatgagggaagttttatctccatctttaaagccaaatatttagggtggggagaagaggagagggaagcttcaattctgaattggacttgtctgaggtttgaaacactctcataggccgttcagaaaataattatgataatggaagtcttagaaaaactggtaagatgaatgtcttagatcgggttactaggaaataaactctgagaagaagacttgtgcgcagaaagtttactggggagatctctcaggatcaacatctgcaagggagtggaggaatcactgttggacagagggaggagttgaactgcagtgcagacagggcccccgtggatctcaaggtgaactctagctatgggttggatcttcagagttgtctcgccttgagccaagggcatgggcctgttataccttttataccttgactggggttacagccttggtgtaattggttctctgtggctgagggtaacccctgaaagcaactaaatgaatgagaattgtcagccaccaacactcccaacaatgggaaaggtccaggcagcccaccacagcatccattacagtgaacattttaagtcctcttttcttttttacacaagaaatactattacttttgttccctcaataaaagagggggaaaagcatagctaatttgtttttgagataaaatctgtatatttttaaaccaacatgtattctaaacctttcagaacccatgatgtgtgcgttcagagttaagctgtattctagtatgtgtgggccattacagggccacatgtatttgaagattttctattataggtcacacacatttgaagatgtttcattgcccaacctgttgtagatacaagaaaggcaagtgacaaaattccacactctactatttagtgtagaaattaagcacacttcgaggggcgtggaaggacccatggtagaggatttatcttgatcagagtcatttctgcatctcacatcattcaggaagttacatgagagcctcaacttcatggctgccatagttgtaagacaggaagaaaaaagaacattgctggggaaataattctcttaaaattcagtgcctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaattaaaaaaaaaaacagacgagaataaatactttgttaaaaataaagggcacttaaaagaatctcggggggaggagccaagatggccgaataggaacagctcaggtctacagctcccagcctgagcgacccagaagacagtgatttctgcatttccatctgaggtatggggttcatctcactagggagtgccgcacagtgggcacaagtcagtgggtgcgtgcactgtgcgcgagccgaagcagggcgaggcattgcctcactcaggaagtgcaaggggtcagggagttccctttccgagtcaaagaaaggggtgacggacggcacctggaaaatggggtcactcccaccccaatactgcacttttccgacaggcttaaaaaacggcgcatcaggagattatatcccgcacctggatcagagggtcctacgcccacggagtctcgctgattgctggcacagcagtctgagatcaaactgcaaggcggcagagaggctgggggaggggcgcccgccattgcccaggcttgcttactgaaacaaagcagcctggaagctcgaactgggtggagcccaccacagctcaaggaggccagcctgcctctgtaggctccacctcagggcacagacaaacaaaaagacagcagtaacctctgcacacttaaatgtccctgtctgacagctttgaagagagcagtggttctcccagcacacagctggagatctgagaacaggcagactgcctcctcaagtgggtccctgacccctgacccccaagcagcctaactgggaggcaccccccagcaggggcacactgacacttcacacggcagggtactccaacagacctgcagctgagtgtcctgtctgttagaaggaaaactgacaaacagaaaggacatccacaccaaaaacccatctgtacatcaccatcatcaaagaccaaaagtagataaaaccacaaagatggggaaaaaacagaacagaaaaactggaaactctaaaaagcagaccgcctctcctcctccaaagaaatgaagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactacgtgaagaatgcagaagcctcaggagccgatgcgatcaactggaagaaagggtatcagcgatggaagatgaaatgaacgaaatgaagtgagaagggaagtttagagaaaaaagaataaaaagaaatgagcaaagcctctaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaaccccgaatttcatatccagccaaactaagcttcataagtgaaggagaaataaaatacgttacagacaagcaaatgctaagagattttgtcaccaccaggcctgccctaaaagagctcctgaaggaagcgctaaacatggaaaggaacaaccagtaccagccactgcaaaatcatgccaaaatgtaaagaccatcaagactaggaagaaactccatcaactaatgagcaaaatcaccagctaacatcataatgacaggatcaaattcacacataacaatattaactttgaatgtaaatggactaaatgctccaattaaaagacacagactggcaaattggataaagagtcaagacccatcagtgtgctgtattcaggaaacccatctcacatgcagagacacacataggctcaagataaaaggatggaggaagatctaccaagcaaatggaaaacaaaaaaaagcaggggttgcaatcctagtctctgataaaacagacttcaaaccaacaaagatcaaaagagacaaagaaggccattacataatggtaaagggatcaattcaacaagaagagctaactctcctaaatttatatgcacccaatacaggagcaccaagattcataaagcaagtcctgagtgacctacaaagagacttagactcccacacattaataatgggaggctttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaacggctcaactacatggaaactgaacaacttgcccctgaatgactactggatacataatgaaatgaaggcagaaataaagatgttctttgaaaccaacgagaacaaagacacaacacaccagaatctcagggacgcattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctaacaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaatttctggacacatacactctcccaagactaaaccaggaagaagttgaatctctgaatagaccaataacaggatctgaaattgtggcaatgatcaatagcttaccaaccaaaaagagtccaggaccagatggattcacagccaaattctaccagaggtacaaggaggaactggtaccattccttctgaaactattccaatcaatagaaaaagagggaatcctccctaagtcatttcatgaggccagcatcatcctgataccaaagccgggcagagacacaaccaaaaaagagaattttagaccaatatctttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggccaaaactggaagcattccctttgaaaactggcacaagacagggatgccctctctcaccactcctattcaacatagtgttggaagttctggccagggcaattaggcaggagaaggaaataaagggtattcaattaggagaagaggaagtcaaattgtccctgtttgcagacgacatgattgtatatctagaaaaccccattgtctcagcccaaaagctccttaagctgataagcaacttcagcaaagtctcaggatacaaaatcaatgtacaaaaatcacaagcattcttatacaccagcaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcacatggaaccaaaaaagagcccgcattgccaaatcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaattggatcccttccttacagcttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacaattttacactgttggtgggactgtaaactagttcaaccattgtggaagtcagtgtggcaattcctcagagatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggcctgttgtggggtggggggaggggggagggatagcattgggagatatacctaatgctggatgacgagttagtgggtgcagcgcaccaccatggcacatgtatacacatgtaactaacctgcacattgtgcacatgtaccctaaaacttaaagtattataataataaataaataaatttttaaaaaaagactaaaaaaaaaagaatctctaccagtacatctttaagagtgtttataacaagagacttaccaacaaagattgacttactgtcactcactatattagtcagtgttctcttgagggacagacctaataggatatatatatgtgtgtgtgtgtgtttgtacatatacgtgtgtgtatatatatatatgtgtgtgtgtgtgtgtgagtgttgtgtgtatatacatataaaggggagtttatttaagtattaatttatatggtcacaaggtcccacaataggctgtctgcaagctgaggagcaatgagagccagtccaagtcccaaaactgaagaacttggagtctgatgttcaaaggcaggaagcatccagcatgggagaaagatgtaggctgggaggctaggcccatctctccttttcaagtttttctgcctgctttatattcactggaagctgattagcttgtgcccaccagattaagggtggatctgccttccccagcccactgactcaaatgttaatctcttttggcaacacctaggattaatactttgtatccttccatccaatcaagttgacagtattaaccatcacactcactatatacttaaaaaaactttttttttaggttcgggggtaaatgtgcaggtttgttatataggtaaaaacatagctgtttcataaagcaagctattattatatttaaaatacagaaaaaataactttatacttagttgcttccaatttgcattcagtttttttgttgaggttgctctctcattccctgtgcctgtatagatgagctgagatatgttagtacactggagtttccctatgttgctgttctcagaacctaggtcatgggatttatttatgtgattctgccttctaaccaatttccttctctccctccctccctccctccctccctccctccctccctccctctctctctcactccctccattccttccttcctccctcccttcctcccttcctcccttctttccttcttccttctttctttctaaatatttaaataaatagggctcttggatggtgtgctgggctctgagtagagaaggtgagcaggagagctactgccttacctggccacggcttgatgagctgtgctgcaggggttctttgtgctttgataactgcgttcatgagttgctggcagagcacagctatctctgtgttaggtgggaggtgttaatgaatctgaggaggtgggtgtggctgaaaaatgccctgggagtctgcagggccttctctctctctcacctctgagcctgcagcctcgacaaatcatgaaaggcaaggaggggagtggtaatcacaggttttactaacctgtggctgagactgtgaaagcttgggagcagcttctggtgttaatttgctgttactttgacatgggcccctgcttttttgatacccagttgagggtgaaatcccaagctgtatttcttaccaggtctccccctcaaaacggcagaggtttcactccctgaggagccctccgaagtgacagtagggtccatgagcaagtttctttctccctggagttcaaccacaggaacctgggggtgtccaggtcagcgctttggagattctcctgacctttccctcaattctatgatggccctcacagattcaagcttcacatttctggttacagcagaaagatgaggagaaggatggcattagcatgccccaccccacttatcaggaaaacaaaagctttcccaggcacttctggcaatcgtttatgtttcatttgctacccttagctgtaaggcaagctgtgaaagtattccctttttccagtctcttcagaggagagggatggggcagagctgaaagtgggtgctggtggacccgcagtcatgtgtgctgggcatcccccctagctgggccatcctgtgagtataaaagtgctgtcctaatgctggcagccttgaggcaggttgttcatcacccgctcaagcatttctaggactgggtcaactgcacatgttctgcatcacaaaccctataaaacatggaaatgtcatcagcaacactttaatatctttctttcacttatttcttgagtagcatttatggaaagccagcggcggtgttggatggtgttttcagggtgggagtgacatggatgattctcatttgagatagcttgctctggcccacttcagggaatcagggtaattcaggataggagaggagatgatcagaagagagaggatgagaaccggggttatggctgcagttgtagacatggacaggagtgacagggtttgagaaatatttaggaggcaaaatctgcaggacttgtgttggggagtctgtgaggggtggaagggaggagggtcaaggtcgacttccaggtggctggcttatgtgactatgatgacagatgctagcacttccaaatgagataaagaatgcctggaattccagagggaaaaaatcgagtgtggaaaatgctaatggaggtagtagcttcattgataactcattggcactgttgctgtgcagaggtgctgtatgcctcccatttaattgttcaagcagccctctgggcattggactatggccatctccatttttcccatgagataatggttgaaaggattaagtaatttacccaggtcacacctggaaagtgctgggacctcaatttggacccaagcagcctcttctacttacaatgcttactacctccaccaagggagcctccaccaaggagatggtggaggtatgaatatgcttctgtttgaattgatgagtgtgaattacttgagggactttcaggtaaacctgtccaatagataatatgagtctgaagcttcgggaggaggtttgggttggacaggagataatttggatatcatacacacgtgggcaagctcactcagaaaaaggtaaatcaagtcagcagtggactgaggcttaagccctggggaaaacaacttctaaggcatcagtccagaaactagagcccctggaggagacaaagaccaaatgagcagataaacagaaggaaaataagggggttgcagtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttggatgaatctttaaagaaatttgaaggagaggaaaagaaaatttgggtggtaactagagaggaatgtgggtgagaggaggggtgtttcaatttcagtatttgtttcaggattggagggactggaacatgtagcaggcagagagggaagaatcagtcaaggaagaattctgaagattcaggagggactggaggagaagcatagaggacaggggcacgggtgaggggctgagtaggaaggaaaattcctcatcttccaaggttgtcgagaaagaggtgaaggagggtatgactgccgtaggtggagaagtatgaactaagcctcatgcctgacaatctcaagttatttaaagatgtaggtggtgagcaggtgctatagggtcttagaggggcagatgagtacccttacatctgaaaacatcatccatatcctttaagactatgtcttcctatggattttgtttcagaaagtccaggtaaaatcatcatgctgatgtgtgattttcacatacataacatactttctctattgagaaatgtcttgccccaaactgtgcagcttgtaacgtgtagataactatttcttagcctatactctttcaactattttgtgctgcattttggtgaaaatagacagcctatttcatcattttgaagcaacatttatatagaatgtcatttcagatttttgctcctatgggtttctgcattgatgatcaacgtgtttatttttaagcatctctgtgaagtgactaataatggcatctaagaaagtaggacagtgtttcccagagtgtgttctctatgaacacctgtcatgtgagattctccttgggggaaaaaagttccatcatcaaatacagttggatcatgctgtgttttgtgtctcttctcatagaggcccaaggcacattaatatataaaaggctatgagtagacacgtagtcaaaaaatgaatcttgtttagcccaataattcccaaaattgttctactataaacactaccctaccacatttttatttttataataccattgaataaggtgcagaactcattccaggaaatgctgaactatagaggcatattacctctattccatacaacactgaggcaggtggctgacagaacttgaacagatttgtagtctatgtgttgtgataactttatatccattttttctttttgacacttaagattttgtgcaaacattgaaataactattaatttggcattcatatttagtaacttttcaaaaataattgttaagagtatgtttttatatttatttttcagatatttatttggcttctttcaaccataaagcctatttattttctttttgaatgtgcttattgaactcttatttaatactttgtatgtgcaaagcaccatattgggattagagtagtaagatatgttcatcccttgcctccagaggatttgttgtccagaggggacagtctgagtaggaaaggctgtgttcaatgccaaccttttgaacaaaatgcttagaagctactttggagggagtgactgatggcaagaatagttgaaagaatcctccagaaagtgctatttgaggcgggtctcaaaaaacgaatagaaattgacccaggggaatggaaattgtatacattctagaaaaaaaaaaatagaaaagttcagtggagcatgacattttggaagcacactgatgtctttgtatgacttgataagaagtttagatgtaattctataaacagccagaagcctctgtagtagcattttaggtagagtattaagatctgatttttttctactttttagattactatagcagaagtgtggaagataaattggaggaccgagattttgttagggacattagtaagagactcaagggggaaaaaaatctcactaataaatgataggataaatggatgctgcatgagtttgtatgatttttcccctcctttttttcccccaaaggaacttatgtttacttctataactagaagtagtaaaatgtgtgtgtgcgtgtgtgtgtgtgtgtgtgtatttgcatagtaaaatgggactcacctgtagtgaagtaacacactgtggtctgaggactaacaatatgccccagtggctggccctctgccatttgtaggccatctcagggatgacagctcacgtgattaaagggctaaatgaagccctttttggtggggaaagaggcggcttggactcaaggcagtgcccagtcagaacccgagctccaccatggatagcagtgacagaatcactttaccccaccccccatcacattactgtttcctcacctgcaaataaggactatactatttattttaaacagccatttatgggttaaaggagataatgtataggaaaccacttttttattctcacaataaactgggaggcagggaaggtagaaataaaacttattaaaaacatggaaaccaatgttcacagggattaagtgatttaccccaggttgtgggcaaaggatctgagcaaacatttctcaaaagaagacaccaaaatggccaactggcttatggaagaatgctcaacacctctaatcatcagggaaacgcaaattaaaaccacaatgaggtgccacctcatacctgttagaatggttactaccaaagagaatgataacaagccttggcaagaatgcagggaatagagaaccctatacactattagtgggaatgtaaattaaggcagctgttttggaaagtcgtgtggcagttcctcacaaaactagcaatagaactaacgtgattcagcaatcccacttctgggtatgtatctaaagaaaattgaaatcaggatgttgaaaagatgtatgtagtctcatgttcatttcagcatcactcacaataaccaagatatgaaagcaacctaaccaatggataaagaaaatgtggtatatagacacaatggagtactatacagcccttagaagaaggaaaattctgccattctcaacaagggtagaactggagagcactatgctaactgaaataagccaggcacagaaagatgaatactgtatgatctcacttatatgtggaatctgaaaaagtcaatctcagaaacacagtagaaagttgtttaccagaggctggggcttgggggcaaggaatgaggaaaaagaagatgttgatcaatgggtacaaagtctcagttagactgaaagaataagttttagtgatctactgcatggcttggtgaccacagtttaaaataatgtattgtatatttcaaaattgctaaaagaatagatttttaatgtcttcaccacagttacctttcttttttccatgtacatagaaaagaaaggtaactatgtaaggtaataaacatgtgaattagctgattgaatctttctacaatgtatacatagatcaaaacttcacattgtatcccaatagattccccataagtgattgtctattttttaaaaaacatctacacacgcacaaagaaaatgcttccaaaagcaaataggagggcattgctctcatgtcttttgtctcctggtggcaaagacaaccatcactgaacctcccaacagaaatacccagtctccttgttacatccattctgacagcttcattagtcacataggggctctgacaatccacaggccaagttctgcctggaattatttgcccatagttctagctgaagtgacagaaacagtttaatctcaaagtaggtgggattgccatccatattttggtgccagagaccttaccatgtgcttcctcagccctgccctgtcacccacatcatgtctgcagagctggagtttcccagtgaagcttatggtccctagggtaatagagtcgctgatgtctttgtcacattaagggtgccacacagagcacttatgaagggccatgggtatcggaatgagaacactcagaacatccacaaacgcttcctccctgactgcctcctgtgctttctcccctctttcctattcccctaatttgccttcacccttgctcctatgtctgtttctctctgtcttcacacttgtatcttatgatgacctctttcacttacaagaattcataaacgtggctcatttgcacccacataattgaaactgtactccaccagaaagcgctggtctgaactcagggaggacggactgtgggcattccctggcttttccacataaattctaagacattcttgcagcatatgaagcaagaggtgaaaaaggtgggggaaaatatttaatgaaaacaaatgtgcccactgcgataacttgctcttgagtctctaatctaaaaagagagcatgcaagtggaattacagcccactaaagaaaggatccaaatggactaaatattcttcatctttgccctccagttactccagaagcatgttgtaaggattaatgagggaataactggaagctctttgaactgcttcgtgatagttccttcctaataagatgacccaattaccagccttattttcaatattgcaactatgtaggaaagctaaattcttatggtattccttaaggaaggataaccttcataaaatgctactataacagcagccagagccagacaggtattacacaaccataagacaggctataaatagctgtacctctctcttgctaccctcttcaccctctttcttctcagtatcttggcctcttttctgatcttttctcttctttcttaagatttctattactttcatcccggcctgtctgtttctgtcttgctcttcctctctgtctgtctctcatgcatacatacacactgtcctgtggatgcacgtctaggtgttagtggcagcaaatgtactggagtcccacagcaccaaagtatgttagcagcagtgaatccacatggatctacagcagcctcaattcttgcctcctcataaggcaggagagactggggcaagttttagagcaggagtgaaagtttattcaaaagctttagaacaggaatgaaaggaaagaaaatacacttggaaaagggccaagtgggtaacttgaaagacaagtgtacagtttgactttgacttagggtttttgttcgtttttttgagacagactcttgctctgtcacccaggctggagagaagtggcgcgatctcagcttactgcaacctccacttcccaggttcaagtgattctcctgcctcagcctctccagtagctgggattacaggcacttgccacaacacacggctaatttttgtatttttaatggagatgaggtttcaccatgttgaccaggctggtctcaaactccttacctcaaataatccatctgaaagtgctgagatgacaggcatgagccaccgcacctgactgacttcaggttttacctgttggcatacttctggggtcttgcgtccctactcctgtgattcttcccttaagtggtgtgtctgcgtgtgcagtggcctgctagcgcttagaagcggagcatgcacagtgcgtttactagtgttgtactcgtgaccacttgatgcattttttccttaccagttgagtgtccctggaggaaggccacatactggttaaattccgccattttggctcttagtgcgcatgcctgagcccactcacccaactgctgaggttttattgggaagctgctgatcaccagtttcaggtatttctgtttattgggagactgcccttccctagcactggctgggaccaattattattttagaaggacagtttaacaatgaccgtcacctgatggtcgcctgccattcctggtgtgtgcgtagtgggggaagccctctcctcccctactcatgcctgactaggtacctactgtagcataggtatttactcatttgttagagaagtaatgggagttacccttgggaggtgggtctgaccgtttttgtgtctgttcatgagcatttctttagccttcaggaagctggggctggatgtgctaaatgtgctgcccatctctggctaaagcctagcttagccattgggatgctccttctctgcactgttggaggttttgctttggcttcttcaacttccttgtctatttcctttccaattctgtttacaaatctctataacatcttgtcccatgtctggttcagtgaatttgtgatgcagaaacctctgctgtgtccagcagtttgtgacaccccagagggggtttaagaggaatgaaagaccccatctctgtcttttttctttttgagttggagtctcgctctggtgcccatgccggagtgcagtggcgtgatctcagctcactgcaacctctgcctcccaggttcaagtgattctcttgcctcagcctcctgagtagctgggattacaggtgcccgccaccaggcctagctaatttattttttgtatttttagtagaaacgggatttcaccatgttggccaggctggtttcaaacttttgaccatctctgtctttaaagagcttactgtagttggagtgagaggaattccacaaacaatgaacacagtcagagagtatataattgagctatactgatacagttgccttccagaaatgtgtgacacgactggccgaagtgactctgggcagtcaagagcaagaggatcagctagagttgaagggtaaaatctcagaaaagggcagggaggtcttgagatgactcttgaggaactgggagcattccaagagggctacgaagtatgtaccctccatgcaaggaggacggcattcttggtagtccaggagcttattgttctgctgatgcaaacaagcttctagtgagaaggaaatatttccctgaatcaagtgtctggctgcatttggagtttggacaccactcagtttcaaggctctggagttgtaagaagcttgcagcggcaggaaaggcccatcaggcaggcccatgaggaatgtgctcccctcatgcaatcagtctgctgttattgcttggttagtgcccagggtggacaggggccttttgtattaaagcaattaattttacaaaaagaggaagaaacccttatgtttctgtgactaaaatgacggaaatgaagtagtggagacagctgcagtggcattttccatcaaacagcttttctatttgtgcaacatatttctaagtgatagaaaatgacacactctctccattacttcacttccatcatttccatcatttcaaccttttctaactttcatatttgtgaaacaaattgctttaaacatgtcaaagacatttgagtggagtgttagccaaattttaaaaataaagatgattcataaagacagtgcttgtgtttatagccatcaagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtcttttgttagagataggatgttgccaagggtagggcaaccaggagggtatcccttagcatgtaactttgaagaatcaagattggtgctccacacaaagttcgttcaaaaatgtttctcttaagaaacttaaaaacctacatcgctgatggaaaaaaaaaaggaaggacatgaatatacaggataattgtacaaaaattgggtacatgtattgttgttgtttaaaagttttttttaaatttcgaaacaaactccactttacagaaaatttacaagacaaaccatacaaagaactgttttttcccagaaccgttattagagttgtcaatctgatgtctcgtcatccctgaatactttagtgtgtactacctatgagcaaagacattcttctgtgcaaccatcaaaataaggaaattaacactgatatttgatggtagtctaatctttagaacacatttgagtttttctacttgttcagtaatgtaccttatagcaacagaagctagtccaggatcacatgttatatttagatgtcatgtctcatgtctttagttttctttaatttggaacagattcataatcttgctttgactttcatgatttgacacttttgaacattacaaggcagtaatttttagaatgcccctccatttgggtttgactgatgtttcctcacttgatgttaaaatcaagtcacgtatctttcacaggaagattgcagaaatgatgctgtgttcttcttggtgcctcctacctggttgcacataacttttacagatcccattactgatgatgttaacttaaccactcgattaaggtggtggcacaggttgagtgcccaggaagtagactgtgaaattagcatgcaagctgttgattagggagtgctgttgggatcaactcctgtggaaggaagcagtattaggtagtgggggagtcaggctgcaatgcactcacaccaaaggcctcagatgaccctctgtgaaactctggagctgagatagctcttcatagtgctcctgagatgaggacaaagggatggggctttgttcctccatagtgatcagtcactggatgtgagccacccctggaatgaggtgtgaccctggatgaggcagttttcttctgctaaggcaactcccaaggaggcctgaaccaccaaggactattttctgtcatcactcccagcagctgaggataagcctgtcggtcatttccgaaggtgtcttgggcagaacatcacagagcccaacacagaggtgactgttggggttacccctgcaaagttattctttgttccttttatagttaataagtactttataggaaattatcttgagactataaaatcccatttattaccaaaattattattgatagaatgattgattaatacctggatgaatcctgattttctcttttaattaaataggttacttaaatcttttattatcattaaataacttaatgttcaaacagcctcgattttgccagttggactgttccaactagtttcagtatccttacttcctcatagtctgttacagtaagatgtttcaggcccgttttgagttttccctgcacctaccctcaaaataaccatttatctaaggagaaacatttctccaaagaactccacttcattttaatagaaagtagtatttagaaaccaaggtctagatcctaggtgtgctcattagtattttacctcctttcagtatttcccaattcaacctaggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctcagcctcctgggtagctggggactacaggcgcccgccaccaggcctggctaatttattgtatttttagtagaggcggggtttcaccaagttcgccaggatggtctcgatctcctgacctcgtgatctgcctgccttggcctcccaaggtgctaggattacaggcgtgagccaccgagcccggccgtcctccatacattttttatctttgagcttgtcatttactgagtcttcacaatgtgccaacagtgtgctctgtgtttgcattagttttatgttgctgttgtaacaaaatatcataatcttagtggcttaaaacaacaaacatttattattttgatataaggtataatgatatataaaaggtgtaatgacatcttaactgagctcctcctacctagtgtcgtcccttagggaggaatcagtggaattcagatcctgattattctggctctaaatggtccagaataatcaggatccgatggctggtcctggtatacctggtctgacactgggcctgggatctggaaaggtcttagaagaaattacattgagactgtaaaatcccctgaggaagaagacaaggtcttcagaatgtgaagtaaagagcatgccctctcccaattttatgcaatgagtgaaattctattatggcaatttattcatttaagatatgaaggaattattttctacaaagtgtaaatatggaggtaagaagaagtattagcactcttcttagacattaacattttagcaaaatgaatttattagactcttgccattaactgttagctgagaccagttcccttagaacgagttgccaaatgaccgttttcatggggagccatgcgatgttcaatgactaggtgctgccagggaaggctggcccagctgagtcccaaagtgaggattctccagccactccgcaaacagtatgaaactccagggtacatgcttaaagcactctggaatttaagtagtggcagatgttttagaagaaattccactgtgccactttccaaagcactggaattaggtgttatttacggaaggcaatattgtaccccttcaagcccacaaataaagaggtactcagcagtgacctttattaaaggcaaatcagtggggaacacatgaccagaggaaatgagagaagattggaatatattctaaggccttaaaaagatgtcaagaacaattgtgttcccccacaaggcatccttaggcaaggatggtccaacctcaatacggtttctttacatccctgtgtttcagctacatccgtggtctcttgtattgtttatctatgtcacttgcaaaaaactaggcttgaatacagttttttaaaagtgatgcttttaaatataagcggtaatcaacttatgaaggaacaatgaacatctatagtaagcaaataaacatccacacataaatatacatatgaataaacaaaatgcaaatgtgtgtcattctttctgccagtcctttgagttccatatttgttgtcatgtagttaataaagtcgttgacttcccccacggtctactactcttgctctgttattctcatgtggcattagtattatgaattaaattacagtctaaacttgcgtatttaattataaacccattgagcacaggaaatgtatcatatctcagcacattcaccaccctgtctcctccagattaagtggtatcactctgctcatcataagcactagtaaacatctgtttaaataaatgtttattgagtatgtattgtaaatatccacttgtaggttaatactagatggactgtaccatactccttagaatgttttctatgttgatttttgtttctccagtaattgctttaatctctggcaatgcaaactcatttaacacttgcttttatatattgcattcatatatactccaaagacaaacaaatgctttatcagaattaccagtgatttattctcattattgttgccattcaattattaacaggaattgactgttttagcaaaaatgtcatcagttggcctgttttgtttggaagacattcagctaaactttttcctttgttggctaatgacactttattttttaagtcagttgccatgattttaacgaaatgagcctttcttgtaaaacctagaaggctcattctgctcatataatggatggaacacaagcaaatgagcaaatggtgctttggctccatagacttgccatttgctgggggaaattcagttgctgtaggagattctttacggcatgtgttctgagctgactgagaacatgaaagagatgggtctcgaagatgctaaatgcagtgcatctggtcagtgaccttcatgttcagtgcaaagtgtgcctccccaccaagtccctctccaccccttgggcttccagaccccagcacgaggggtcagaaacccaagaaatatggaaacattctttgtcagttgaaagaattgcataacagttggggtcagatggggcaaaaagctgggtatgcagtttggtttataactgtgaaatctggcaaactacaataaattagacattgtgacaccaacatcctatttctctgtctcacatctctagatcttaaagagtttagccttcatggattgatagaataacacagtcttgtttaaactcatgccaaggaagggctggaaactgccctagaaacaatggtcatgtagatgaactttgtgcttctggtggccacattttttataccatgtcccctgagcaagtttccctatttccaacctccactttcctccctatttccaacacccagttccagcttttaggaaaggtacatagtgcagtaaatttaagcaaacacattgcctttcccagggatataaacatttcagcatcatctctaatttctcttctgttggtaggattttcattaccaacaagcaaagggggaatattgagaggtcaagagatcttcatagcaatcctgattgctctcctgcagtcttcacagaacaaccaaagtgattttttaaaagaacttaaagcagaccatgcctcttttctagtgactgcttttctcaatcagaataagatccaaagtcctacaaagccctgcttgatctggctgtctctgacatcatcttccatggtttcccctgctccaggaactttctcgtctcccacaattcccctgctcaggcactgtcacctcccacaattccctctgctccaggcgtctaatctcccccaattccctctgttcaggcacctcatctcccacaattccctctgtcccaggcatcttatctcccacagttccctctgctcaggcacctaatctcccacaattccctctgccccaggcatcatacctcccccaattcccctgctcagatacctcacctcccacagtttctctgcttcaggcacattggcctcctcaagcatgccaagtaccacctcccacagggtctttgcactgatgacacctgtcccctgatatttgcactgctcattccctcacttttctcaagtctcttctcaaatgtctcctctggccactgtctctaaaatagcacccccagctctgaccctctctgtcctcttaagctgctctagtcattttttcatagcacttgtctccgtttgacgtatcatgtatttatttgtttattgtccgtatactcccactagactatacactccattaatctttatgtgttgacactgctgtattctcagtacctagaacagtgcctggcacttaaatggtgcttaataaataacctgttgacgaaaaagatcctgaatcgtgccacagcaacaattacttgttaattgaaaaatcacaaatctatacatttggaaaggagtctttatttcttataaaaggttacagcctgcagagtgactatccggacaggctgagaagcacagcctctggcagaggctgaaaggtgggcacttcaagggaaaggaagatggaacaggaatttatgctgagctggttggccaaatatacatattccacaggttacaggaggagctatgaacatttatgaagagggtcttaatgtatgcatactgaataaacatgcatgttatgtgtgacccatgttcgctttggggtgagacttaacatttatatgtgcttcagttaggccctatacatcaaaaggtgaagcagggacaggaatgcattgtagtgtgcagcttcggtaaatcgtccagaaccagtccatggttgatagtctcttaccaggagaaagatgctgaaatcagtctcttacgcaatcaaaactgtagttgtggctggtggaatgtgagttagttagtcagcatctggtgatggatgaactgtagttgttccaacattgctcatcttgagaccagggcttgtttagctgctagacaaaaagaaaaactttgtggcagttagaacatagtttattctttaaatgcaggggttcatgacttaatccttgcctggtgtggccttgggtcttgtttataattatatattttattgccacagtgtcagtcttatgatctctattttaacattgattctgttcaattttgtctaaacagcaaaaggaaagggaatatagtgaggtgtgtaccacctcccatcccatcatggctgcggctcagtttttaaggtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatgcccttcacacacactattgtttaatcctcatcttctggaatgccaattttacagatggaaaatgcactgagagggttcattagcctccccagtcacagctctggccaagccgacctgggttcaaatgattgttctgcatcctgatagctatgtagcctagagctagttacttaagttacctgagcctcagttttcccatatataaaatggacataacccttaaaggtgatagagcaaatagaaactgctctagatttgtaagcagtgggagcttactggaggcaattgggtacacaagcgagtgaatgactaagaagccaaacaaacgacatggtgaggcaacccaggaattaggaacagtagaaaactgccaccacaccaggagctggaggcacatggaggaggaggtcccatcagaacccagaaggcatcagcaggtgctggagccatggaggagactcagactctcacctcaagacagagagagcacaggagacacaccctgacatctcccctcctcctgcttccaatcctctctttggccgaacctacctcgaagtcagagagcagaggagcgtgggaacatggcttcctgtggaacctgacagaagattctaggggtgcaggcaataggtctgagaacagccagtctgtcaataggtggagttgctgagacaaactataagtggttgttattcccgaatggacaacaggaaacacaagtccagattctttgactcctgttcctcctggtccttcggaattgaatgggcaacgtgaacaaatctgcagtgtaatgttatgctctgtaaccaactttgtctacattgtagaacattttctgctggttattttttcttaaagactaaaaatatcctgtcttctcttaaatgaggcaacacacatgtgggttagggaatttctagaaaactagcttcctggagtaaatttgtatcgcagttaacaacaccaggtcctaacttttggagcaaactcctcataaagcagcatgttctcccatgcttgaagcttagtctggaatctttgggttagagggaatgactgtttggttcatggctgtatctcacttaaaacagtgcctagggccaggcacagtggctcacgcctgtaatcccagcacattgggaggccaaggcgggtggatctcttgaggtcaggagttcaagaccagcctggctaacatggcaaaattccctatctactaaaagtacaaaaattagtgggtgtggtggcccacaccagtagtcccagctacttgggaggctgaggcaggagaatcgcttgaacctggaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgccaacatcaaatacctgttgcgtctacttcctgcttccgctggcacccctccacttaccttcccccgagagtcagtcaaagacaccatcatgcctcccttgagcacttcagcaccctctgactggtttccttgctccactcttgtccctctcaaaccattttccatcttgcagacagactgatctttctaaaatgtaatctcaccagatcacttaagcttttcaatggctcctgccccatctccatcccctccctaggacacactctacatacctttgcacagcgttggaggtccctttgctttttaccctccctgggtcaaatgcttcttctgccacaggtatcctgagtttcctgccattccctttatgcaccatcctttccttattccctcagttggttactcccccagctgggaagacttttctctaccttttccacctttaagattgtatcccaaaaccacattctctgaggaatcttcttcaacttccacagacactgttagccacttcctcctctgggtttccacactgtgttcctcgtgaccagtagtcccaggaagaggctggcatgctgtaggaatgtttaaaatgcatgcacatttcactgaaggggcttcacagtcctctttctcagaaataagccattcttagggagaaattctcctatctcaatgctgttcgtattttctctgaagttcatgttatgttcttacttcctgtgaatgccactggcatcatcctgagacagggtgtcctcatgttcacattcctgccttggttagccatctaagtggtgcacttcttaaagccagggaccaggtagtcagcatcaggtgacagccttatgatttctttctgattcactcaaaaaacctagcacgatgctggtttcatgtatatcccacaaaattacgccttacgtttactccaaaagaggctttaagtgatgtaggaagcactgaaagaaaagtaaaataaaatcaaggtagaaaagacaccttaacaagtacctagcttccatttgccaaatatttattgagcacctactacgttccaaacatcatgcaagctgctgggtatacaaagttaaacaaaactccatctctgtcttcacaaagtttccccccaacccttcctaagtttgcctgagctagaataaacatggccaggaaggtctcttttctttaggaaacatctggaaatatgtatgtaatctgccaatggcaacttagcaatggaaagggcggatttctacagtcctcaaagagatgatttgcttttgaatacttgtgtttctctcctcttagttgctatcatccatgatttctgtgcctttttgattgtttcttttttggtggtggcattttgtttttgtagctggtaacctggtatttctaagagttatttggtgacttattcccacttggtctcagcacactccctttccatcctaagactgttagcacaagttttgcttccttttccaaagcaactgtattcacacttccagcgctgccacatacatcatgctgttaccttcatacttcaagggcccatttggaaatagattgattattttgaacatgaaaggtgcgccttgggaaaaacaaatgaatcaaatggaaaaatgaattaacatcatgaaatttaccttctcagctgaagacatgatagattcctgtgttccttagagacagtcctcttataagaatgaactcttaagggaagtctgcaggtagatggagtcagggctcagcttaaaatgtgtttatataagaatggaaaacaccctctgaggaagaagcttagaaataaaaaagtttctttcttgtgaggggtgcttggattgaacacccagattgctgtgggcatctcattccagagcttctaacatctctatgatgatcttagtggggcttgccatttgcagagagctcagttcagcctcactgacatttattaggtaccgactgggtacaaaacactgtgacattctatgggagctatacagacatattagacaatgtcttcagttcagtttaacaagcggaatagatatctaagtgaataaggagaaaaatgtttgtttgggcttttctggcaaataattgttataggaaaaggggtctcgatgcagaccccaagagagtgttcttggatctcatgcaggaaggaattcagggtgagtcacagagagcagtgagaagagatagtttattaaaagctgctccattacaaagtagggtatcctcagaaagcaagtggaggaatgcgctgtcattgttttaagcttttcttacataggagtcttgtctatgtaaagactaaacaaagctgtgcttttgtgtgggtaggatgacagcatgacaaaatttattattctattgatttaaagaaaactatccttgacattttagtgtgtgagtatatcaaagcataactgtaattctcttgaaagtatatatcattatgggtattgggacatctggactttctgttgttgtaggagtttgtccttgcaggcattactaagttgtttccttagctgtcaacatcttaggaccatgggttttgactggcaaggaaagtgccttgctagttttcagatgcagttgatttaaaaaggttgtgaccctggctctcctacgttcgtttccctaacgatatggccagaagtcttcttattactaagtatagcatatgaggggcacagactgcagccactggacttacagatgacatgcccaaaagaggagagaagtgggagtgtcctgagttatcagcttctttattttggagcacgagagggagcagtgattgatagatgtgtctactcagtcactgataccaaccctccttgatggcaagtatgttcttccaggtcctaggcatgagagaggtggagtcagaacagttctattaggaacaatattcaaccatactgaccataccatgtgctatttgatgtcctttctagactacctgggaacctaatcaccacctaggacattgtatttttaatgtaaaaatatttcaaagccatcaactaacccaaaagattaattttttaaaaggcaatgaattcttctagtgggcactaccaatgcagggctttgcgtgcagtgggctctctggtctgtggaatgcattgaaaggttgagaggacattttccccagggtcacatagcactgaatttgagctgtggctagatttctctttcctatcttgtgaagaatactaatatcaagaaactgtgcacaaagctcaatcaagcctaggtagctaaggttggaaaagagtaacatcacaaatggaattaaagattttcatcttcttcctcctacatcccagctggggggattaaggtaggtctgtgtaaggagagtgaggccctcagtaaagggacaatgagacattcgaatataggcatatggtccaagcggcttttgccttaaaaacattagttttgtggcctcaataataattcacaaatggaagcaagcactgaaactaagagcatatgttaatttctagatcacttgggaagatggcactagtttttgataagtgtgaaaaaatgcaattggtaattataatatttcctcatgtttagtagtccaatttcaaaggctgcaattattaaaaacaaaacgggattcctttcttggatgctgtctttcccgatgtctttttcttgccctgatgtttttaacgcaaagttgcatgatttgggggagaaaaacacatctatccaggcattatatactctaggcaaacacgtgcatggaggttccctgtatggagccatgttttccatccagattgggccaaggatagctgatgggcagtcatggatgttgatggatgggttttcccagggtagctggattgtggtctcgtaaccatgccgactcctggggctgagaagggctatttagtgaaatgaaatactactctgtcacaacttcctcactcacaattcaatcatggagagtacttccccagtgctgtcactgaaatcattacattcagaattaaacatgggtgtaatagagcagtccctgaggttctattggcacatcaggttccacattcctaaccagctttcccatacaggaatatgaaaagcctgccaatcaggattctttttccttcctttggaattaatctcaccactccctgtccctgataacgcttccataacctgttcccgggccacgtggcatcagcgtatcagcaggattgctcagccttcaccctttggtgtctgacattactttggaagtcttcccaatgcaaatcacaaaaaaatgagttggcccagagagaccctcatgcaggttctctccacctggtcttccttctcttcactcactcagttgttacctcctttgatccacatttctggctcacacaactcttatccacggcagcatattttctcaatgtcccttttcctcatattcctttggactttccagttttattcttctcttgtctcctttcatctccctagatcccttttgccattctccaccttcctccacagaggaagcatgacatggagcaaagagaacaggcttccctgtccccagttctgtctccacttctgcctagctatgtgatgtgcacacatgacgccctcaccaagcctcagtttcccatctgtaaaaatttcctcacagaggttttgtaaggaccccaagaaataaaacttatttcctgtcactttatttgcatcactatgtgaactgccttggcaactctaaacaacttttgcaatcttaaaattgaatattttagccatgaatcataaaatcaataaaaagctacaaacttcctatgttttcaacaccccctgagactgtggggaatttaggcgactttaaggaaactaaaggttgacctactagtagtacagatgtttgcgaatagtttagaaacatatttctccttggaaggagaagctaggtgatggtattttcttcttaggctcaagtgttagacttcaagagtctgtaataaatcgctccttaaataaataaaatgtgaaatcctctaaggcagatgttggcaattgtttactgtaagggccagctactgtgttaggcgttgcagaccatagggactctgtcacaactactcaactctgctcttacaagagtagggttgtattgtagcacaataatacacaagcaaatcaacataactgtgttccaattaaactttatataaacagtaggtaggctgggcgcagtggctcatgcctgtaatcccagcactttgggaggcctaggcgggcagatcatgaggtcaggagatcaagaccatcctggctaacaaggtgaaaccccgtctctactaaaaatacaaaaattagccgggcgtgatggtgggcgcctgtaatcccagctactagggaggctgaggcaggagaatggcatgaacccaggaggcagagcttgcagtgagccaagattgcaccactgcactccagcctgggcaacagtgcaagactccatctcaaaacaaaacaaaataaaacaaacaaaaaaaaaaacagtaggtaagctacatttggcccgcagactatagttttctaaccattgctctaaaggatgaatggagattacattgatcattaacaactcagaaaatcagaaattatgattgaatgggaggtttcaggtgactccatgatgattctggaattattaaggcttttggttactaataaatggcaacccttttttttttctttttttacttctacaagttctcctgatggaaaaatcagtcagctcaaggttttttagtttgggatgaattggcctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagcaaaaaagaaatcaccccttcttccttctgcctttactttctagtagaagttatacttaaaaaaaaaaaacaatttgccaggcatggtggctcacacctgtaatcccagtactttgggaggctgaggcgggggggaacacctgaggtcaggagtttgagaccagcctgccctacatggcaaaaacttgtctctactaaaaatacaaaaagttagccaggcatggtggtgggtgcctgtaatcccagctacttgggaggctgaggcaggaaaattgcttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaagaatcaagaaaatggaagctaagacaagtaagtgatttgcctgaagttgcaccagtagttaatagtggagtcagaatttgacatggttctcatcaactccaaaacattttcaactcacacagctgccatagagcttagaacaggccgactctcaaaccagatggtctgggttcaaatctgaactccactatttgctagttgtatcaccctaggtaagttgcttaatgactcttagtttcctgatttgtcaaattaggatgatgataatggtttccttctcatcttttgttatagggaataaaggggtaataagaacatggtaagccacatgctttggctttttctgtggaatatcagctctatgagcacagaagttattgtctgttttcttcactgttgtatccttagcacttaggataatgtctagcacatagtaggcaatatcaatatatgaatgaaaaatgtcagaagtagtctttaaattaggttatgactggattcaaagtcagcatgaaaaagcatagctttccttttgctttactatttttgtataacttggatttgataggtgaaattcaatatgagtctttgaagtcttaatttaaagtgtaacagtggaaactagtgattgtcttcattctttccatgttcccaacaaaagtagaagttagtacaaaggtgaagcttttaaaacaaaagtggaagttagcacaaaggtgaagctgaggttgagcacataacaggtacaaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttagtgacaacagctgctgggaaccactgtaataaatgaattatgggtcccatttacctggcaagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtgggtttatggaggggctcctgagagggtgagtcccatgagtcttcaagagcattacttagatgccatggcacctaggcagaaaacaatgtttaaatttgtgctggatttacaagtatatgtgatattcattctgagtggtataacctatatccctaatagcaaagtgttgaagttctaatctttctcagtggtttgcactgtgtaaattattattttcattaagattaagcatcctcacagaattgcacagcagtaacttatgtaaccacctccttagaatgttctctctctgacaatatgcctaccaaagactcttttaaagatctttgaaattagtaattagggaggttacaatggagcactgtttgcttgtcttaatgtggaatcctctacatgctttatagaaaacaaatgaagtgaataagttttgctcttgaaggttctcctgcttacaatcaaagtaatttgcagacttgcctgatttgtatgtttcttcaagtcaagaataattctaatggattactcctgtcccttcagctataagataacagagtgagaacaaaaatggcttgtgaaatcaacctaacagagtatttcttctctcttctcataggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaaggtaagaggcagacatttagttttctcatttaaaaattcacctatttggcggggtgccatggcacatgcctatactcccagctctttgggaggccaagatgggaggatcgcttgaggccaggagtttgagacctagtctctaaaaaataaaaattaaaaattagatgggtgtggtggtgcacacctgtactcccagctacttgggaggctgaagtgggagaattgcttgagttcgggagttggaggttacagtgagcaatgattgtgccactgtactccagcctgggcaacagagcaagactccgtctttgaaaaaagaaaaaaaacaagctcatgtatttccaatacatctctttttgaaggggtagtaagattattctaaatacatatgcctctcctacatataccatctttaatgattgaaagagaaagatagaaaattcatcctccatgtgtatgaagataaaacctctatatgtgaagtcaatgctgctatacatttatttcgggattaattggagattgtctaaagttgcagttagttatttgtggagctattaattgcagttttgtaattaaaagtaattgcaaaaatcacaattacttttgcaccaacctcaccaacctaatatatgttgacagtataacctctgtacactattactctgtaaacaaattgggcttattaagcttgattatcaaaactattagagtctataactctgacttcagaaaaataaaataaagtcgacgctgttcatagtagaactaacctctctatccccctactttaagaacagaaagtctgtatatctaaaggattccacaaagttgtttatgtgcatagtgggtgcaaattttgcaaaccataactctggatgtgcaaagatgtagctgtactttaatataatataacttgatctctagtgctattttcagtcttcctttctgtctgcggcagaagcttaatctagttatattcaaataaaactcagtcaagttcaatgatttctctatcaattctgttttgtgcctcagtcacacatagcattttctcctcatcttcatctctgccctttcatacctctcccctgctcccacactttgtacgaagctgttttaagttccagaggcagatgcagatgttgcagcagcatcaatgtgggagagaccacttctaggtcctaggaaataaggcagtgaaagatatgaaagctcacatggggcaggagacttcccatggcaccctaccccatatgcactgctctctaacatcatccaaaatgagcccatattattgctgattttgaatgatccttgtatgtgaaagtcacatttgaatcagggttaatctgtcctagatatagataagtgcacaacaatatttgctactcatctagaacatacaccttggtcctactgatcttttctttgttttatatttatatttatttactttttgtagagacgtggtgtcactatgttgtccaggctggtctcgaactcttgggctcaagcagtgctcctgcctgagcctcccaaagtgttgggattacagtcatgaaccaccatgcccagcatggcttgggaattacctgttccactagtgttggcaaaaggcgccaagctattcctacactccctatacatccatcctcatcatattgtacccaacactcctatctatgagacagatattcaaggtaaatggtaacaggaaatgttaactgggccatgtgcagttcaaaaaatgaactcttgatagtaatcttaaaaccagatgtgaggcatttgcaactggttgatggggtgatatttacagagatgaaaaatactgagaggatcagagttacagatatataaattaagattttgaatatgttaagttggagataaccatagatagacagcagaaatgacaaataggtatgtgaatctggagaagaaaatcagagatatatatttgggagttatctgtacctagggagaaaatatagataaagaaggaaataggatatagtatctagccttcaggaacaccatcatttaggagtccagtagagaaggagtcagcaaaagagaatgagatggaagagtatgtaggaagcaacctattctaagaaaattgtatttaaaaattcatacttatcaatcaagagtttgttattgactttctttttattacaaaaagaaaatcctaggctacatataactgttcagaactctaggaaatttcaggaatgctataatttacccagactttggtttgtttgcaacttttctggattatatcatgtgtgtaaatgggatatgtgtctgcattcatttcaacttatgtgaccactcttcttgacgggaaaagggttagttaagttgcttgacatattaactttcaggataactactcaggaggtggacaatctaataaccttctaattgctgccttgatcttcagttgtatccatgatgagcagcttccagatacctctgttctgaaaaagtcacttaggtctggaggcgttcttgttctagaggctgtacagggacctcccctaggttttcagttcatggaaaggattggaggaaggtgggacaaaaaccagagaccaatttggaagctgtggtctaggacaaagatgatgataaactaaacatggtggtaccagtggagatgagaaggggttagattggagatctattttgtatttagaacaaaaattgcacagggattcaagatgagaagtaaagaaatgggaggactcaagaataactctagatttcttgttagaccaattgggttgatggcggtgccattttcagagctgggaaaactgtgggaagtggaggggaagcactgggggtgaagctaagagttacattcagaaatgttaatttggtgatgtctatgagacatgcaaatgaaaacgtcaagtaagcacttgaataaagtgaatctagaactcaaaggagatggctgagctagacatgtaaacatgggcacggttaggagcaataacggacacaaatgattcagggtcattaacaattaagagttgagacaaaggagaagtcaacaaaggaggctgagcaggagcagtcagtggagcgcaaggagatcaaaagagcccagagccagacacattgatagattcaagacagcagtcaactctgtttaatgctatgattagttgaataggataggggaggaaagtggccatatagtgtggaaatatggatgtcttcgatgatcttgaaaaggacggtttcactaaagtgatagagacagaagccagggagatggtcatgggctgtgttgtaaacaggaggcgagaaagtagagacggcgggagatggcacctttctcaagactttctgtagcacctagatgttgaagcgaaggtcaaaggagaattttttaaagacaagagagagtgggtgttattttatggtgacggagaggaaccaggaaagagagtttgcagtccagagagaggacggtggttcacagccttggctgcacgttgcaatcatctgggaagctttgaaactatggatgcttcagtcccccatgcaggcattctgatgtaattgctctggactgcagcctgggctttggggttttttaaagttctgcaggtgattcttggagctaaggttgagaagtttcaggagtgaaatccttgagtggttggaatccagggaacaggtgaagaagggcctgtgatgggtggggctatctactctctccagagacaggagtagagtagaagaagaggggtgcagattttccagtttaatggaagaagaatgaggtgattgccattttgtgactcctttttttttttttttgtcagtgaagtgtaaagcaaagtcatgtgttgagaagcagcagcaaggaagggcatgaaacgcttgatagggaagatgtgagctagtcatctggagggtagaaggtgaacttattacagggacatgccgggagggtgctccctgcttccagaacacagggcaaactagcacaatcttcttcattacttggcctgtggaggcccaaacatctctgcaaattctttagggatttctgacttcatggctgcctctgcctctaggagtcctactcacacttgtgctgctgcaagtgagaaacttgaccgtcaccttcaatttcaatgttggcaacaacaacaaaagcagccacacacaacatctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactggtttcataataatcacgaaacaataaagctgggcatggcccccagagcagcctgcggtcccagctacttgggaagctgaggcaggaggattgcttgggcccaggagttcgaggcagccccgccagcctgtctctaagaagaaagaaagacaataagcaataactttaaaactcaagaggcagggccgggcccagtggctcacgcctgtaatcccagcacttcgggagaccaaggcaggcagatcatgaggtcaggagttcaagatcagcctgatcaacatggtgaaaccccatctctactaaacatacaaaaattagctgggcatggtggtgtgtgcctgtaatctcagctactcaggaggctgaggcaggagaactgcttgaacctgggaggcggaggttgcagtgagccgagatcgtaccactgcactccagcctgggccacagagtgagactccatctcaaaaaacaaaaacaaaacaaacaaacaaaaaacctcaggagattataatttactcttcttaaaatttcactggctctaccctgaacctaattccagtctctctcccttaccaccccttctctctctcctactgttctcctttattctctgaacttttctctcccattctgtcccaggagcaaattctccttccttaatgcagagggatccagtgagctttattatttttgttgcttgatctcttccaacaaccatgcttttgggccctgaacaccatttttttaaatgaagtgagagaaagagttcatctccccacttattgtgtggtttcccggcctagcacgcaaagcataacccaaaaaggggatgatatgatgaaccgctccccccaacacacacacaagcacatacactgtagcccagcagtcccctgcagttttatgcttgtgtgtgtgttaatgcataacaaaggattcagcgctatggcctggtaactggaaagtaggtcaaaagagaggggtgagactgtcgcccaagtgaaaaagatagcagaagataagaaggaaaactgtttccagaaattgtcaaaagacagccaggtgaacaagattgtggcccgaggtggcacaggatgctgggctgaaaattacagcagcatgcacagcacttattgataggagaatgctcagctgtgctcctgagggcccttcagcctgctttgcattcataggcaatttatcctccttaatcactaaatcattaatggggatcaatagcaatgccacatcagtgaaggcaggggtgcatgcggggagaataattgcttgcttagtttttagtttagtggtgctaaccgggcttcgggtccattctgggaggaaacccttctcctgggtgttagagagaactgtacccacaaaggcagcaggagtgagacgggcagttattatgaattcatcatgtttttctaactactcaggaactctgaactattgaatgtatttcactatttaaatatagaatgttccagtttggtagtctagcactagtgccagatagtgggtcctgaaagatttagatttctgatatctgtgcctagtactctggagaagcagtgagcagtatttttgattgggcatcagttacctttaagggatctttctcctcttgataagttgttcccccattccattctccatcactgcttttccctcacctcattcgacctcatatccttagcctctggcacacttgaggtttaataaatgtttgctgtgttgatttaataatcccaagtaaatactctaggttcgccgcaccctgtcattacagataacttgtaaatgtaatctcagaccttaccatcttgagaaaagtcaaaaacatatctggtgtgctgggaggagtgtgtctgtgggtgatgtgtgtgtggatttctctatctcttagcatctgacaccaaattagcatctaatatttcctttttattcaatgtgttttttcacttttctttaaacaaataaatcaatttaatttaatatgaagaaatcaatatgttcccaatatcttggatgcttttaacagcaaataaataaatatgacctgcttgtattttatcattaaattcatccttagccaatttgctttgtatttatataaggtctttttagcccctttcatacagaatggagtaagtaaccaagactggtgtcctcagagtaacaatgacccacattccttctcttggagactcttgagcccagaccagcatttacgccctcaggctagagccattcatccatcaatccacaaatattgatagtatgtcgcatcccatgcccatgacaacacaatgacctgtgcacagtacgacagtattatgtattcattcagaaaaattcaaagtcaatactgaattaggtactgggactatggcagtgaaaaaggcagacacaatcttcgtatagcttctagcaaggattttacaaatgagctcctaataaaaaactgattacaattgtaaaaagtactaaaataagtcagtgcacaagaagaacacaaaactggggactccgacctatttggggaacgaggagagactggccagtggcttagctttgcaccttggctagcacccagaacagtatttgcataggatagtaatcaaatagttggttaattgaatttttatgaagttttaataaagcttatggaaaaattttaacctttatttactcaatattcctcttaaataaaatagtatgcatcattcttcctagtatctgagtcattagagacttattatgctttttatgccaagcgaggatcatttagtgtggccctgtaatcagaaaggatcccagagagctcacagtaaaccttcttttcaatggcatgtaggtgaccccaggattgaggtgcaaaggtctttacaaggtgtttctagaaagagcatggttggaagtgtctaatgcagagacacattcacccaccaattcatgtggtttacaattccttccttgtagagtctcttatatgcttcaaagtgtgctcatagtcagtatctccctagattgtgtgtttggaaggtgtaatccttatctcattcagcctttcgtggtgcctggaattgagtcaatgttcagtaaatgtttgctgaactgaactgataatcaccattctgagaggcaaggagacgattattagactcagatttcaagagagaaagcaggttctgtgatgttacgtgcatttctcaaagtcctatagaaaattaagaaacaaactgaggctaaccctggagcatcctgactctgtcaaggtaagcacttatatttttaaaacaaaagccatcagtatctggcattgtgtaacaaaagaaaaaaaaccaatagatggccagccgagaagattctgtaatgacctaatcaacgtggaaatttctgccataataaataaatacataaataaataaataaattcaggttgatatttacaagatcaaatgaaagctttctctgggaaaaaaaattaaagcataccaacaagggcacaggctcccttagaggatatgtgctaagtaaagaagctctgacattttctttgtagaattgcttcatgaataatagtctatcttctgaagatatctcagtacactaaaaagcccttaaccagcaaaacaggcaaattagcacaaatccagtaaccttctcaagctggtgtgagctgtaatgcagcatgtttgtaaggaatgtaaactatgttgtactatgcacgcacggatgattgtgctgtcgtgagcactgtgggagatatactatcaatatctgtgaattgatggatgaatggcagtagcctgagggtgcaaattctggtctaggctcaagggtctccaagagaagcggtgttagtcattgttatttcgaggataccagtcctggcgaactactctactttatactgaaggggctaaaaggaaagaagcaaactcaactgactattgaggaaccatttgcttgtgcttcatagattgattccattccagtgttactagataggcaagcaacgtctctggagtggctatatgaaaccattttaggaaggcagtgcgtttggatccttccagaataaaaagctcagactctaaaaatgccattccttaatatgctcacaattgccaccgacaggaagttactcctggtatgccacagcacacacagcctgttagaatctgccaccccttttgatgtactttgtgatggaaaaacatatcatggtgacaccagtccggagtcacatttgctctgcagatcaagccactccctctaagagtgattacacactcccagcatgaatctttcctctttttagtggtgctcagcttttatataaagggggaagcaagtgtaagtgattcctaatcccctcgctctaaattccttccttccctaaatggtgactcattttgccttttggaagggccaaaccattattccttctaaaggattagaaacaacaccaaactctggtttaaactgttgaaagagaccatgtaggttagctgttctagcaccatagttttgtttaattcctgggctccctttgccagacttgagcctaatgaccaaggaaatggaacttgctctgactttgaaatagcatgtaaataagcagaaggaatgtatcagcccatgcaatgatgaatgatcttccttctcacaaagaggttatacagatactaaaatcagtaggctcagcatttgtttttacatgtttgttataaatccttaccttctctgggtcgggaggacagtgggaatgtcagagggtgactgaaatccaccccaaattttcttggcccactcttttcttttttaactacccttctattcccaccagaggaacagtaaaataaatgaggtcattattcttcactacatgcctcttgtaaattgttagtcagcctgcaagggtggttatttacgaggcattttgaaggtctgttctggtgacagagttgctctgggcagtggatggaggtgctgtgtcacactcaccaatggtgccatgtgtaatctgtttttctcagagttttatcgtaatggtggttgtctgccagaggtcacctacgatcaaagagttgtcagttggtccaaggtgcagccgctcctactctgggagctgtctagaccttatttctcccctcagtcctcagttaagtatagtttccagctcccacattccacacaagcctcatacacgtctaccttctaccagtccaaattgttgggtttctagaatagtgagttgtttgttagtttgtttttcctattagtcgagccttccattttactaagtgaagaactagcttcccctgaaacttagtgaaaccccaccgctctgaagctaaccaaaaatttaaaaacaaacgaaaacactatcaaaaagccaacagcaaaaatctccaagggcaaatgattacatttttctatttttgttagccttccaaacatagggagtttttttggagtttccatcgtgatacaattttttttaaccttgctttggacaactatattttaaagtgacagatctgaataaaaacgggaaataaagcactgctttccaccctcaatcttctttttaaaatcataaataaatttaaaattaaaatcgagccttcccatttgacttccttgccatactgtggattcatgataatgtctgcctgtttgaggtgagatttaattcaagtgttggaagggaaagggtggcctagtctggagctccagaactcctctctatcatgctttgccacttaaatttatcacttcccatcaatactaacgcaaagcccaaaggtaaatccttcattttcttggacttcttccttactctctaagctccagacatcttccccatctctcattctttcagtacacattgattgatttcctaccgtgttccaaggcacagtgttgggggctggggacgcagtcatccgatcctttggacccaagagccatggactacttagaaggcagcttattcaaatcctagcttcacaactcactagctgcatgaccttggaaaagttatgtttctctctgcctcagtttcctcatcagtgaaatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaataaaaaataataaaagcataaaaagagctcaaagatctacaaattagagacactaacaattaacattttgttgtaatgtcatccatttaaagtattttcagtgcttttcatttttaattggcaattaattgaatatattgttcttttcaaataaacacacatgtacatttacatggctaaaagaaaactttccttttcaccaatcttccaatcctagagaatccccagggaaaaccaactttaactgtgtatatcattacagatactttgctatcattttatgtattgatggcatatatatacctagagaatttaggttttttaaaaccacaaaagagattgtgtcaacctgttgctctgtacctcattttctcactcagtatatcttggagcgttttctatatcagtacctgcatcttctttttaatggctgcttggtatggtcatatcatgttgttttggtgttttgtttacaactatttggattgtttcccatttttactatagcacgttatgccattttgaaggttgcacatacattttgtacaaatgttactgtagaatagacatctagaaatagcattgggcaaagtgaattcacattttaaatttgcatagatattgcctaattacccttctaaaaggctgcagtattttacactacagccatagtagatgagagtatccatctcttcataccctcattggcactggtggttaatcatttgttttaatatttgccgatatggtaggagaattatggtatttcattggtatttcatggttaatttggtttttatgtctctgattgttagtggagttgagcattttttcatatatttattgaacgttatgtttctctacctgcttatatctggaacatgtcaggtgaaataaagatcgtcagggagagacacacatgtgcctcttaaatctatggatacagtttgtatatagtaggataaagagatcttactgacactttttttcttacatagataaccagctgtcaaaacaccacgtattgatcagatctatttttacctattgattttaagggccatctttattatttactaagatttaatacacatctagctccttccatatatttgtccattactgtgctaatgtcagttttaagtgtagctttgtttcagttagctataatcacactaatgctacattaaaaagaaccagaaaatcttagtggcatacaacaataagcacttactcagggatctggggcttggctgggattgggctcatccagactgggcttgactagccagctctgcttccggtgggaacagctggagaggatccgtctctccctgagagctccggagaccctctgctctggtgcctctcatccttctttgaccagtgggcttgctgggtcatattttcctcagggtaacagcagatttgtatgatcacatgctcagctgcgcagtcatattttagacccctacttgcttctgctaacattgcttctgctaacaccccattagccaaaataagcctaaagttaagagaggatattccacatttagagggaagaactgctagttacatggcaaagggcatagatgcaggaaactataaattggggtccaaagtttaatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagctaggattacaggcacacaccaccatgcctggcttatatttttatttttagtagagatggggtttcactgtattggccaggctggtctcaaacttctgacctcaagtgatccacctgcctcagcctcccaaagtgctgggattacaagcatgagccaccacgccctgcctggctgttttctttcacattgttttttccagataagcttttgaatgagcatgcaaagttccaaaacttctgagtagaagtttggttgggttcacattggtcatatagactaatttgggtagaatttatatctttacattactgaatgttcacatccaattggaaacattttgtatgtgttcattttgtatttcagttttatatcttttgacaaagttaatttttcttataaatattttcagataaactcaaaagcagaaagagtagcacaatgaatatctacttatatgactctcagagttaatggttatcaagattttgccacatttgctttatctatcccttttttccttattttttgccttagcattttcaagtaaattctagtaatcatattattttacctgtacatattttagcgtgtagctttttaaaaatagacatatatacagtatacatagatacatatgtacatatgtgtgtatgtatgtgtttaagtgtgtttgtgtataattattgcagctaatacaaatcaacaagagctccttggtattatctaatgaaccatctttaatctaattttcccaatgtccaaaaattatctttttagttagtttatttggattaaggtctgtagattaaatttggttggtatgtcacttaaatcttttcctctagagtaatcctcttcatctgtttcttcatgccacaaacttatggctgaaactgagtcattttttatgtagaactttccatattctgaattttgctgattccatcccccggtgtcatgaaatatttttctctaaccactgtgggatttttttttaaccactgtggcattttctgttaagcagctggttagatctacagactctgtcagattcagctccaagtggcattttttttttggaggaaggggcaaaaatatttcataagtcacgccattgcttcctaggacattcatcctggcagaagatacatatatttaggtttgtcaatagtatctggttcacgttttatcagtctcatccacccgttacgaagttctcttcttaacgaattatttctgcctcaattcgttacttcattagggattgcaagatcgtgacattctaattctaccattccttttgcatttattataatcaattatttcgttaccttgaggtagaattcgtgtaaaaacgcttagatgcctgtcccaaacacacacattttcctgagtgcgatttacacttgtagggtcctgtctgtgttaaagatgctttgctgctctcccaccaggcctgggaataagtaccagactgatgatagacggggaggatgatcctcctgaaattctagccacagggaagaaaagtccttgcaatgaaagacactggccagggaagctggttggacacacacacatacttgcacattcacaagtatctttcattaaaaggagatgacctactgcttccctcctgccagtgatgggccacaaaacagacatgacacgtgggccttctcacgtgtcccagatttgttttaaaaatcattttcaattcatctagttttctattaatgttaaaaggttggaaattatattttaattagtgttagagatgtacatcagcatcatagaattctgaaactactgatgcaacagaatcataaaatgtttaatgagacatatcaatttaattctgctgcttggaacttaaagagccagagttcgtcagcattttgctaacaaatgtcatcatttacagactgaatttggtgctgattatgttcaccattactaaaaatattgggaaatgagctatgcttggtgaaacaaagggcattttttaaaaatttggctgattaaatgtagtttagaaacaaaataaacttgcataaacttgcaagtgtttggaaacagtctggtttggtaatagtcactatgtttaaaccctgatgcagatgatgctgtgtatctggacaatgagaaagaaagagaagagtatgtcctgaatgacatcggggtaattttttatggagaggtcaatgacatcaagaccagaagctggagctatggtcaggtgagccacttaaaatttgttattgtcaaggacatttttacttcatattttttgtcacatgtatccctacaggatcccatatatcgatattagacaagcacaatttcctgctttttaggatctgagactccaaggcagagagcataggagtagggactcataaagacaactgcgtaatttatcagctgaaaccacatatctctgggtattacagtgttacagaaatgagagattccatgaataatgtggcattctattgagaaatgctttggccacttagaacagtgaaatctcattagttcaacctggcttataaagaaaggtattttcaaagtgatgcaaagaatactgcaaggggtgtgcccaattcaaagaaatagcttctttttttttttttttaagtgttagcctagggtactgctaattagaaaagagtgttatcatttcatcaaaggaagggccactgagcttttacatagaaagattttatcagctgcaagttgattgtctagacacaaagtagcaaatggcatttctttaagatgttcagtcattcaaactatttcagtttggtatctttaacaatggagcaaatgaatgatattttaccaattttccataaatgaatgcatgtcctgtgatttcaaaatgatttttaattagcgacacaagcgggggcgaatgtcatttctcaggagttttggctgggatggctggaactgtgcatcattgcgctgggcatccagcagggagttttcatggaatctggtggtcacagggtactttcttggctccggatgccttgctttgacttccatatgggatctccctgtgttccttacccactgctccagtacccgtgttatcctgcctacctggctttgtgaacagcttccctgactccggagaattacatgcccagtgctcaggcttccccgcctgcatttctaatgtcctgccaagctacaagctagttggcaccccctgttcttggattcctgcctgactccctggtttcaagccatcccctcctcagtgacatgcaacctttgactatactgcctactgcctgatgcccttgtcttgggtccccaatttctagcctttagcctggtgattctatttatggcccaaatatgacaatctatagatagctaacaaggggaaaagtcatcaaggtgggcagcaaggaggtctggaaaagtgtcccaagcccagtcagggcactcttcgccagcttgcctttgggtaggcaccctggagcacagtcacttgattgtatcttctgccactcaaagaggctattggtgtgtatcctttggccagaataaccagccaagcatgtttacagtgatgcagggaatcaatccgttctatgactatttccttaactctccagttagttgctatcctgcccagcaaacacagctgagagaagctgcttaataagaaccaaaatactgagctatttgcatacctgaagaactagtgcaattacccattactgcatccatcctgtcagtttgggatacacccagagtgggtattctaactggactgaataaagaattgtgtggtaattagccattatgattgtggtttctgtcacaagcacttgggtggatagcacacaaggtttctctattcaggaaaatctcttactacagtgaggtacagtataggtaaaatcttcctgtcttgctatttgatctttattcctttttaagaaaattctggtattgcctgtggctagcagttctttctaagaagactgaactggtaccagactcctcccttgatagtgtaatctactttctgcagccttctgccctctccttgatcctggggtccaccttgtctcagaagaggggaaaccttagagggacagtcactatatgaggtctcctactattttgggtgcaaactaagtagtgtgaagcaccttcctgtgatacacctgagagctctttattttctaaatgcacgaggattcacattactttcgaggtcctaagactctggcctgactttggtaaatgattcattccttcttcttgggtacaggagccaatatgttgaaaagaccttctaaattgaatcattttctgaagaacttcaagtcagcttatgatccctgagtatatcaactctctagtatttctgtttatgtttctggcttgcttttatattcttattcactttaatgaaaaacaaaagaagatgtctcattccttctactttaatatttcatactaaagattatgggagatcactatacaggaaacacacatttctaaacattaggttgtggtttcatgttatttttcatcagagaatattttgcttgcagagtgaacactagtttctctttgtttttctttctccaaatagtttgaagatggcatcctggacacttgcctgtatgtgatggacagagcacaaatggacctctctggaagagggaatcccatcaaagtcagccgtgtggggtctgcaatggtaagcagcaattactgatacctaaaatctgttacacctgtcatttgcctcagtatatatgccagttcattaagagctgctgaaatgatgacttacacttaataaactttcatttgtaagattctagcttctgacacccagttatagctcctggaattttctgagcttatcatgtgctataaaacaaaattatcgtctcaatactgtatgtttctttggctttagaaaacaatgatagatataatgatactgtagaccagttattcttaagaaccccttgcctagagactgaggagtgatcatgacaaaaatgtcaatgactataatcaaacagttgatcaaccaaacatcaaggtgcacagaagatgtgcaaggcacagcttttctcaattttcacactgatagtaagagtgaagaaatgaatggctacatctcatcctaactcctgtcacaaggatgtgtcactgtagggctttctcacttacgaagtgggtattgattctttgcaggatcctgtgtggtaagtagggcagccattactcatgcacttttacaagttaggacacagggtaaggacagctttcagtgacaaagccacagctagaactccggtctgctgacttcaaatctagacattttctacttttcatgccgctctctgcaggatatcctaaaacaactttgagaatgcagagatcttgcagtggaacaactttctgagaaaggagatagaactcccatgagtgggaagggtgggccaggcataggacgtggattaaatgggatgtccaggacccatgcagtcctggattatatcaatgtacccaacatggagagccagatgttggtacagagaagtagacccaatctggctgaagagtagattatttctgaagaaatgttaaactgggtggtatttcaaacaatcaaagactgaaaaaaagaaatacttatattaccaatttccctaagttttctaagaaatcctctttttgaaagaatgttatgtttgagtttggtttgtatattcttttgagctaaatgaaatcaatattgttaatataaaaatattagactgtgaatgatatgaaatataatttctggttagcttttaagaatggtggcttttattttattaataactaagctacatgtgaatttaagaaacagcagagcataaaaagtaaaaatagaaaccaacatgtaaaggcagttttgtttcctatgcatttacattccataatgggaagccaatgaattccaaagatttgggggaatgttgaatttgggaaatgtttaccaaagtgtcatgaccgtttataacaaatatattagacttgcatctgatcactatttttactgtttcgcccacaagatttctctttttcttctttgaagttaccataacaattttgcagtaagaaaggaagcaacagctagcagtggttaaatttaaattaattccttcttaagcattctaaaatggcacactcatcagcataagcttactcacacactgtgtgtacttttacgcacccagaagtcagaaatcactgcctagcagaagccagtgcaaaagagaagcagacaggaagcagttaacctaatgtgtctgtggtggcagctggctaagcggaagctgttaattattgaataagcacacatactcctaatgcaaattgccctgagattttattaatcatgtaaagcctatgaagttctaagtttgaaaatttatatcccaattaaaagatttaaaactagacagagaaaatccatttggaaaacggtttggttttatttttggagggggagaatttgggtgttaaggggtagaggtcctgacctgagacattttgagcaatatttccatttccgtcatacccttgtttatatacacaaaatattcaatggttttcaaaaacactttcacctctattagctcctttaaaccttagaatacctctgtgaatctttccaaaatctgttccgttttaataattttaaaagctaaaatactgagcctccaaaaatcaatttaaaaaatgacacagaggaaagatcaagtgttctttggtcattcaggcagatactctcccgttcacaaatcctggaaatctatcatgaaatttctgaatgcagttaaacaaagaacaaagacaaaaaaaatctttaaatttctcaatgaatgatttgactttattagtatgaaaagatgtgcctagagagcccacaagaaaatgttctgaagttgtggactcttagccagaaccctgttgcaggtcgacagagctgtgtgtgttttctcaggggctgggcccaggcctcacaggtaaaacagaggctggtgcagagttgttctgaattcctctcaaacacctcccagcctggtcatagaggctagaaatcccattcgcaggttgcaaatgccagagcagcggtataggtggcatgtggactctccagaagaaatagcacatagatctcagttcatccccaggtgagagtgaaggaaggcagaactttcctgagggcacttgctgctgggaaacagtgaggatgagcagaccagtctttgctgggtatctggagagagtggagctgggtggggacaagatgcagagcacacgactggggccccaaagacaaatttgcttactgtggtccaggacaagtctagcactgaaggttggcaaggagttttcaggcaacaggtgggtgcatgttgaaaaaagcaccgataacccaaattgtgcaaactttcaatcataataagaatctgaatttgggccaggaacggtggctcacgcctgtaatcccagcactttgggaggccgaggcgggcagatcacctgaggtcaggagttcaagaccagcctgaccaacatggagaaaccctatctctactgaaaatacaaaaaattagccaggcatggtgatgcatgcctgtaattccagttactcaggaggctgaggcaggagaattgcttgaacccgggaggcagaggttgtggtgagctgtgatcacaccattgcactcaagagtaaaactccatctcaaaaggattttaagtgcacaatccccagataaaaatatttattgttcagtatatttatatttattgtatgtgaccttgggtaattgtttgttgtagaaggttgtcctgtgtagaatgtttaacgacatccctatcttctacctgggggatgcaagttgtcataactgttcccttaccagttgtgacaactcaaactgattccacatattaccaaatgtctactgggggtaaaaatcacccttagtgaggatgacagcactaaacccctctgtgactcagtttctccacctatggaatgtaagtaacactctcttctcacctgcatagcgaatctgtcttcctaactcactcaaaacctgctggttttcatccttgactgaaaagaaagtgaaggcagcatcatatgggaagcgactcagctcgtgtcgagggattggaccttgattctggttgtgctattaacttactatgtgacccagggtaaataactcacctctgctggcctcgcatctttgtctttaaagtgaaattttgtctctgtactcaaaccacattggcagcaagaatactcttttattcttcaaaatagtgctctcccttcttctattttttcctttatacattcagtaacttcccttgttcttatattgagttgctgttatttcactttgatgtaaaagtaggaaaagttatgacaatctggacagcctggggctattggagtttcccaggagaaagcaagtccaaaatcctgtattctcatcatctagagattaggcctgagatattataaccttacataagctaacttttgcttaggctcctttaaatactgagtggtgcattttaccaagctatactgcagattgatttaagagagaaaagaaaaaaaagagaagcaattagaaaaaatgaagaaacttgcccacagttatacttctccctttaaattgcattgcttgattgctgctttcttttcaatgcatttctgatgtgacagttcccaccaggaaaattgccagagaaagctaaggagaatgcttaactttgtgccatccgaacacttacttccctcacatggcattaataaagcattctattgctagccccaagtttctgtgaataagccagacatggactctgagccctgagtcagactatcaaagaaggtgggccgtgacatattgtgacaagggcagcatggttctggggaaaagggaaggctgtgcaaccacctggcattactgcggcgtggttacctgtctatgcctgttcctgcctcccgactgataggatctggcagcaactatgggcagagaatttcccccaaggagatgcagctgcttctgcaaaggctgccgttactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctgggtgaggaagcagaagcccttggaagtggtgtccctcactcaaagtcacacagcaaataagtggctgagctgaaaccagatatggtccttactctcagatcatattaccttagagggccactatcaacacgttattgccaataacacaataattatgtaagattgagttgccatttcctagaaaagaagagagccccaagggaatggagcccagatgaggcaaattattgaaaatggggaataagtgaagaaaggtatcaatcagaggattctaaatagccataggcactggggccctggagaatgagcttccaaagacgatcaggtaccaaatatgatatgataatggtggtggtgtttggtggtggtggtgatagagttagtgatgatggtggtggtgacggtggtggtgatagtgattgtgataataatggtggtgatggtagggtgattatggtggtgatagtgatgatgatggtgatggtggtggtggagatggtgacggtgatggtggtggtgatggtaggagtgatggtggtgggagtgatggtggtagtggtggtgatggcgtaatgtggtggtggtggtgatttatgatggtggtgatagtggtagtggtggtggtgatggtggtaaaacactcagtatttactcatttgtttgacaaatgtttatggcaatctaccagtctgaacactggagtacaattgtgaacaaaattaagtttctgccttcacaaagcttacagtctaacagagaacacagactagtaaatagaaaattttagctcagcatggcaaattctgtgatggaaataagcatagggttgtatgggaaagcaaatctctcaaatgtagctcaaaggtttcccaggactaaacattggatcaaaagatagaagaatgtctgaggtcccacagtaattaaccatgctattatttgaagaaaccctttctccatggtggaaattatatacaaacagctagtcaccaaaagcactgaagaaaaatgtagtagagggttatttgctcttctgggggcttgtttgttttgcaattcagaaaactaaggttgacacaactgaagtttattccataggatctcaacatttacagttacttgatccatggtattctgattcagttgtagtaagaaaaaaggtaatattaatgagaaaattaggaaagtaggaggagagaaaaaaacgtcaatatagttacatatttttaaatttcagtgtttgtactgctgccatcctggactatccagcttcccttgagatgtatgcatttatttttaaccctggccttttgctaatatcgaaccacaatgccatcattaatccccattaatactttgctctgactatgccttttgggaactaactcatgactaaacttttttaaccaatcgatgttcgatgtactctttagcattgtaaaaaaatcttgaacttcagctagtaaatcaaactgaccacaattcggagtaggtcctggatttttctaggacacagtacaagatgaatgactgtagacctttgagatgaaatggactttagtgcttctgatcctcatgcatctgtgatcctacagataaacagaaaataaagttattttccctttgtccatcttttcctccccctctttttgtcccagtatttagaaagatttttttctttccatgcatgaaaaagacagtaatgacataactacttttatatcttgccaagcagctcctcaaggggttaactataaaaccatgttttgttcattttctttcaattgtttacttggtcatcttataggaagcttcacgttgagcaaacctcttcatgcaacaaaccttaattataaatattcagattacatttaaaagttcactttgattagaaatttcacacctgagtcatcccaaatgaactgtaaagacagaaataaatatataaagtttgtatttatttctaaagtttattccttgatcatacagaccagtcacaaggtactttcgtaacagttttattaagaaaaattttaattacaaagcaatatctaacccatcctttggtttataaagcagcttaaacctctttttttggagtgaacggtcgtagatacatctgaggacccaggtgctcaatgggcattgtccttggcatttctaaatcaccaaggaactttttcacatttacccatatggattttaatttttgaaaaagttcatctatcaaaacaaatcatgattatgtaataataccttgttaccccattcttgtgtcagatttatataactgccaatgggaacttctaatgatggtggcggtggtggtaatcatctctaccagataatgagtatgaccacactgaatatgattcggtgtcactttgtgggggtaaagatacaacttccatctggtcttttataaaagcgacaacagcctacctgcattactaacccacagatgcctagaggtcaaaattccccaggtggtgaccactgccagatgtaggttccatcatggacttgagtctccatccagagcttctgggtctccaaccctatcagcttttatttaaaagtgttattgtctctttctatgattcatatcaggaatgaaatttctcagtttggaacagcagaaaaaggcagaagcctccggtgttccttgcaacctttccaattgtaacgcatatcaattagtaggagctctcggggtgacaactttgggagaatccactgatttatattaatgaagagtgttactgtagtccaacagagtaaagtactaaattaccaactctaaaaagattttttagaaaaccattaaagttaaagtcaaggtatttctaagaatgaaagtcatttctatgattctaaaatgacccagggaattcaatgatgaatgagaggtacagactcaaagcaattctctaatgtattcaaagtaaacaataccataaggtcaccttattcaccagggattttcatttctgttcattgaagatttttaaaaaattgacagatatattggaagccagtgggaaaatagaatttatctaacagaaagtatcttcatagccacttttgagaaattgcataaatccattccataaataaccaaagtgcaggtggagagactgaggcatcaggaagttaagtaactttatccaaggttgctggtagcactgggggtgggtcatgagttgcctggccccactaattcacacacaatgttctatttcccctggatttgtcctctgtctgtcctctctcccggtcacatgagctccttggatacagatataatgccttttacatgtcctgtctgattcaatccttctctttcaggtgggggcagtggggggacgatgaactgctcagacattatcttttttctcttatggtaaaagccagcagtgtaatgaagtttccatttgtggtcaaacagcttggtttctcaattattaagcttacatttcttatgcctcttcaccccatatttttggagaaaaacagacatttattacaaggcatctctcgaatgtgataatcatgggcaatctaaatgtctgctttccctgaattgcttcctggaatgaggtttcaatgctgcagctattctgtaatcacacaggctatttctgaagcacagggatgctttacagcactccctccaagctgagcggttggtgctgctctggtctcctggggccagcatccccaggatagatggatagcaaaggagcaaagcaaagccagctcagccctttaggatatgcacagcttcatgcaccttgggttcccttcataccctctttctttcccctgtctcctcctgttacatccttccctttttcctcctcctgctctgcatttttccctctctcatacgtccattcctttaattcagatatttttgaggcctgttctataccagctctacaccatgcagcagtggtatggcaatgaaaacagcaggccacacttggagaccttgaaatctcagttttctctctcagtccacatttgcttatttctctcattattgtcaattagtaaaatatgttttggccaaatgagcatcctcagatactgagagagacaaggttaataatttcctgtggtcatagttatcatgaaaaatgagtctaattacccacccctatcagagcttgggtcatatatataccaaaggacattcatatatcggtagttatatgcttcatactattcattacagttagttacaggattttttttaattgaagtaaaatttacatacagtaaaaaatcatggatattaaatgcacaattcaatgacttttgattggggtaatcaccaccccaatcaaaatatagacatttccacaagctcagaagtttccctcgtgcttcttccggtcaatccccacctcattaggtagctactattctgatttcttgcaatgggttacatttgtctattcttcaactttacataaatggattcacacagtagaaatagggctggcttctcttactccatcaactgttacatgtgttttcaatgctttccttaccattactaagaagtattttattgcattgtatatcacaatttgtctatccattcacctattgatgcatgtttaagatgtttccaatgtgaagctattatgaatacagttactataaacattcttgtacaagtgtttttgtgtatgtgttttcatatatctggagtaaatagctaaagagagcatgcctagatcagaaagtatgtatatatttaactttataagaattggctagttttccaaagcagctctactgttttacattcctgccagcaacatatgagagttccagtttctccacagcttcacctattcttgatgtcttgaacctttttaattttaaccaatcaaatgggtatatagtggcatttcattgtagttttaattttcatttccctgatggctaatgattttgagcatcttttaatacatttattggctatatatatatatatatatgcagcatgttttcaagtctactgattttcttattcagtcatttgtacttttattattaagttatagttgctctgtgtatatacctctcatttgtcagatatgtatagaacatattttccccaaactatggcttgtagttatattttataaatggcatattttaagtaacaaaagtttttaaattttataaaatcaaattttttcattgttctttaatagtcatccccagtaaatgttctttccacatgaagactttcacatgaatcactatttgcccatgtttgccactatttctcctatgttttatttttgaagctttataatttgaacttttacattgtggtctatgatccatcttgagttaccttttggtgttgtgtgaggtagggatcaaatcttattttttccaaatttatccatttgttccaccagcatttgttgaaaagactgttggaaaggctttcattcgttgcaaagagtttctttgttgaaaagactgtcattttcttcattgaattgctttggtgactttgtcagaaatcaaatgtctacatgagtatggatctatttctagactctcttttctgtttcattagtttatatgtatgtccttatgacaataccacactgccttttttactgctttcctctagtaaaccttcaaatcaggtagtcattcatttttgttcttctttttcaatattatgtttaattattctagatcctttgtattgctatgtaaattttggaaacaactttccagctttaatgaagtgcctattggcattctaactgtcccgttgtcttgatctattaaagaagtattaaaatgtagcctatagccatcttccagtgatagcacatccattcattcaacagaacttattgagttcccactctgtgctagccctgggaatataaagtcaaaacagcatagtgccttccttccttctgtgaacataaagtctgggaaaagaacaaggacagtctaaccaatgacacaatacaatgtgataaatggatagtactatgcaaagagtactatgtgatcaaagagtaaggacatccaaatcaaggtgataagtaaagattcccagggtgaaaccagctgagttttaaaggatcaatagggcaccaggtaaagaagaggtttgagtgtggatggacattccagggagcgagaataacatttccagcaacaacaaggcagaaaacagcttgttattaagcaaaccactatgaaaaaccaaagacatggtagatgattttcctttcctttcgaccaagtatgtgaccctggctgttgtaagtgccataaaagcccagaagaaaatcaaggatgaagagccaggcaagggaagaaatagaattgctgctaccctatttcttttttcttgtgcattttctgggatgcctgcccatggaataacctgagtacttgaccttcagctcatctcccttcctatccttacaacataacttggcaaatggcggagcaggcacaaaaacagatctctacattcccagaactgtgaccttttaaattttattttttagaacaattttttcaaacagcaattgaatccaaatacataaaagagaaaaagcagagcagctattattaaagaaaggtggtgactgcagccttgactatcaacattcaattctcacctgccccaccccacaacaccgtaactactgagtttcttttgcaaaaccctagcatgtcatgaagcacaatttgacatccaccacaccacttccacctgtgattaagtctggtcaccaccacactgtagctggggatttgtggttcacaaaacctggaaacgattttctacaggaaataattcttctccttgccaaacttaacgctaggcctttgatgttagttcgtgttacccaacatcaaaattcatttccaatggtctttgagaaaccattgtggacaaaattaggtataagactattttctaaaagagttatggaaatcctagcctttatgaggacataacttttaacaatgaaatttaacggaatatgataggtttataacagagaaaagtcatttcatcatagccatataaaatgcacacagaggagaaaagtacccttgcatatttttttaaaaagcagaaagaaatagtaactatacaaaatgtaaaggtctgcgctacaggaaattgaagaatcaagaaatgtcacatttctttatttttcagtatcaagttagaatctgctcatattccaatgaccaaaattaaacagaagtccagtacgggtcatgttttagggctatttctattctttgaattatacaggagaaataattttaaaatcatagataatattatactatagatgctggtttaatttaaaagtcttcattgattttcacagctttattgagatatagttgacaataaaatgtgcatacttaatgtacaattggataatgttgacatgtatatgtacccatgaaacgaacactaaaatcaaaataatgaatatatccattgcccccagaagtttccttattgtaatttcttccttaaaccactccctgctttgtgtaccatcccccatcactgctcagccttctgtcattatacattgatttgtgttttctagacttttacacaaatataatcatgcagtatgtactccttgtgaggcttcttttatgcttccttactgtattctgagcttcatccatgctgttttttgtttcagtagttcattcctctttattgctgagtagtagtgtttcattgtatggatgaatcactatttgcccatgtatttacttgtggatggacatttaggccattttccgtttttgcctcttacaaataaagccagaaactttagcttggaagactttagtaaaagtctttgtatagacgtaagcttttatttctcttaggtaaatacctaggagtgaggtggctgggtcataagctaaacataggtttaatttttaagaaactaccaaactgtttcctaaattggatgggcattttacattcccaccagcagcatatgagagtctaaagtgttgcatatcctcccggacacttcatatgatcagtctttttaatcttagacttttaaatagatgtccaatgttaccttgctgtggttttgatttgcatttccttaatggctgatgatactgagcatcttttgttgtgattggccacccacgtattttctttgatggaatatctgttccaatatttttctcttgttttaaggttgtgtttgttttcttactattgagtttcaagggttctttacatattctggatacaagttttttctttttaatcagataaaggatttacaaatatcttcttccactctagttttattttttcattctcttcacagggcctttcaaagagcaaaggttcttaatttttatgaagtctgatttacaaatttttttatggatcatgcttttcatattttatctaaggaaactgcctaacctaagatcacacaattttctcctttgcttccttttagaagttttataaccctaggttttatatttaggtctaaggttcattttgagttcatttttacatatggtgcaaggtatgaatcaaagctcgtatttttgcatatgaatatccaattgatgccacctcattttttgaaatgattatcctttatccataaaatttcctttgcaactttatcacaaattagttaactgtatttgtgtgagtctatttctgtgttctctattgtgtcacattgatctgtttgtatttataccaaatggtgtcatgctacttaatttgaaagtattacatgtaattgtacccaaattctatttaattttaagttttattgaattttactttaataggaaagaaattaaattgcaacagaagaaattattaaacttcaaataaatatttcttcactacaagagatatcatttcttaacaggttttcctaaggttattaaaaattataaaaaccattaaaagaataaagtaattatgtacttttaaattatactttaatgttagatggtatcaattaactgagagacccacacactaaaacattaccattttcactgttcctctcctctttctcctatcttttttcttaggatgattattgtttttatattatcaagtcttaaaattcatctgtaactgtaaatcccaaagatgcttaacttatatagagttttctcacccctgaatctgttatcacagagtctctgttcctgggttctttgtttgactcagcccctaattattttgatatcactttcaagtattaatagtttggttatgataggtaccatattccctgaagtacttcatgttcgacaatgtgtgtaaaagggggctgaatgcttgatttgatgctccacttggtcactgttgatgtagagaagagctaatgatttgtgtacattaatcttgtatccagaaactttgctgaattcttttatcagtcctaggagctttctggaggagtccttggggttttcaaggtaaacaatcatatcgtcagcaaacagtgacagtttgacttcctctttacctatttggatgtcctttatttctttctcttaacttattgctctggctaggacttccagtactatgttgaagaggagtggtgacagtgggactccttgtcttattccagttctcagaggaaatggctttcaacatttcctcattcagtattatgttggctgtgggtttgtcatagatggcttttattacattaaggtatgtcccttgtatgctgattttgctgagagttttaatgataaagcaatgttggattttgttgaatgctttttctgaatctattgagatgatcatgtgatttttgtttttaattctgtttatatggtgcatcacatttattgacttgtgtatgttaaaccatgtccacattcctgttatgaaacccacttgatcatggcggattatctttttgatatgttgttggattcagttagctagtattttgtgaaagattttagcatctgtgttcatcaaggatattggtctgtagtttccttttttggttatatcctttcctggtttttgtattagggtgatgctggcttcatagaatgaatttgggagggttccttctttctctatcttgtggaatagtgtcaaaaggattggtagcaattcttccttgaatgtctggtagaattctcctgtgaatccgtctgttcctggacatttttttgttgataagtttttaattaccatttcaatctcactgcttgttattggtctgttcaggatatctaattcttcctgacttaagctaggagggttgtatttttccaggaatttatctgtcttttctagattttatagtttatgtgcattaaggtgttcatagtagccttgaatgatcttttgtatttcagtggtgtcagttgtaatatctcctgtttcatttcttagtgaggttatttggattttctctctttttggttaattttgctaatgatctatcaattttatttatctttttaaataaccagctttttgtttcatttatcttttgtatttttgtttgtttcaattttgtttagttctgctctgatcttggttatttcttttctcctgctgggttagggttttgtttgttcttgtttctccagttccttgaggtgtaaccttagaatgtcagtttgcgctcctttggtcttttttctgtaggcctttaggtctatgaactttcctcctagcactgcctttgctgtatcccagaggctttgataagttgtgtcattattgtcattcagttcaaagaattttttaattttcatcttgattttgtttttgacccaatgctcattcaggagcaggttacttaatttccatgtatttgcatggttttgaaggtttcttttagagttgctttccagttttatttctgtgtggtctgagagatggcttgatataattccaattttcttacatttattgaagcacattttatggcttatcatatggtctatcttggagaaagttttatgcactgttgattagaatgtgtgttctgtggttgttggataaaatgttctgtatatatctgttaagtccatttgttccaaggtatagtttaaatctattgtttctttgttgactttctgtcttgatgacctgtctagtgctgtcagtggagtactgaagtcctccactactattgtcttactgtctatctcatttcttaggtctatttgttattgttttataaatttgggaacttgagtgttcagtgcacatttgtttaggattgtgatattttcctgttggacaaggccttttaccattatataatgtccctctttgtctcttttaactgctgttgctttaaagtttgttttgtctgatataagaatagctacccctgctcgcttttggtgtccatttgcatgaaatacctttttccacacctttactttaagtttatgtgagtccttatgtgttaggtgagtttcctgaaggcagcagacagttggttggtgagttcttatccattcttcagttctgtatcttttaaatatagcatttaggccatttacattcaatgttagtgttgaaatgtgaggtaccattacattcatcatgctctttgttgcctgtgtactttggtttttttgttttttgtttttgctttttaacttgtatttttgtttcataggtcctgtgtgatttatgctttaaagaagttctgttttgatgtgtttccaggatttgcttcaagatttagagctccttttagcagttcttgtagtggtggcttggtaatggtgaattatctcagcatttgtttgtctgaaaaaggctgtatctttctttcatatatgatgcttagtttcgctggatacaaaattcttggctgataattgttttgtttgaagaggctgaagatagggttccaatcccttctagattgtagggtttctgctgagaaatttgctgttcatctgataggttttcttttataggttacctgatgcttctgtctcacagctcttaagattcttttctttgtcttaactttggataacctaatgacaatgtgcctaggcaaagatctttctgcaatgaatttcctgggtgttgtttgtgcttcttgtatttggatgtctaggtctctagcaaggccggggaagtattcctcaattattaccccaaatacattttccaagctttcagaattctcttcttcctcaggaacaccgattattcttagctttggtcatttaacataatcccagacttcttggtggctttgttcatattttcttattccttttcctttgtctttttggactgggttaattcaaagaacttgtctttgagctctgaatttttttcttctacatgttcaattctattgctgagactttccagagcatttcgcattcgtaaaagtgtgtgcaaagtttcctgaatttttgcttgttttttctttaagctatctatttccttgaatatttctcccttcacttcttgtattattctttggatttccttgcattgggcttcacttttctctggtccctccctgtttggcttaataactaacctccttaattctttttcaggtaaatcagggatttcttctttgtttggatccattgctggtgaactagtgtgatttttggggggtgttgaagagccttgttttgtcatattacagttccttctcatctgggtaggctctgtcagagggaaggtctagggctgaaggctgttgttcagattattttgtcccatgggatgttcccttgatgtagtactctcccccttttcctatggatgtggcttcctgtgagccaaattgcagtgattgtctctcttctgggtctacccacccagcaagtctacccagctctggagtgacactgggcattgtctgcacagaatcctgtgatgtgagccatctctgggtccctctcagccaccggaacagcgcctattccggtggaggtggcagggggtacaatggacactgttagggttcttagctttggtgtttaatgctctatttttgtgctggttggctccctgccaggaggtggtgctttccagagagcagtagctgtggtagtatggggaggaaccagtggtgggcagggccccagaactcccaagattatatgccctttgtcttccactagcagggtaggtaggaaaggaccatcaactgggggctgggctaggcgtgtctgaggtcagactctccttgggcaggtcttgctgcagctgctgtgggggatgggggtgagatttctaggtcactggagctgtgtacctaagaggattatggctgcctctgctgagtcatgcaggttgtcagggaagtggggggaagctggcagtcacaggagtcacccagctgccatgcaaaccaaagggccagtctcactcccaccgtgcccccctcaacagccctaagtccatttccaggcagagggcaagatggccttgaaaacctgacccggtctacccacctcccagctgcaaaagaaaagggtttggttcttccacacctgtggagtctgcacaccggatttgcaccctcccccaagttttggccaggaggcttctcaccccattcaaattgctacaaagttcagctagagatttccttctccatgtggagttttatcctctgctcctctgtccacctttctgatggatctctgtggtgccaggcagggatggcctgctaggggacctagcaagctcccagggcctttctgctgcttcctctacccctgtatttccctcagctctccaagttgacccagcaccaggtgaagtcggaaacttctcccacaaacagaccttcagcttctccagtggaggtttgtgttcgggagaggagggtctccctttcccacttgcatagttgggacactcacagtatttgggggggtctctcgggtcctgcagaagcagtctgcttccttcagagagtctgtggtcctctcaggattgctggtttgttcttgcagtcgacctggatctaaaatttacagcacgagcctccacatgctgctctgtccagagctgcaatccagtcctgcctcccatccaccatgatgatccaaatccttgggttctctattttaaggacactaatcatccttatgttgtatcatctttgttttccataactatggtactattagaatctctctaaataattcatcactttggttttttattagtattttctttgatatctcaagttttcttctatgtcattaatttttatttttaataatatgtattctgtttcttgcagtttataatttattattagctctgtaatggtatgatttggtcctcaatttgttgccttggtctgtgatctcctaaaaggttgtgagaaaaatgacttatgctccttaatttcgttttcttctatgtatattttttcatgatctctccctctctctctttctgtctcttcctctgcatgcagtttcttttccctatatttatgctcaaacttgcatcattcttgtctctagacgttctatttgctgtaataaatgaaattcttctcaatctaaggttagtttgatctcacttctgaactacaatttgaggccaatgtaccacattctatctactcttcagtactctgcaagagattggagtgaggactacagtattagaagatgaacaatctttggtatcatgcttagggtctgctctttcccttaagattctcctacatctgtcactccagaacccacccccacaactggaggcatatctcagttccattgggggatacgctcagcttgtattatttcccaattgtgttccagaatctctacctcttttaaggtgcagatactttttcactcgtttctccacagcaggtgtttccaccattctgttcagaacaataaaaagatcagcttttttttttttttttttttttgagacaggatctcactctgttgcccaggctggagtgcagtggtacaatcagctcactgcaacctctgcctccccggttcaagcgattctcctgcctcagcctccagagtagcggggactacaggcatgtgccactatgcccagctagtttttgtatttttagtagagatggggtttcaccatgttggccaggctggtcttgaattcctgacctcaagcaatctatctgcctcatcctctcaaagggctgggattacatgcctggccaaaaagatcagcattttgattatatttattactttctagaatttaaaatataaattagaaatctcaggtttttgttgactagctggtaagatggttaaggttaggagctgagccatgttgcctctctgctttactccatagtcctcatgttttgttgggaccatgttttgaagtttattgcattatgctgataatgacttttaggggtttttgaaatttttttctaattttgtaggtattatgggagggcaatttagtgtagccttaatgaagttgaataatgcctcctgtacgtagtcctggacttgtattgtctacttgaccaccagtgactcaagaccaagacactttattctgccactggtcaaaccctgagatcatgagagggtgttaaaacagccaactgtggcatgaaaaatgacaaacatgtcctccaaacatatcttgttgcttatgaggggagatattattttaaccctttacatctgtcactaaaaacttacctctttcatggcctgagctccctagaaatcaatgttctaattagaaaacagtagctaatctgcccaaatgctaataaatgagggttgtgatttatctagcaacaggggaacagctcagcattaacaattaaaaggtctgtagaggacagagctttttttccttactcttccccttagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaacctacctacccacaaagaccaaaccacatcatagcctaccaaggcattcttcaatcttcacgataatggatacagatttttaaataatcaatccaactgcaaggagaagtactgatctttaatatagccataatgtttggctaaagcctgctgcactccagtcatttcatgactctataagctaaagtcaaaatttatatcaaaggcatgagtttgcaattagctgagcaaggtcttttagagacccccaaagagttcattttttcctacattgaacaaattaactgtgtggttcataaagttcttcttcactttaacctgactggacacagagttaaagggggaagatagcatgtctaaaccaaattgaatagtgatcttctagacaacactccccagaagggaccctccttgggaaataccactcagtgctagagtaaatctcaaatttcagtgaaggctttgtcattcacagtaaaagatgcttgcacatcttgcatgttttcttctagtattttttttatttcgttcggtattgcctacttacataatacccatgcagagctcctagaaggtcccagagcctgccatattgtttcatgacactacacatttattaaaactgtttccactatgtagatggccttttctggccagtttgcctgtcatctccctctattaggccccccagcatcaccaccaccaccctccaatctaactgataactcccttcctcaggttcccactctacctctacatttttctgtcttaataccagtaatctttacatccacttgattggtttcttgaccatctctctccaggcataaggtcttattcttactcaaatatacatttcctatatgtttgttgactatataagtgattattgaacaactacatagcatccagtctttgctaacacttggtaaaactcagaaagacggagattttttttctttgttcccaatgaattgataaaccagcggggaagacagacttctctacaactagacacagcaagtcaaaaagaggggtctaggcaggtgatgaggctgagttgttagttggtgaggcagcaaacacataaaagctcaccatgttttaatgtctcttctgtgattttcataatcaaaacacacatgcttcaatcatatgtttcacattgcttactaatgtctttgcattataactcagacctgtgcttctaaacgaatgtgcacacaaatcacccagtgatcttgttaaaatgcaaattcttattcaagagttctgggaggggcctgagattctgaattcctaacaagctcccagggaatgccaatattgctgatccatgaatgcctcaagtagcaaggctccacaccattgtaatgtcaatgtaaacattgttgaaatggcaccagtttttggaaaagctcctggactccccacctaaactcttctgactgtaattaaacatgatcaacattacaccaagagaggtagattcagcagtgcccagaaaaaaactggcaagatgccttgaaactgttacctcttggcctttgttttactatgtaaacacaaaaggtctttgctcctgcactttaggtctgctgctacaagatgaatgtagtctgaaggtgtggcaagttttatccagatattcaagattgcctttctctgctaaagtctcttccatatttaaaccataacatcccaggttctttatggaaacagaaataccttctaagaaaactctaaaactttaatctgtttaaacaatcataagaaagaatacttaagtgaattttacaaagggaaaaagaagctctgggccaggcatggtgacttatgcctgtaattccaactctttggaaggctgaggcaggagaatcacttgagcccaggagttcaagactagcctgggcaacatagggagaccctggctctacaaaaaaaataaatttaattagccgagcatacacctgtagtcctagctactcgggagcctgaagtgggaggatcacttgagcctaagagttcgaggctacagtgaaccatgatcgtgccactgcattccagcctgtgtgacagatcgagaccttatcttagaaagaaagagagagagagagagaaaagaaaagaaaaaagaaacaaaaacaaaaaacctctgtaagcatcccatgggaatctattttcttaactcttaatgattccaagacaacatctgttaactttttcaattcattagagtctaccactcaaaatgacaacatctgttaactttttcaagtcggtagagtctaccactcaaaatgaaagtcaaaatccattagaccactaatttctcatttgtgagttttgagttatctttccaccaagacaagttccctacttgagattttatcttttgtaggtcttcttcctctcttccccacatcattcttgagcactaacctagcccaaaccaagtgtcctatgtatgtcttcttccaatccggtaggtgtcacactcctcctatctgccgttcaactttgccttgctataatatgcgatttaacaggcaatcttggttacttggtctcctcttgcgtatttagtttttgcatcttttttttctaacaatgtaatggtaaaccgaacagaagtggaactcttttcactgggcacaacatatagaaggcaatggcagccatagcttgcgccatgcatagcctggagtagacaaacctaaatgaactttcttccttctcacttctcacggactcatttaggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatgtaagtatccaactgagtaatttctttttaatataaaggaaacttcactctaagacattttttctataacctaacaaagagacatagcagcccctgttgacactatagaatttatgggtgagccattctgggatgtagtcaatgcataattaaattgtagtgggccaaatatgctcatagtttctctttgactgcagaatctttatagaaagaatgatagactatatcctgtgtaatccatcacttaacacccgaagaaatagagggttacagtaaaaatatagagaaaaaagccattttcttttcagccaccacattttaaaaaaactaaaacagttaaaactaaaataataaataacaaaagatatatattgcttatttatcattgagaagttgtataaatatgcgtatttatttattattgagaattttataaatatatccacttaatttttatcccagttatggaaggtattatagcaggtggtctcatattcatttttccacatttctcaatgcccctgagcaattagagatcagaacataatgaacaatctttccctctccagtttcccctctggtttttaatccacccaacatccaatctgtagaggaaagcatatgagaacagaattattctcttcagtgtcatgcatcatttttcagaggcatttgcctctctagacccagacgatattacaattaattcagtgaatatttttaaaaatacatttatttcagtatgtcttcatcactggtaatgattttcattcacaagtcatttctacagccttggagaaacattaagctcaagttggggtgtcctttctgcctgctcattaataaagaatttttacctagctaacattttttaaatcaaaaacaaagggaggggttggaggctggagggaggtcatttaaaaaaatgattacaaaacctatttgttttagctcaaagtctcaacagtctaagacttggtgatctaaatttaaaaaaaaaaagtcatgagttttgttttgttttattttcccatagtatcaaacaggataagattattttcttagccatttaaatataacccagggaagaaggaatacatatttcttgggagcaatgaaaatcaaaagtatagtcccctagaagcactggtctctgaagttccagatagaagccggaacttcatggtaggttaaaggttggaggtcatcccatccctcgaggctcccaaaccaagacaaggtaaaagatgcccaacagaggcaaccactcttgtgaaatgattttagaagacagaaaggacccaagttctccccatgcctacaatttcactatcccagtgtaattccttccggctcacaacaagataaaatagtgaacaccttacatccgttcgtgtctttggcataaaaaggttatccaatctatgcctgaaaacaggctttggcggtaaatcaagaaaaggcagaaacacacagtggggaagtcacaacgagagtaaacctgaagatggaaattgggggaaggaggaacaggtgccctaaagtcaagcctcactttcttgaaattatgagtaaggcagagtcttgaccaagtcgtgtctgggataatgtgaattagtgttcagccagaaacagaatgagagtggcaatcgttttattgataagaccctgggtgaacagggctgaaaatcaagaaaggaaaatgggaacgggaggcccgtggcagctgccactgttgtttggggcattaagatcaagtcctttaaggagggggacccttgaatctctaccagactccagtttggacttccaaggttgttctgttgaaggaggtgggtagtctttggttaaaaatgctaaactattctgaaggagaaaataaaaaggcaagccaagtcattaatcttaaaattgtcagctgaattattttcaatgagccctgatgtctggtgtcctgggaggcagggagggcatttggattaagtttaatcagtaggtacatatggcaagaaaggtattcagataatttgttatctattaaaatgaactaaaatgaatctgtggtgtcacccaccaatgcatgtcacaggagcaaattctggccaagacagcaaattccaccaaggacctactctgtaaattcctaacttcctattagtgggtttttaaaattgtattttcgggaacatagtcccattcatgggactaaaataatactacgttgatgatcaaacgcttagaaacgaaacaattagaaccctgttgggattctactctagttggcttcacctgacaccagctgcaattctgaaggatcacacagcaagatttctctctaccgcccccatggggttgaatgaccacccttttccagcatggaacatttgagaataacatgtccaaagggcttttcatgttgggtcaggaagaaagtcccctacaagaagggttttttcactctgtgtttattaaatgctggtgatgtgtttagctgtggtctgtcctttcctgtagttttacgatgccttggaataccagcaagaattgttaccaattatttctctgcccatgataatgatgccaatttgcaaatggacatcttcctggaagaagatgggaacgtgaattccaaactcaccaaggattcagtgtggtgagtttgattgacaatggcattggctgatgtcacattatagtaatgttacacatttaccacaagatagactcaatctgatgtttctgttctattttgaggaccattcaacagcacaggcagaaaactctgattgtcaaagaatgttctagcaaatgattagaaatgttactgaagagacagtttgggttcctagtgataaaaatcaatcattccttataatagcaaccaccaaaaaaaggtcatagttttagctgctgcatatgcctatactagttcctctctaccttgatatattaatattacagttaatagcagaagtattggagccaagcgttctctgggtcagtgccctgggactaatagagctaacatttatttagtatttactatgcatcggtcttggtgtatgcatgatcttatccagttctttttagttgtatcaggtggatgttattaatatcgccatttacaaatgaggaaactgaggcccaaaaaggcttgctcacggtcatacatctgttgagctgggaataaacccaaatgcttctgaccattaaccacaaccttttaaatgacttcagcagtataggttttcttttcgaatgtaaagatgagattctccttgattatattgtcacctttcattgagatatagaaatgggagtaaagctgaaattgttccccaaaaccagctgtggggttctctcactgccctgaacagctttgttacaagctggctagagggaacttaagatcccagggaaattccatttttccttgagaccccctaagtccaaatcaatacactaagaagaaacgaaaaaaatcctaagagtttaagtaggaagaatttttatcaaggtctgtgtgggaggaaattggggcataagttcctctgtggtcaggcattgagctaggtagaacttctaagccaaaaatgagtctcatgcacaaataataaagctaaaacactttctgttatacaagcatccaaatggggatggtaggaagttacaagttcattttaagcaaaactaaaagttagaagtgcctgaacttcatgttacaggaatggatcacagttgtagcagcagtattaactcaccagtaggggcacacattcattggagaatgttgaaatgaaattgctgaatgagtagcaaagtgctaccatgaattaaaaatagttcggttcattggaagggaatgagctgagccatagtaagctggagggcacgtgtaagacaaaaccttgtctctgtaaattgaacagaaatttaaagaacactttaagcctgcagaattataatatagcagccctgcatgtatatgggatgacaaaacagaccaaaatagtcaccccaaaaactcattgcaattgttaaaaatgacaaaaagatagttatttggcattctccatatctcttccttaaaaacacacagacacacacacacacacacagacagacacacagacacacacacacagcctttgtagctaagtgcagttcaaagttatctttcccagctccttgattcaggtacctcccatcatcaaataagtccctatgaggcactcctacaaataaccccacaggccctaaacagagttaatacaaaatagcgaaggtagatcttgcccttggtaaccctgtcctcattcaggtccctgctccaaattacttccccttttcctgacaccatttgttcctttggtgccttactcaaatatcccatcaccctgagactgttcttcctggcctgggaccctcacccaccctccactgcagaccactgcccgagactcctcttcccttcctttgcctggcttgtagtaggttttcaacgcatgatgcctgatcagatgctctgactgactgcggggctgagaccagcacaactcaggacgtgcccagaccatgaagcacagggattaaagggctcagtgggatctgaggccaagacttggctctgctactgcccaagctgtgtgactttgggcaaggcacaacctctctgtgcctcttttctcctctaaagtggagagaacaatattccctgcttcactcatcacagagccgagcataacaggtgcctaatgaacgttagctgctattattgccttcattattagtcacacagctggaatttcttagaggcaatatgtttccatcaacccaagtacatcaaagcggtcagaaaaagagggatgcccagtgtcctaagatgactgtgctatttctgttactttggggtatttttaaagaaaaagcagacacttggcctcaccagtgcaaacacccatgcaccttagaagttataggtggtccaggaaaacaagagtatggctaagactctcctggattgaggaggttagtgcgggctgtccccagacagatcagccagtgcatgatcaccacagccacactcctatgtcaagctctggcttgggcagctacttgctgtgtggctttgagaaaatgacttcacctctctgagcttcattttcttcatcagtagaatgaaagtaatcttagtagttaccatttcccgatggagtgactataatgattaaatcaggtcatccaggtagagtgcttaccatagaggtaggcctgatgctgatttaattattattggtcactggtaagaagcaggggctgcctgagcatagggctggtgaggaagggtgagggtgagggtgagggtggaggctaaacaggggctgaggtgggggtgggaatgatttgctgggcatcagctgacctctgtgaggtcagtgcggtgtagactggcgacacatggcctgatggatttcctagcaaggatctcaggagctattggcctcatacttacctccctccacaggctctggtcaaacacacccacctcaacctgtcttccccgctcctggttggtttgtggctggggcccctctcctctccaagtaaaggagacctgagaacaatctctcatcctccaccatctatttcttcttcaacactcaggtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggctggggactcaggaacctcagaagggcagagcagggcagagtaattagatcccagggtagcaaatgaaaccccaagtgggcaaatgcaaagtagcagatcccagaaggagcaatttcggccgcctgtccccagcgtgctgatgagttctgaattatgtgtaacctctggggggaaggcagctatgaatcactggacagtttaatgaagacgcttgctcaatgtttagctgcagtccaaacagcaaatagaatacgagggctcagtgaggagggagtcagggctactcagaggggcagggggacagcaatggtttggcctcaccttggaagagctcagcttgatcacctcattatacaaaggtcacagtcaaaatggaaacaattttaaaagacagagacgttggcacttactaggatcaagaaagatttttcaatgaaaggcttcgctccttctaaatgaagaagcctccctgtgttcttttgctggagagagtgtggtctgataggatgattctgggtgagggttggtgtcctcctctcagcttttccccaccggaatgcacccacccacagggggagcagtgtctgatctattttatttttgttgttttgtcagcatgtaacagtgtgcagggcatagagcaagcactgaataaacagaattgcttggaaaaaatttttaatgcataaaaactccatgctgcaatgggtggtcttaatctataaacaaacctttttcaaagcacattttagagcagaaattaaccagctttcacacctgggacactgccctaatcagtgtataatcctaattctcattatgtcctcagtactcatatggtgtttcacacattgtaggtgcatttttgaaattgagattgttcttctatacattattttatttttatttttatttatttttattattatactttaagttttagggtacatgtgcacaacgtgcaggttagtaacatatgtatacatgtgccatgctggtgcgctgcacccactaactcgtcatccagcattaggtatatctcccagtgctatccctcccccctccccccaccccacaacaggccgcagagtgttatgttccccttcctgtgtccatatgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtgaatagtgccgcaataaacatatgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtgccaccaatagtgtaaaagtgttcctatttctccacatcctctccagcacctgttgtttcctgactttttaatgattgccattctaactggtgtgagatggtatctcattgtggttttgttttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttccccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatcctgttttggttactgtagccttgtagtatagtttgaagtcaggtagtgtgatgcctccagctttgttcttttggcttaggattgacttggcgatgcaggctctcttttggttccatatgaactttcaggtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttccgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctacccggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccctgagattctggtatgttgtgtctttgttcttgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagacatagtttgttataatttctgttcttttacatttgctgaggagggcttttcttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattcggggttgaaaattctttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcgtctcgaggagtatctttgtggtgttctctgtatttcctgaatctgaacgttggcctgccttgctagattggggaaattctcctggatagtatcctgcagagtgttttccaacttggttccattctccccgtcactttcaggtacaccaatcagacgtagatttggtcttttcacatagtcccatatttcttggaggcttttctggtttctttttattcttttttctctaaacttcccttctcacttcatttcattcatttcatcttccatcgctgataccctttcttccagttgatcgcatcggctcctgaggcttctgcattcttcacttagttctcgagccttgcttttcagctccatcagctcctttaagcacttctctgtattggttattctagttatacattcttctaaatttttttcaaagttttcaacttctttgcctttggtttgaatgtcctcccgtagctcggagcaatttgattgtctgaagccttcttctctcagctcgtcaaagttattctccatccagctttgttcctttgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgtcagttttccttctaacagacaggaccctcagctgcagatctgttggagtacccggccgtgtgaggtgtcagtgtgcccctgctggggggtgcctcccagttaggctgcttgggggtcaggggtcagggacccacttgaggaggcagtctgccccttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggccgctttgtttacctaagcaaacctgggcaatggcgggcgcccctccgccagccttgctgctgctttgctgtttgatctcagactgctgtgctagcaatcagcgagactccgtgggcataggaccctccgagccaggtgcgggatataatctcctggtgtgccgttttttaagcccgtcagaaaagcgcagtatttgggtgggagtgacccgattttccaggtgctgtctgtcacccctttctttgactcgggaagggaactccctgaccccttgcgcttcccgagtgaggcaatgcctcaccctgctttggctcgcgcatggtgcgcgcacccactaacctgcgcccactgtctggcactccctagtgagatgaacccggtacctcagatggaaatgcagaaatcacccgtcttctgtgtcactcacgctgggagctgtagactggagctgttcctattcggccatcttggctcctccccctaattattgtcacttctatacattattttagatgctgtgtatgactcatctagttggacttttatattgtaaaattatcttcaattttaatcactgtctgcaaagcagaatgatctaaaaacgaattccaagtaaaatagtagagaagaaaaattcagaatgtagaccaaattgcttaaagatgcttaagggtttgtaaaaatatcccatgatgcattgcagttgccaattctggacagttatcagagatgcttattttcaaacattttcttgttaaccatatttctggccaagttggttttaggaaaatcacctggagttagaccatgagccttagcattagaggactgagaatatacactgaaggcacacaatagtgttggaaaaaacattatttgccaccttcaaagaataagagtagctcatgttcacaaaaatacttttttttgcaatgccctgatttaagtgctgacatgtattaatttacttctacctcttaacagcatgttaaggtaattactgttagtggcacggtaacttaaccaaggtcccagccaataagtggcagaacctgaattacaaacccaagggggctgaccccagagcccactctttttaaaatgacatccttattgactgggcgtggtggctcacacctataatcccagcactttgggaggccgatgcaggaggatcacttgagatcaggagtttgagaacagcctgaccaacacggtgataacctgtctctactaaaaatacaaaaaaattagctgggcgtggtggtgcatgcctgtaatccccgctacttgggaggctgaggcaggagaatcacttgaacctgggagacagaggttgcagtaagccaagatcatgccactgtattcctctagcctgggtgacagagtgagacttggtctcaaaaataaataaataaaaataattaacatccttattaaaatatgcttcacggcctggtgaggtggctcacacctgtaatcccagcaatttaggaggctgaggcaggtggatcacaaggtcaggagatcaagaccatcctggctaacacagtaaaaatcccgtctctactaaaaatacagaaaaattagccaggcattgcaggctaactgtggcaggtgcctgtagtcccacattgcaggctaactgtggcaggtgcctgtagtcccagctactctggaggctgaggcaggagaatggcatgaacctgggaggtggagctttcagtgagccgagatcgtgccactgcacttcagcctgggcgacagagcaagactgcctctaaaaaaaaaaaagaaatatatatatatatatatatatatcacatgctacaaaatttacaaaattcactcctttaaagtaaagtacacaattcaataatttttagtatatttttatttatgtattattattattattttgagacaggttgtctctcacccaagctggattgcaatggcaagatcatgactcactgcagccttgacctcccaggctcaagcaatcttcccatctcagcttccctagtagctgggactacaggcacacccaccacacctggctaatttttaattttttttttttgtagagacaagatctcactatgttgcccaggctgctcttgaactcctggcctcaagagattctcctgcctcagcctcccagagtgctgggattacaggcatgagccacggcactaggccatttttagtatatttgtggtcttgtataaccatcattatcatcagattccagaacattttctctcccctctgccatacctattagcagtcactccccatttctccaactctggcaacctcgaatctactttctctctctatggatttgccagttctgatcatttcctataagtggagtcatgtaatatgtgaccttttgtgtctggcttccttcacttagcgtaacgtgttcaaggttcgtccgtgttgtagcatgtatcagtacctcattccctttcattgatgaatgatatttcattgtgtggataaaccaggttttatttatccattcatcagttgtacatttgggttgtttccatttttggctttcatgaataatgttgtaatgaacattcaggtaaaagtttttatgtgaacatatgttttttatttctcatgggcatatatttagagtggaatttctgggttgtatggtaactctatgtttaatttcttttgatgaagtgccaaactgttttccaaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtgtttttcttggccctgtgtatatcttctttggcaaaatggttattcatatttttgtcccattttaaaattgacctacttttgtattgttgaattgtaactattctttatatgttctgcatataagctctctatcatatatgtgatttgtaaatattttctaccatccatgggctctcttttcactttcttaatggtgttctttgaagcactaaagaaattaatttttataaaatccaactttttaattatttctttggatgcttatacatttggtgtcatatctaagaaaccataacttgatccaaggtcacaaagatttgctcctctgttttgttctaagtgttttacaatcatagatcttacatctaggtctgggattcattttgagttaactttttatgtatgtatgaagtataaatagaaatggagaagagagaaaaataagagagcgaataagagagaaaactaaaatcatcttattgattatctcttgtacatggtaaattatttttttaatgttgtcttaaagattctttgtttcactcaggtctgagatttgaaaaagaaaaaaagtaaaaaagagattctctatttgtcttcagcttttgacagtttgaatatgatgtgtctaagtgtagatatcttaagtttatcctacttggagtttttgaactttttcaatgtacataataatatctttcattgaatttgggaaatttttggctatcgtttcttcaaatattctttctgctacttgctctctttcctcttcttctgggactcccattaggaaaatgttaatatacttcatcaactgcataagtaacatctcacctgtttctggggctttgattttgttttagttttttgcttctgttattcaaattggataatttcaattggcctaccttcaagttcattgattcttctttctgcctgcttaactctactgttgaaactagtgaatttttcattttggttattgtacttttcagttccagaatttctatttggttccttttcataatttctatcttttcattcgtattctctatttgatgagatataattctcatggtttcccttcagttctttgaacatatttataatggctaatttaagatctttgtcttgtaagtccaatgtcttagctttcttaataccaatttctcttggctgcttcctgtgtatgggctatacttttctgatcctttctgtgtcttataatttttgttgaaaactgaacatttaaaataatataatgtggcaattcttaaaatcagatttcctgttctctagcacctattgttgatgtttgctgttgttgttgtttttgctgctgctgctcgtttatttagtgaccttcttggactaattctatgaagtctgtttttcttgtcatgtatggccactgaagtgagctgagttagcttagtggtcatataacaattggacagagatttccttaaataccttgggccaaaagctccccagctttagccaagtagcgttgtgtgtgtgttggggaaagtctttaattaacccgcaggcagtttaaaattcttcattagccttcacttcctgtgtggacagagcctcaagatcaaccagagatgagagatgaggaccttcctggggcttttcttttgggcatgctcacagccctgcacatgtttgtggctatctatgtcagagtttttcaaagcctcctatggacatcttattccctgttttttctttcaaagtgttttggatagcccttttttagtctcaagtggtattgccccttcaggcattatgatgttaaacatttgcttctattttatttttatacattatatgaatagggctgattcagaatgagctgtgaatcagatcaaataaaaacaagccctgagaatggagcttttcagagagctgccaggcaagttaagcagtggcaatttggagagaaagagctttcggagtgttcaaaactcattttctctccttcattggtttctaggctgcaagtttgcaaagctactgaggctactggtttttaagactactgtggaggtggggtgagaataaggcaaattaaaactccacaaagtcactcttcttactgagatttatgtttgtttgtttttttccttgaataaatgcccctcagattgttgtttgcttcacttccagagttctggaaaggtcagctgtgatcatatttgcaagtgttctcattgctctatggaggagcagatttccagtagtccttactctgccactctggaggtgtttcccagagcccactcttaaccactacacaagtgcttcctaccacactgctaaggtgctttacattttgtaagaatatttttggcatctagtagagtcttcctgacatatatctgctgaaacacatattattgtatgtatatccttttatttctccatttctcccatacattacggggcatgatattgatcttttagaaaattatgtatgtagaaagccatctatggatttagtttcagcctaatgaaggaatgtaaaaaatatttgcttaaaaacaagaagggggcattgctctttgaaggttggaaatcactgccctacactctcctcccgttcctctcaggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaacactccatatggcaatggaatcatgttctggttaatcataatttttgcctacaagagtcatcatatataccgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcagagggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaaaaataataaaacacgtaatcacaccatggggaaaaatgaaaggagaagaaaaaaagaaagctggataatcagcccctaattttctaaaaattgctattaacaaagctgctttacaattctcttgataaatatccaagaaatctgttcttggaagcttaagaagagagtggaaaggctgtactctcaggactaaggaaggactcactccctaaagactttgtggatggaaatttgttcagtactcctgtagtgtgtatgtgagtgaggacatctggactggtatctagccaggatgccctggtagaactgcatttagcgttgatgtcctttccgatgggttgcaacatccatttggttcatgcctgtgtctgagcacttattaatggttttgactatcactcctactacacatacacctcatagtttaatggtggaagctacagcacctgtccaagtgcaccccgccatctgcaaccccctccattgaggtctcttgtgctatatcagactgtatttacacgtgacttctcagtgagacttgcaaaaccccttgccttcacaggacaagtaagaataaacacattcatttcttcttttttcttggcggtcagttgattcctacaacagcatcctttactgagctgggatgcccatggcgccctccatttatctcccatatagcattgctatgcaaatgaggccattcatgactggctacccagggcttccccaggtggctcccagccagagggatctgaagcagctgagcctcagagaggacaggggccctggcctagtctccacctgactggactgctggcctttgacatgacgccagttaacatccaaatgccccttgctggtttcagcactccaacaggctcaaacaatgaatagctgtattctgaaatagtgtcatgctcgcagctccatcaaagattcctgcagcatgcctctttcctctgaataattcctttctgtcatcttccttcattatatttcctaacaagtttttttctaagtccaggctttcatttccactttgaaatgtcttgttagacaagcctcagagtccaccaaattgttcccacttctttccaacaactcccaccccatcctatccccactgcccctgaaatggccagagcttaataatccaggatgtcctgtcattattgtcaacaatattgttgtctgtattcggaatgtattagcagaaccagagaggtagggctacacccatctgctacaaatacacaaatgatttgcaagatagacagtgcctttctttcaccccctgccagttttgctatgaaagaattcaaacccttggtttacagttgaagttggtccaagacatctcctccagggctttctcttgatcttatttgtgctctcccctgagccctaataaagctgcacaaacaaaattacaagcccatatctctttcttcccttttaagaactccttttctctgaaacatttctggacagatagattgtaaatgagatgaccctgtggactgtttaagcagttagttagccaagttaaggtcagtaaaggactccttgtttaaattaaccactttattttcttcaaacacatagcaccctgaagcccatgttggtctcagctgtgttctctgtccagctcttcaccaccccataggctcctatacctctggatatgaccttagccagaaccaagacagattttgaactactgtgctctactgggttttggtaaaataaatacataaataaataaatagtcctcagtgtttcggagggaacctaatacatgtttattatgcagtattttaaatgttgcagaaaaaataccaaagtaagaagtatctattttctaactactcagaacatctgtaacatttccttaacccttctgtaatatgtctctttgtgtgtcgtatgcatgtttttaatgctgcataccaaagtaccaaagtaccacaacgtaacagcttaaaaaaacacaacttatcatcagacaattcctgtgggtcaggagtttggtcactggttgactgggtctctctgctcagggtctcagataactgcaatcgatcagtgttggctgggactgttgtcccatctaatgctcagagtcctcttccaaattcattgaggttcttgaaagaattcagttccttgcagctgtagaactcatagatgcttctatcttctttgaagccagcaggagaatgtctctgctgctttgaatccctgacttgctctgtctctgatctctagacccagacttaaaaggctcatctgatgaggccagacccacctgataatctaccttttaattaactcaaagtcaacagattagtaaacttaattacttctgcaaaatcctccttgacacataaagcaacatagtcacaggagtactagcctgttctgtttatagatttcacctacactcaggggagaaaattatacaaaattatgcaaaaggtagtgggagtcatttaaaattctgctctgcatgtgattttgaaacactaatatgccatggatgtctttcttgcctagtcaatatagatctgcatttttatggctgaatagcattctattctgtttcaaaatacttgatcacatgttggacagttaggctgcttccatgcttccactttccctttcttacaccatgatgaacattcttacataacacacttgtctttgcatttgtatgattatttcccgtgtacaaattcaaagcacatggatttactgaatcacaacataaactatgacgtcccatgtagggtcccccagcaggggatggtgctgctgttctagtgaagtactgcctttggtgaaggttctctgagtcctttgtaccaatactgctgaattattagcatccttgaaaggagttctaaaaattactagctgtcactgcacggaacacacaggaagaaacataaagcagagatgtgttcttcacttgtcatctccatcgttatcctcccaaaggttgttctcatcttgattaaacaagtctcaatgaaatgaggcctttattttgatttctatactgcttctatagaaagaggcaacaaggagatttagaatttttttactttaaagggacacggtaccttttgactgtatagtgagaacttaagtttcaaatgaaggctccgagaacataaaaaaccatgaatcttaaagagaaacaaacaagcaaaggtttaataagaacttccttgctagatgtcctcatgatttatttagccaacacttactgagcacctcctaatgactgggccctgctctagtgctggagatgtgtagaagaataagaccaacagagctcccaaagtagatttatgcactctacaaatgcatgatggaattgcaagatgaaaacagaaaaactcttatggatctagataaagaagctttagaataaaaagtagcatttcaggaatcagttggtattttccaacctggagaatcagtagatgaaattaggaaaagtctgtacggaaggaataagtgtttgagatcaaatatacaacatgttggctatagttaattatactatactatatatttcaaaattgccaggagagtaaatttcaaatgtttgcaccacaaaaataaatatgggaggtaatcgatatgttattaacttaattatcctgcaatgtgatttgattttatatatatatgtaaaatcatcactttgtaccctataatatatacaattatacaattattatgtgtctatttaaaaaattaaagatatgctaaaggaagttttccaacacaaagggaaatgacactactgtatattgaaaattagatcctctgacacgtatgaattgcagcaaaaatgctaaatatctgagaaaaatgctcacgcctgtaatcccagcactttaaaagactggggcaggaggatggcttgaggccaggagttcaataccagcctgggcaacatgagaccctgtctcaagaaaacaaaacaaaacaaaacaaaaaacaggaaaataaatgtctgtaaacattagcctctttcatggaggaacttgggatataaaaaactgagcatgcttaaatagaattgtgtaatgtcagccaaatggaaactcttgaggcacgggtggcttaggacacaattcccctagtcattcctgagtagagaggattgcatggtgaaagagatccccatggctgtggaggtagcaccctctcgttctcttcatgggctgtctgggagctgagccattagctttccacccattgatggaggcccagccctactgggagcatttgcttcctccccacctcacccactgcctgcaagttcctgaccctgttatgaaactcccaccctaaatacacagataacgtctcagccatgagtgaaactagaagagatcatgtgtaactaattagatgtcagagtgagagaaaagaaacttttccccgggtcctggtcatttgaaaagaaatattatcctcaaagaaaagtctttacttgagatctgaagtgcaaagcatatttatcttgttccaggctaaccttgccaaggatatttgaatttaaataaggctattctggagcctattaatctagggtgatggtgtagcagtgaaagccagggggtcactaaacacttcgggtcgtataggaagcaggacggcgtccattcagggttgcaaatgttttattgctgtttttccctgggtccttctgcctgatggggcaaccttcactgctctggagagaggctagcagagtcattgtctaacatacacagtgacctcccttccagcttccaagcaaagatggaggctctcaggtgggaactgacctcatgttcctgctcagagacctccacaccttcaccctaatccacatctgtacccttctctccctgcagaccctgccttgcttcccacatctgtccagggtgttgctctcagcctcatcctcttgcaaccttggtatttcagctcccttttatattcccactgtctctaccttcctccattcctccatgaacatgcctcagtctcttttaatttgaaaataaccgaaacagacttccctgcattgcattacatgctagcccctgccctatcttttcttctgtcttacaacctagatcacttttttttttttttttttagacagggtctcactctgtcttccaggatggagtgcagtggtgcaatcatggctcactgcagccttgatctcccgggctcaagtgatcctcccactcagcccctcaagtagctgagactacaggtcagctaacttctttaactttaatagagacagggtttcgccatgttgcccaggatggcctcaaactcctgggctcaagcagttctcctgcctcggcctcctaaaatgctgggattactggtgtgagccactgtagccagcctctaagtcactcttaaggaagaagctacctctttcttccctcctcattcatttgtcagctggctttgcccagccctcctccaccacccaccaatactcccgcaacctcctcctccgcttcatccaatccagagcatcacaagtgtagacaaaaatgcctcttaggcctcacctcctgggtttcccacaggcactcaagctcatcctgcccagaattgggctggtcatccacccatcaccaccagtcccaacacagactttcttctcttccttttttattcacagtcttggtaaacaaaaccatcatactacttggacaggcaaaagtcttccccaactcatccgagtccctcacatctccctaaacctgtgggttgtatccccaatggcttctctccctctccatggtgctggccacctgaatgcctttctggtccactattgcagttcttcaggggtgggggacagccggggaggactcagctcaatctccagccttgcctctccatccatcttccacgaacagagatttgcaaatttagatcttcttcttaaattattccaatggctttttatagcctaagaataaagcatgaatgtttaatttgatatcaaaggatttcacaatcttatccttacctatatcataggtcagtgttgaagagtgtggatttcagagctctatcactaactagctgtgacctcagcaaggttcttaaccttcctgggtttcagcttcctcccctgtaaactgggggtaattataatagtactgttctttttttttttttctgagatggagtctcgctctgtcgaccaggctggagtgcggtggggtgatctcagctcactactgcaagctccgcctcccgggttcacgccattctcctgcctcagcctcccgagtagctgggactacaggtgcccgccaccacgcccagctaatttttttgtatttttagtagagacggggtttcaccgtgttaaccaggatggtctcgatctcctgacctcgtgatctgcccgcctcggcctcccaaagtgctgggattacaggcgtgagccactgcgcccgaccaatagtactgttcttatagggtgctagggacatcagatgtgttaacatccatgagggttttagaacaccacttcgcactaaggaagtgttatatgtatttgttagtttcgtgcattgcctgccatcaccgttctcctatgaacctgaatgttcaaacacgctatgctccagccacaacacacagcagacagttccacaaacaaaccatgatggctatttcatgccgctgtaactttgttcttcctccttttcttgacctcctaaattcccatttatctttcgagcctcagctcaaacatcacttcccaaatacctggagactttgctccactgagactccatggcaccccaaatcaacacccgttttaccagggatcatttaaattaattatttttcaaagcctgagagttaccatttttgagcacttaacacatgccagtctgtgttcgaaatacatgtattagcttatttaagtctcacagcaaacctatgacagttttgataattggtttacaggtttgtcatttctcctagaagattaccctttatgggtaagaatctatgttttgatcatctctgagtctccagcacctaccaaggtgcctggtgtgtagtgggtacatagtgaaattaatatctcttgaaccaatcaaaaatgggctgcactcagagaaagatgggagcatgggcaaacagctgacattgaagggcgtctaggcacggaacccgtggtagttgaacctgaaattcatcagtgtcataaacaaagactgctgtaactacctcaccacattattaaatctttctttattactatatgaacattttctatagtgctgaggggttaatgtgctctcatttgattctgtactgtcatataatttcaggtcttttcaaggacataataatacaattcatgatggcattttattccatgctcttgcttccagggtcatattcaaatttctgagaagttttccatgacccttagcacttttaataaagggtaaagagagattcaccctgacaacgtattcttcttgttggacacgagatggaaattgtagagaattatagtcaggcataattgttgtagtttctacagtaatagtctaagaccacaaacacaagtattttttgcttaattgctacaaaggaatatgctttttctaaataggaactatattaaaaagttcaaaataaatatttcagttttggttaacttttcttccccaccctgtcggtacctagtaagttgtttcgttagtcagcagaaaatggttaagattaaaactgttcaatgcactgattcaaatatctttgggtggccttgaagctgctcttagcagagggaaagagacatccagccatgtgagtgtcctgagggatgccaatgagaatgaatctgcccagaaaacccaagtctagagccccaggatatctccaggagccctcagatttggcttaatccattctaataatctgtagatagcatatgcacaggatttggggtcacttttttttttttttgagatggagtctccctctgtcaccaggctgaagtgcagtggcacaatctcagctcactgtaacctccatatcccagattcaagcgattctcctgcctcagcctcccaagtagctggaactacaggcacccgccaccacacccagctaatttttgtatttttagtagagacagggtttcatcatgttggcaaggctggtcttgatgtcttgaccttgtgactcacctgccttggcctcccaaattgctgggattacaggcatgagccactgtgcctggccgtcacttcttgatctcttggagcattgggtgtgatgggaagtttaacctttctgggcttgtgttttctaaggaactaccactgctggaatgaagcatggatgacaaggcctgaccttcctgttggatttggaggctggcaagctgtggacagcaccccccaggaaaatagcgatggtaaaactgtgtcctccctctgggaacttgcttcattgctgatctttgttttgcttttatgcttgcatttgatgtgtgggaaccacgcccattgggaggcaacatctgaagtgtgcttcctgggcacatgtacagtattagctaccttccaatcaggtttaatttcatttccattgtcagctttaccctgattattttacagattttagagaaagaatataaaacaacgtataattcatccattcttgctttgctaagcagttttgaagacaggagagaaaatatctgtaagcatttttactaggctataaaatatacttcagccctttgtggtatgcactggtaagatataaggcaggagagaaaatagagaactcgaaaaataattatagatcatcctttaaattgtttttccagaacctggcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccctctgacttcctaaatgcatggtgggcatggccaaaatgcacaggcaatgtccaaattctccagttaaacttgacatatgttcataatgtccaaaaacaaaagacaaaaagcaaaacaaacagcaacagcagcacaaccacagagcacacatcaacatttccaacatttcagataccacctgaacaagagataaatgctgtgtaagccacctgcttggcatcaacacatctgggtatgtgtctgtaggtggcagagtagatgcaggaatagtgttgccttgtatttatttccatggcttcaatttttggcttgagggggcatagccaatggaattctcttcagccttggaaagcatctgggctaaatcagcaatgaagttgggaacactggtctttacagagtcaccctcagtgccatgaatcttgcagtatctggacagaattggagatgacaaactcacaccgcccttcctctgtgcaatgcaggcatgtatcggtgtggccccgcctcggttcaagccatcaagcacggccatgtctgcttccaatttgatgcaccttttgtttttgcagaggtaagcaggaagctggaggaaagtgctgtttttctccccaacctcttaacacatgaaagagtaagctaaaagttgttgtttctaagttttccaggtacatagcgtatgcttcgtgttgacaaaggtaactaggcattattccaacttccaggctattaatgctaaatgcagttcttgtttaacatttttctttccttgatgttttgggattccctactcccaaaagtaaatgctttactaacattagcttagttctctgcacccattaagtatcaactgctccagagaaattatatgactaatggatctctcaactaacctcattggaagagatgggtcatgaattgaaatttcaggacatgccacttccctctgggactagtccagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgggcaaaggctctgccatttcagaagaactaggcagggactggaagcagaacaggctgttaaaggatactcaaggagagctctgaaaatcaaattaaatgtaagagatgttgggtaaacgagaaggctgggctgccggcctaggaagacttgaaagactgagaggcaggacttccccagggtatatttgcaccagtaaatacactgaaataatgtctttcactttgcctaccattggatgctcttagcaaccttctaaaattgataattcttcccattttacagaaaataaaatcgaggcaaagagtgattaagtgactttctcacaaccatctagctaataaatagcagtgctaagatttgaagccaggcagatacctgaatgcatactggtaaccattgcactctagtactccaggaggaacaaatagttattattaatgtacaccaggcattgtactggggggaattctaaggttcaagtctttaagaaacgtatttctagatgccaggtgacagggcacaaacacactgaacatgaaataacaacaatacttgtcaggtgggccatgtagagagcacagatctgcattcatatgatgcatgagttgggaagtagaggccaagaactgaagcaggatggcaaagaccacaagacaccatctaggaaggaagggcgacctgggaacagacagtgaggatgcctgtggaagtgtccccaggtagtaagagcagagaactgtgggaccacatgggaaggagggatgattaggcaaaatgattagaaagaagccagaggaagggaggagtgcaaagcagggggatgagttgagcatctgaaagctttgtgggggcagttgaaagctgtgcagactcactagaacgccaaggatgcatcaggggtgttggaaggtggaggctgaaggaacgcagtgcagaggacctccctgagagacttgctccttgtccctcctgtaagtgagggagagttttcactgggtgggaacttgggcaaggtgctgacagccttgtggaacacggattggaggggttgttatgaagttgtggggaacatctagagggctggtcatccctccaagccagagatggaaagggcatgagctagacaaatggcaataatgaggaaaagaggaggcaggactgagaaatgttaatatttagaaagcaaaacgaacatcaaaattcagacagcaagatcaggaatttgaaacacacaaaagaccagtgttcatctcatcgtacctgccgtggcagtttacagaagcctttggagaccaagcttactggacttggaattttatcccctcgttttcactttgggatttgaagatttccacaaacctcccagctgtcatttgatagtttatgatgctacgagagcccctaatgaggagatcactctgaaatccacaaagccttgttttcagctttttattacactttattgctgcaaagaaggagaaggaggacctccctccacaagcaagctgcctaatagctgtaaatgcaaacactttttgctattattaaatatagatcggggtgttatgaatgtcatcaggatttgcagattataattactcctttctcacccactgcagaggcgtgtctgacagagggtacaatttgttgctttggcatgggctgcgctccaggggctgagccatttttaagagatgtttgagttgatgaaaagtgtatgaggaatcttttctcaagggtgcctgcagtgggaccccatggggagtgtcatatgagtcgatatgactcaggttcgagtctgtggctctctctgctctccctcgtccttgctgcatcagctcgccttctcttccctcccagcatgctgactttcttggtcattccttactcatttccaggcttgatcaagcatcatgttcattgactgttttttagtgttcccagggccttagtctccatgagtgaaagcagagcctaaaaagaagaggggtatgcctggaaaatgtcttaccttctgttccttttttctctcctcctccactttggaagttcaccctccacatttctgggtttctgccagggcttgaagcttatttctcttacccctcccttcccatgtcctccctgctgcagtgggttcctgtggatctgaagccccatctgcctatctccccagcttatggtggcctagggcttccaaataggtgagaggagatgagagctgttctaagcgtctggagtcgtattccaagattccatgttcacgaagccctcaggggttcttagtgaagaactctctccttcttgccaaagataactctcttctgtcctaacttctcattaactctgctgccctctttcacaccactccaccccaaactcactcacatacacacacacatgcatgcacacactcctgcctgccctcactggcgctgagatgattttgacaggagcaataactggctccctgggaccacagcaaccatctcatcactcaagaagctaagccctcctctgctgtgggccagcagttctcttatacaacgtgtggagatgttttcctgtagattattcattctcaattcaaacttatttattttgctactatcttatcagatgcagcctatttttttggcatctcctacttggctataaaataatccagtcatttattcaaatagcatacaaaactttggaattattttagctttccttcttaacctcccttatgcatcttgccaaaaataccttcccaaaattatcataaatccagccacttctacaatctctatcgttaccctctgagctctgtacaacactgagctccataaagttacctcctaactcctcctaactcatctccctgatccccctcttgctccttttctgtctattccccacagagcaagagaattattctttaaatgtaaatacaaacatcacactcctgccccaacccttctggtggagttccaccacccttacaataaaactgaacataaattcctacaagattccatggcttcccttccacttcatcccttgtttatttccctccagccatactgagatttttctcttcagaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactgcacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagaggcaagggtgtggtgttgtgaaaaaaatatccaatttcatgcaccaatgcccagattttgtgtgatgataacccttcaagtgtagggatagaaaaaggggatcactaacattacattcaaaagaaggaagaaaaattagccgtaaatgtagggctttcacaagtagtaccaatctatccaccagcccgacaaggaaggtaggctcagagagattcagtaactcggagggaggagccaagatggctgaataggaacagctccagtctacagctcccagcatgagtgacgcagaagactggtgatttctgcatttccatctgaggtaccgggttcatctcactagggagtgccagacagtgggcacaggtcagtgggtgcacgcaccgtgcgcgagccaaagcagggtgaggcattgcctcactcgggaagcacaaggggtcagggagttccctttcctagtcaaagaaaggggtgacggatggcacctggaaaatcgggtcactcacacccaaatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcactggttctcccagcatgcagctggagatctgagaaggggcagactgcctcctcaagtgggtccctgacccctgacccccgagcagcctaactgggaggcaccccccagcaggggaacactgacaccttacacagcagggtattccaacagacctgcagctgagggtcctgtctgttagaaggaaaactaacaaacagaaaggacatccacaccaaaaacccatctgtacatcaccatcatcaaagaccaaaagtagataaaaccacaaggatggggaaaaaacagagcagaaaaactggaaactctagaaagaagagcgcctctcctcctccaaaggaacgcagttcctcaccagcaaaggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcaagacctacgtgaagaatgcagaagcctcaggagccgatgcgatcaactggaagaaagggtatcagcgatggaaaatgaaatgaaagaaatgaagcaagatgggaagtttagagaaaaaagaataaaaagaaaccagaaaagcctccaagaaatatgggactatgtgaaaagaccaaatctacgtctcactggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcacccaaagttgaaatgaaggaaaaaatgttaagggcagccagagagaaaggtcgggttaccctgaagggggagcccctccgactaacaggcggatctcttcggcggaaaactctcccagccagaaaaaagtgggggccaatattcaacattcttaaagaagagattttcaacccagaatttcatattcagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttcttagagacctacaaagagacttagattcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaatacagacacaaaaaacccttcaaaaaattagtgaatccaggagctggttttttgaaagaatcaacaaaactgatagaccgcaagcaagaccaataaagaaaaaaagagagaagaatcaaatagacacaataaaaaatgataaaggggatatcaccaccgatcccacagaaatacaaagtaccatcagagagtactacaaacacctctatgcaaataaactagaaaatatagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaaagagaattttagaccaatatccttgatgaacattgatgcaaaaatcctcaataaaatactggcaaaccaaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaaattctgggccagggcaattaggcagaaggaaataaagggtattcaattaggaaaagaggaagtgaaattgtccctgtttgcagatgacatgattgtatatctagaaaaccccattgtctcagcccaaaagctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaagcaaaaaaagagcctgcatcaccaagtcaatcctaagccaaaagaacaaagctggaggcatcacactacctgacttcaaactatactacaaggctacggtcaccaaaacagcatggtactggtaccaaaatagagatatagatcaatggaacagaacagagtcctcagaaataatgccgcatatctacaactatctgatctttgacaaacctgacaaaaacaagcaatggggaaaggattccctatttaataaatggtgctgggaaaactggctagccataggtggaaagctgaaactggatcccttccttacaccttatacaaaaatcaattcaagatggattaaagacttaaacgttagaccttataccataaaaaccctagaagaaaacctaggcattaccattcaggacataggcatgggcaaggacttcatgtctaaaacaccaaaagcaatggcaacaaaagccaaaattgacaaatgggatctaatgaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgagactgtaaactagttcaaccattgtggaagtcagtgtggtgattcctcagggatctagaactggaaataccatttgaaccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactatctcaagaaccaaaaaccaaacaccgcatattctcactcataggtgggaattgaacaatgagatcacatcatcattctcagtaaactatctcaagaaccaaaaaccaaacaccgcatattctcactcataggtgggaattgaacaatgagatcacatggacacaggaaggggaatatcatcacactttggggactgttgtggggtggggggaggggggagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacatatacaaaagccaccccatacaggtgtttctcgtctcctctctccgcaaaggacagtgctgttggtctgtcctgagatttcagcctacaggaatttctgaagccatattcaaggtgggggggcaggaatcagccactttcatattttgcttgtttccctggaaaaccacaagctgttataaggattgttattaagaagttatttatcattattgttgctacgatttgaaagtagagggggtcgctgtttgtacttacatggcttcctccagagggaattcccgaattctcagacagctcatttaaagcttccaaaatgacaaatattccacaggtatctgctgcgtcctctcctgtcctgattcctgacttcacatttcagcctttcacaacatgtggctagcacccctgagttctggctgctctgctgaggggcagggccaccgtttatcaccctcagaaatctgagccgcaagtgtggaaccatctcaccactcaagctggggctcatgctcccgcagggtggtgtgggaaaggcggtgtgccgtgaaggccaagggccaggttatgggctgtcccagggcttgagctgcttctccagcagctcctagccatgaaaccacaaacactttgcctcccccttctgagtcttggtgccctcatccataatacggttacaatatatacctcacaggcttgttgttgtgaggttcaaactaaatcctttataaaatgtccctgaaacattgtaggtatgcaacaaatgttggctatctcccccttagtagaaatccgacttcatgtgcactcagaacattctgtgagaaagtaaaattgctctctttaacctcaactttaaaacctagggatatatcttcaagtttccccattacctaatgatgactattatatttttactcaattttgaaatttacaagtcatgttcacatagatcttatctcactctggcctaaaatgctcccataaaattggcagaacaaatttaatcatttttattttatagaatcaggaactgaagttcatagagattaacatgcactttctacaaggacacacccactatcggaacccaggtttcttgcagcaaatctagtattcctctcaaatgccatctaggtttcaccttggctgttactttctagccaacccttgactccactgccccatgtgctcccaaagtatcttgtacttattctttcatggtacttatcgcactgtattgcagggcttctcaagcctgactatctaacagaattatgtgagactttttgtaaaatataatggatttagggcctcacgtgatttaggtcccacctccttaatcaggcgtctatttttgtttaaagttctccaggtgactctgatgcacagaatcatgcttactaaagcataaactctctaatggcagcaaccaaatctattttgttcatcattaggattctgaatccttaaacaatatctggcaatactattcaatattattatcaataacatttactgagcatttactctatgccagacactatgataagtaatgtgtgtgcatttgtttctgttaattctgccaatcgtcctatgaagaaggagttattatcaccctatttaaagagtgggtaactgaggcttggagaggagcttgggaaacatttagtaaatacatcaatgactattagcagtacaattcatgcttcctacctgcttccatgataataactggaaccttcaagaaagtgattataaaatatgtaataaaggactctggtacagtcagctttcaggcacacattagtcattgtctctagaaagtagaatagtaaagcagagccttgggagagcttgggggcagacagcatggccccaagacactatttctgagtcccacaaatagcacattttagttgctgaaccaatagaaaatagcctgaattcctcctagatcatctaatattattgttcaatttaaatacttttggcttcaagtagcagaactaatgtggctgaaacagatggggactgattttctcatataagaaatcctgaaataggtggtcctgatgcgggcttagccatttaacagcatcattaaggcccccaaatccccaaacgcctctcagctttctactctgccaccttctcattgtcagcagtgtttctgttcactgtctcacgatggccacagcagcttcaagcatcccttcacctgaaaacacctgaaaacagctgaaagcagaaggggaaggacaaactcatccatgtacctctctcctttttcaaaggggaaaaatgtttcccagaagccacctagcagacttcctcttcctcctggcagtaggtcacatagccacagttagcccaaaagaagtccagggaagcaagcgatgggcatggtggcatggcattgtcttctctcctgtgagaggtaggacttatcacaaggacagaggagggagaaaaatggttgcttcttagacagtttattatctcagcctcaaataatctttatttaaagtactactaaatcaactagattcgcctttagaatattttcaaaacctgtttggccctatgatacgaatccaatgttgttgaagaaaggggcatgtcagctccagagatctctagacgactgctctatggacagttaaagactttggcaacagcagacatgtgatgatggctaatgctctcctctcctgtttccaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtaatttactaccactgaatgaagatttatttgcccaagtccattgagtacttattcattgtcactcagagatgagttccagagaatgcactggcatttgcagcatttggtagcaacagcagaagtataaactttcacgtgtgaaagacacgtcacatatgcaatttttcattgtagttttctttgctagcttgctttgggcagaattctcattcacgtggcttgtaaaatgatttggtttaaagtcatacctaatttaacagaatatagaatatgttcttgctcacaagaaccttaattttaaataatcctattagaaaacactgtataactaatgtaattttagtccaataatagaaattaaaataactacttcacatttgtttagtactttaccaattatttccacatacattgttctattacattatcatggaagactacaacgtagataatacaatattaataggacaatgcaatctctctaactcaggacaattaggtcgaaggccagtttcaattccaaaataatgtcatggtgggtttttgttaacttttattgcatagaatgtttcaaatggcactactgagtttaattctatctcaatcaatgcttagtgtccgctctatgcctgcaattggtttggtgctggcgattccagcagtgagcaggactcagttcctgtcctggtccgagtgacaggattattgtgcagaggggtctttggaaacaataagtaggggcatttagtccaactgattcagaaaaagacttgagaagagaagtcgtggacctcggttaaagaagctggacaggggtttccagacagtgtgaacatgaccaaagttacagggcgtgcagcagcccggtatgtttagggggatcctgcaggctcagaatgcccagtgactgaagacaaagctgcccgaggccagcagtggccagaactggaggaccgtgagtgtcctgatggggaacatgcaacatattttgcaaatgattcactgccagaggttcttaggagtatttatttttagtaaatggataaaaatgacaagtaattagcatatacctaaatattcattggaatccatgaagtgctaaggagtgcagaatttattttaaatagtttagacagtctccctgctcttatttacaaaagtaatttgcactacaaagaagaagcttgctgaattgagaacacttgtgcatagtctcagaaagtcagaatttttgttatctgaactagtgaattttcactgtattttttaaatgcttcattttcctcttctgttggttatcatccattgcacaacacagatacaaaggtggtatttttttgtcatttggatttttccttaaaggaaaatttaaaacaatataagtgcaaataaaacaaaacaaacaagcaatgccctcttactgtagagttataagcaaaaaaaggtttggagaaacaaaaaagcaagttcatagaaaagttagctgcaacatccactcattcatacatacatccacacgacagctggctcttaccatctgccatcttccagtgctgtgtagagctggatacatgtacagccctgccttcccatgcagctggggagaaaagcagaaggcagccctcactgtgctgggtgagaattgctctggcacagggtggacgggtgctgccgggcacagagaaaggctctcagccaagaatcggcagttggggaagacctcgtggaggaagttagtgatgggctcactaagcccaaaggacacacaagaattggcagatgaagctggggaaagaggtccccaagaaaaggcagtaaggcaaggactgtggtgagaactctcgtatttggaagaagtcctgaccagacagagtagtgaagaaaagttgcacctacaggcagctaggggcagcaggaagcgagctgtccacatgacagatgtctcttggaaaccatggagccgagcacagctgccattagctgtcagcatggaggtgacagtgaaggccaactcaggaatgggacagaatcagatgccacgagaggaaagactaaaacccagtccacgaaacaggagtcaggggcttggctgggggtggataacaaattaaaacaaaatgtgtccgcactgcatgaggaagacatctgaggtccaggcctctagagtttagcaaggaggcaaggctgagggagagggacagtgtggaggtctggtccaactagaagaatccctaaatccacatagatggttgtaagcgacgactcatcctgcttcggggctggagtttgaccccaagtggatagtttcttaatcaagggtggcatacacatttcaaactggaactttggaagtgaccaagtagaatgttgttttgagaagaacaccaagactgcatctgaatgtggcgggtagaaggattgatggccgccattggccactggcatgcagtgaggactcgtcatatccgtggctcagtacttaccaccctgattctcaccgttgaatctcttataatttctctgatccacaaatgctgagtgtagataccaaaatatggaaatgagtagaatcacaggaaacaaattattactagatttaggacttaactattttaatgaattaaatcatggaaagatcaggttcacttcaacttactaaagcttattattaactttataacttttttcaagatatataattaagaaacgataagactttgaaaatcagaatttctgaagacttctcctgtggcaatatatcttctttgataacagtgtcttgattccattccctctttgctccttcagttacttccagggtcactgttatttccacctctccctctctattttctccttccaatcagcatttaagcaggctcaaatatctgctgtgttaaaaacaaaaattacaaaaatctttttcaccactgtctcttcctcctcgcctccttgccgtcctggagcgctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcctgcctgaccctcttttcctacctctttttgactataagcttttcccctttcttcacccttttcaaattccatttcattctaggcatctatccttgggctccattcccacccacctgatgttcttcccacatagctggtgttaatgttcacatatgtaccatcaccccatgtctgtgtctccaccgggactttacctaaatgtcctacagaaacctgacacggaacttcccaaatgacacctctcactctctccctcacctcaggtccgtttctcccactccccctactctggtgaagagaaccaccatccactcaaatttagctacttaagaatgagttaagcaacaaatcctctaaatgtcccctctgaaattgttctcgaatgcatcccctcccctccagctctgtagcctaaaaattaaatattatctggtgtgtacaactcttaatatagtgcctgacacataataagtgtccaataaaagtttcccctattactagtaattctgttattcctgccatactactgctattagtttgggctatgattagttttctcctggaaaaatacttgctctagcttcccaattccacctcacctcctcaggccctccttccctcagtctagcccctgccttgctgccaaagtaatatctgaaatgtaaacctgagcctctcccagcactgcttaaaagccccacccccccccccctctccctgtggcctccagggcatccagtcctaactcacaaagcctcttgctaagtggcttttcggcacctggtcactgcacctcctgagcatgcccccacaggtattgtatgcagaggccagggacctgccagcagttcctccaacaagccaagccccccacctgcatccctggtcttgccctcgctccaaaaactccgagaggcctcccatgccccttcctttccccatgcactgcaggccaacctccgtcccagcatctgtggtgagcacctgtgtgctgccattgctcttcacgtgttccttctgcaccagtgagggaaagactgtttctcctctgtgcctagtgcctagcacggtgtttggaacattatggggtttccaacagcatgagatgatttgaatgaatggttactggggaggcactttcacagctaggcttagttgaacataaaatgtcctaaactggactattatgaagaggaaagttttgtctctggctgaaagcaaaatgcttctccaaacctcaatccttcagatcctctgtgccaggctgggtttcagggcctggggatgcagaggtggacaacatgtctctgttctcatggagcttgcattccagcaaggaagataatgtcacacagtaactagtactgtgacaaggaagaggaaataaaaccaggtatgtgttagggagagccgagaacactagggtttgaggacacattacacaaggtaagagggggaggacaggggaggtgacagtggagctaaagccagaagaatgagaggcttcgtccaacataaaagggctctcttattacatcctagttaatggaaagatatttttgactttgcacccagaggctgcagaagaatctcagaaaatataatctggctttggatatgtctctcactgcactaaaatgttgcctgtggccctgaattatgtaagatgccagagcacgcagcataactgtagagaaacaggaattactctgccaggctctgggaaagccgtgcagttgttttctcctctctgggcctgcgcttcctggaacagccccagcctgcttctgtttggcggtctccgctcacagaggacagtgcttccccagaaggaagctccaggttcctgcacccatggcaggctgtgaagttgcttgtggctggcttcaaggcttcttctcccattcacctcaccttggccagctcagctcctctctgatgtgttcctgatgctcgaatttccctcctgcattttgcctcaatgcatctctggcccgcatccaaagtgatcatcattaatgttctcttctcatggatctattggccagatgatttctgctaaaagatttcactgcacttcccttgtcctcactcctccttccctttttcttacctccctccgagtgctctagctgatgcttgtcctagaccaactgttcctggcacattcttgcagtcttgacaatcagggaaatcgttaatacacacacacactacacattcacattcgtatgcaatgccttctggcattttttctgtctttgcagagtagcttccatttattatatatctacttcctctaattcacctaataaacctaggatgtagacacccttattttacaaacaaggaaagtgatggtaataatagtgtctgtcttatagtgttgttatgaggattaaatgacacaatgcatcataagcacttatgccagtgcttggcacagagctagccctcagtgagggttctgatgattcattgacctctcagtcaccattgcattttattattaactagataaagtagaagacaatacctttaaactagcataattataaaagctaggattcttattttaaagtgatttttttttcactagccattctcaagcctagtttttacaagccaaggaatttgccttcatcttctcatctctatccttagggatacacaaagataaacccaaaggtatttaggatggaaaagaggatgatgaccatccctcacatctgcatgagccctgtttccaagccaaagccttttgtccaaggctctgtaaggaccgttctcccaccttcccagtgtctgaggcataagctccttctgaggcctgacttgtatctgtattttctgcctcatcacttagacaaagctatgtttttcttcttctggaggttaccctcctctttttcctcccttcatctccaccacaaccactttgcaaaccctgcacaaaacattttcctaaaagcagcacacacacctcgaactgcattagaacttaggtgcaccaccgcctgtcaacagatgtccctcaaaaaactgccctccgtgtcagatgagtttgggaaaccttgtgtaaagaaaggcaaagaggtgtccttgctgctgggcttcacttagaacctctaatttgctaattaaggtggagaacatctccaggaggcgctggacaactagggcatctccaagggatctgaccggagcaccttgggcagggtcgcctttttaatgtcttgccagagcccagcatccttggggactgggggatgcaagttttggtagaaccttctgccatggcatgggtgttgggggcaatggcaattgagtgagatagggaagaacggggcaggagccctcaagggtcagctcagcaaacagcaagtgggacaggcccaagtggaaggagagatgaggaagacaggtcttattggggggcaggtattcacaaatcagagagaaaagttacattgcaggaggtggaatggcaagaggcaattatttccaattattagaggtccccaaattctagccacatggctgggactaagaaaagcaagcaaactgacaccacagtttaagaaaagatagacattgccaattttacctcccaccccctgaaatagtggccccggagaaacccctttctggatagatcccaacactgtcacctcctaacttgcagcctaggctggtcactgactgtctggcaatctgactttgcagaatttataacataggaataatgacggcaccctcctcctggggaggtctgaagcttgtattatagaaacaccccaacaagtgcagtacacggtgcatccattaatgtgactttctctctggtggattgtatttttgcctgtcattatctctggatctcccccaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtcctgtaagctaacaatggtgtggttctttgtgagactcgctgtctggcccctgtcttgctaggtgttaatgcccgttatagctttatatcaaagttaaagttccctccaagatctcagaagtgtgagcctcacagggagaacccactcattctgcaaaagcctccactttctttttttttatttttattttttgagatggaatctcgctctgacacccaggctggagtgcaatgcgatgatcttggttcactgcaacctttgcctcctgggttcaagcaatcctcctgcctcagcctcccgagtagctgggattacaggcacatgccaccacgccaggcaaatttttgtatttttagtagagacgggatttcactatgttggccaggctgatctcaaactcctgacctcaggtgatccacccacctcggcctgccaaagtgctggaattataggcgtcagccaccgcactcggcccaaaagcctccactttcatcctcacgtctcatgcacagaagtgaacattgaaaatttcaaagcctagagccccatgagttgtgagaattaaatgtaacttcttgctactcaaagtgtggtccatgagccagctgcatcagcattccccaggagtttgaaaaaaatgtagaatctcatgtcccaccccacaccctctgaatcaaaatccatgttttgacaagatcccaagcagactggagtgtacaggagagtttgtggagcatggatctaaatgatccatctcagaaacaggccctctgctggtgcctctcgcccaagttaggaaagtcttttgggggctgtccagaatgaatagtgtgctttgctttcccattcaaaaagatacacgcgctgacataggccgcttcttaaaacgctgtctcctgtaatctcagcactttgggaggctgaggttagcggatcacctgaggttaggagttcgagaccagcctgactaacatggtgaaaacccatctctactaaaaatacaaaaattagcccggcgtggtggcaggcacctgtagtctcagctactcaggaggctgaggcaggagaattgctcgaacccgggaggcggaggttgcagtgagctgagatcgtgccactgccctccagcctgggtgactgagcgatactccgtctcaaaaaaaaaaaaaaaagaaaagaatggaggctggaaacaaagctgtgtcatctaggaggggcctaggaagaggttttctgcctctgccatctcttgtggggcctctttctcgtccttgcatgcacatccttccaagcattttcatcactgtaaaaactcagaatattttaagcagatcagggtccacgtgctacagcttgccttggggattacaatctcaaaaaatcacatttcctaggatgttcgtatttggtgggcacaacagttgaccacacgatgggcaacacaagtccattggaagaaactggtctctaggcagagaatgagttagagcaggttgcaaaggacctcgatactttggggcaccaatttctgttggcctgacatggggcactgaagagaaaagtgtacaaataataattttgacaaagcaaaggcaagcaaaactaatacgctcccctgggatggtcaagccacaagtctgaattgctctcaagctctctggattttgtggctgtcacagatcatggtccccttactgaggttttggaaaatattcccagaaaaatgagaaactattttttaaaatcctaattccaaggaacttactcaaatttgaaggaagcaaatctccccagcttcagtaatggagctaacaattaagaaatcactatagtggggccaggcatggtggctcatgcctgtaatcccagcagtttgggaggctgaggcgggtggatcaactgaggtcaggagctcgagaccagcctggccaacatggtgaaagctcatctctactaaaaatacaaaaaattagccaggcgttgtggcaggtgcctgtaatcccagctacttgggaggctaagacaggagaatcacctgaactcaggaggtggaggttgcagtgagccaagatcgtgccactgcactccagcctgggggacagagcaagacttcatctcaaaaaaaaaaaaacactatagtgttttctttggaaactaaaagctttggcacttttcctattcctagggtagtaaaggtaattttcatggaaaagaatagtcagtgtaaaggactgaagaggacaacagtcatggggattgtttaaaacaggcagccacatttgatttcagagagttttgcaaatagacaattctggatgtaagcgatgactgtgtcacctaccagctgtgtttcctgagcaaggtacttaagcactctgagctgtctctcctcatctgcaaaggggaaaaacagcacacacaccccggggttcttgattcattcccctaacctttatttagtgcttgcaagtccaggttctgttttatgctggagacacagcaatgcctattcttactgaatttctgatctcatgggggaaccaaacaaacaagtgaatctatagtatagttatatgggtaatagaaaaatacaaagcaggttaaggaaaacggggagtacctgtggagatggtcagaaaaaaaaccctctctaatggggtgacatttaacagagacctgagtgaaggtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaacttaggttttgaaaagaccactggctgctgtgttgagaagagactaaagaggaagtagggcggaaggttagagactggtaggatgcttctgcaatcactccactgaaaggggttgatagcagtgatggaagcagcgagaaccagtccgatctgggcatgtgctgaaggtggagcccgcctgattggctgagagactggatatgtggtgtgagagaaggaaggtatggaggaagccaaatgagtgatgaatgtgaaatgtgtgccacatggtagaatcttagtaaatggtaacttccaacatgtttacatttggggaaactgaagctcgagagatgagtcgatgtgttcaagcccccacacagcaatgagaggcaaagcagataatagagtagacagataatagcagtgacagtgagccagttcagggtaaacttggccccaagtgggccaggtcccttccttgtgctcccattacctggagtctagcacagatccttagacaaagaaccaaatgccagcccttttcccacctcacaagtgtcctgtctcataatctccttccccttccctctttaatccaattaaagaatgagcttgtatgggtgagtagaatgatatcattctctcagtcatcgacctagggacagctgaccaaacctatgcctgagtccataggaacacatctcccattcgcttggccagccccaggttgtcctgaataacttgaagggaactggagactctttgttcctttgccctgcaggcaggtggtattaactgtgaccaataaattgtatattgaaatataaattaaattgcagtgtattgcaaaaagccacataacttcaggccttgatcaagcattcttagatgcctctgctgcaaagaaagctttccaagtagaatgggaggcatactttccagattgatgattaaagggaatgtgtgtgctggaatcagcttgggagatctgaataacttaaacctctccgtaccttcaaaggtgctatcatttccacttggctatatttagttttctttgctttttggaaaagagatgaggcagctccagtctgtgtctcccttggctttccccagacaccgtaaatgatattggcagcatcccagccctaccgctcatagagcgaaaacctattcctccttctcctgccacgtttaataaactttatctagaacaatttcttgtgcagtggcaaaacacagcacttacataacatactatttcagaagcactgttctcttgggctctgaagcacagcctggtttctttagtgctatgatttagggagtgttctacctcagagaagaaaggggtcctgatactgagattataaaggtagcaagagcctctgtaaagaaatcatatcccattagccaaaagaaatccagtggtcaaacatagtcctctagaaatagtcagaagaagtcattttattattgttattactggaaacagctagaggcaaaaggcatcttcttcgaggccttccaccttgccacttcatccattctatctagagacacgataaactgaccatttgtgctcatctgaggctgtaaccaatagagggccagaacctcactcatctaaacaattaattgcaaggggagccatggaggaagcagggtccaggcttaggtccaaagacagcaatacgagagcgggtcattccaaaaggcaggacctgggggccaaggtcaaggcaaggtcatagctttaaagagtcagctctaaatggaatagctctgccccaggaatcaagccaacaaagctagctctttagcgcttgcccaaaataggccaatacattctaataatccacctgccctatgcggggtttcttggtttcagcaccattgacattatgggctggatactttgttgtgggactatcctgtgcattgtaggatgtttaactgcatttttggcccctatccaccagattccagtagtaacccaccctccaccccagttgtgacaatcaaaaagttctccagacattgccaaatgtcccctggggataacattgcctcctattgacaactactagtctaggatgaccaacctttctagttttccagggattgatggggttctcaggatgcaggcctttcaatttaaaacccaggtagttctcagtccaccctaactctgccctaacttaccccttctgctgttagaacctcctgtctctcagagtatctcacacttcaataggcattgtctggggtcttattcaaatgcagatcctgacttcactggtgcagtaagaagtcagagaatctgcatctgtaacaagctcccaggtgatgatggtgctgctggtgtgcagaccgcaggaggaacagcaaagacctggactggaaagccatcccttccactggaacccaggctgtctgcagggctgattctacagggatgcccctggttgttggagtggcccttctcaaccctggctgcacatcagagtcagctgcagagctgttaaaaatacagatgtctaggtcctccaaggctctgatttaattggcctggaatgagagccagcttggtaggtctttaagggtccccaggtgattgtgatatagagccatgactgagaactcttcaatcagaagtcctggaagcaaggcacagcacttacgcatctgtaaagagacttccaaatagaagtgctgcccaagacagaggctttcccagcctcttggtcttcaaggtccagagcaagctgctgcagatccatcgcaggtgtgagagttcctccacagatgatgggcatggctcaatgcacccacaccttcgagccagtggggagtcaggggccctgccctctgctctggtgcatgcccatccacaggcaccccaccctgctgcaaaactgctgttcagtacagcaggctaaaatgaattaccctctgtgctcaaactgttggccatgaagctgtttccttcaataacttccacaggaaggggaagtctttggcaaaagccagaaactgagaaggaaagcagtaaagacattcagttctgtgaaggttcatagagtctgttctctgtggctggggatggaggaatgagtcacccattcacctgcggagtctgccagctgtcggcacatacaggcatctggctccaaccaggtagcagtgggtgcacacctgggctcagcctacagaaaaactgcccattgctctctagaatcctggacagtgggaaatgggagttagagagaaagtgagccagagccacaagatagaactcaccatcctcagcccagatggtaattggaggggagccaggaccactctccatcttccaaatgccattctcattggcttgtccccaggacctagaaatctgacatcagtgactggtttccattgagaaaacaattgtttggcacagaggtcttctaaatcacaaacagaggttcggagatagttgaatgcctttggtagaaactggtttcaacagcttccttctcttaaatagaaaaatcatatcagattggagagaaaatgtggaatgctacagagaaaatgtgtaggtagttgacaatttagtctgagtgtggcccatggcctaggtgagacacttcttatttgacaagggatcctatgtggaatgggggccttggacttcagcaccccacatgttccattttgggatgatcccggcccaaatcaaagccaccattaaaacccattggtccttctttgccatgaaaatcacatcttttccatggcatttcttttacaacagcaaaagaactgtttggaaggtttgacacattttctccagtgagacttcaatgaatattaaatttccagcacattctttacctaagaagcaggacagcttatccccaattgactctttgttccacttgccccttacctttgctgtgttcctggtggcttccaggctaatgtgggaggggtagggaaacttggagaaaagtaaagcagaccctgtctcaagtcttgatgccaggcctgtgtgtgttttctcctactagtcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtcagtcttagcgtctcatcctggaacagagacaaaggcacgcagacttagtgttcatgtgtgcatatgcgtgcttgtatgtgtgtgtgtgtgtgaatgaatgtcctgctcaaaaaaaaaaaaaaaaaaaataccagtgctaggatcctcttgttctttgaaagaagtaaactgccctatatatagacacatacatataacactttcctctcctctccagatttaaatatatagatgtggctgcagatataaatataacctgtgggtataaacacacttgtggaggaagataaagatgtgtaatggctacagatacttagaactttcagtgtctccagaataaagtgggtcaggcatgctataagaggtagataaactgcctgcaacattttggacagtaatattgtttatggaggtataattgtggatagtagattgcacagatcaaaatatacagcttgatgatgattttgtatgtgcgtgtgccttgcaaccacaagccagatgaagaaatggaggatttccaacacccctagaaggttccctcttgccttttacagccaataaccccctagactatcaccaagatagtaacttttctgacttttatcaccataggtttgttttgcccatttgaccagtagttttcatgatgcctctccagtgatcaccagaaatctctgcccaaatggctcaagagacttggcagaggaaggccgagggttgatgagagtggaagataaatgtgggagcctctgtgctcctacttctcaggcccacagctgtagcttctgggggcatctgtggttgcatccatgagacgccttcctgccctggaagcaggaacccaggcttctggcagtgaccctgaggagtgacatctcatgcagcccttatccaggtcttagagcccttccctagtctctggagaacaatcttcttgaagtgattaagagcaattagcacagatcctgctaaactacattgctctaaagtggtagataaatcaaagctttataaagttgatcacattttaatggtcctagaggtgggcagggtgagggtaggtagtccttgcttctcgtgaatcctttgctgtgagtcatttggaaagccaatgactgctgtgcagcattcagaatggcagtgtttcttgggtaactactgggctccagacgctgttcttaaagcactttacatggttgcattttcaaccaccaacaaccccacaaggtaaagagtactggcatcactttacagatgagaaaactgaagcacagagaggttctataactcctccaaggccatacagccagcaaatggcggagctgggcttccaaccccagcaggctggctgcaaaagcagggctgggaaccagctccttcaactgaacgttcttatggtctggtcctgtgtaattgacacagtgagccaccccaaggcaagtcccacccaaactcacgggcatgtaatgcccatcagggagcagaacaccaggcccttcttttctacaaaggcctacattgtcatgtctctttgtttccttcgcctctgtcatggcccacaggcccaccatggcgttgtgtgcacaggacgcctgaaaagaatgaaaacgaggctgtgcagggttggcaggcaaagggagaaacaaatgcaaaatggagaggtggggattagggttgctgcagaggtaccatcatccatgagaacgtgaagttaatagcttaaggtgcaggatgccctaaccccgaagctgttcttcacagctggctcttcctatagacatgtgggaccccctgctgcaggcctgtcccagctgcttggtggaagcagcttttgctacccttctgggctattgcgcaggtttcatttatgagctcaaccctgaaccttccctgacagcagcaaggcctgtgtgcgtacctaattatgaagtgacggcctgtccctgtgaaggtctcaggagagaggcttcccaagctgtgaagtgctcaaaccacagcagaaaatagaatttaattgcaccactgataataaaccggatgtatgaaggaaactgataactttcatcttttaggcactattaatttgcaggattatttgttagttatcttctgggtttacttaaagagcagtttaattccccagggcacaatcagaataccttatcccacaagttagcagacctgggcatgtagagagtactttaaatggagagttatattgttttgtgtttccttccacaaaggaaccagagatgctgttcctggaggaaacttatttagaggtagggacatttgatagggaagagagcatgagagagatggagattctggcttctgtccatgccaagtttgttcaaaaaggtggaatggggcatcatcccataaactgtcctttaaccattagcccaactaactccaaggataacctaaatccaaatggagtagaagtgctcctgggtaaagcactcacaccctaaggaccacccaggagtcacggagctgtgagaggccctgagtgcagaagctccggcctgtggactggggacctgcctagcctcctggagaggtgaaatgcagagtcatagcaggggagggaaggagggaggggaagggagggagaggagagaagaacagaggggagaggagagaacagaggagaaaaggatggagggaggggaggggaggggaagatggagaggagaaaaagaggaaagaaaagaggaaggcacaggaggggagaggagagaacagaagagaagaggaagggacaagagggaaaaaggagcgagaatgggggggagaagagaaaaacggggagaggagagtaataagaaaacttcaagttgaaatattccaaaggaggcctagggagaggggtcagataaattgtataaaacacaactcaattaagagttattttttctccttccttccttccttcctttcctgtctttctatttttattttagatttgagggtacatatgaaggtttgttatgtagataaacacgtgtcacaggggtttgctgtacatattgttacatcacccaggtactaagcccggtacccagtagttatcttttctgctcctctccctcctcccatcctccccactccagtagaccccagtgtctgtttgtttccttctgtgtgttcgtaagttctcctcatttagctcccacctataagtgagaacatgcggtattacgttttctgttcctgcattagtttcttaagaattatagcctccatgggctttttttttcatatgcttgttggccatatctatgttcatgtcccttgcccactttttaatggggttgtttggtttttttcctgtaaacatgttcaagttccttatagatgctggttattggcaacatcaccaatcatcagagaaatgcaaatcaaagccaccatgagataccatctcataccagtcagaatagctataattaaaaagtcaaaaaataactggtactcgtggggttgtggagaaaaaggaacacttatatacggttggtgggagtgtaaactagttcaatcattgtggaaaacagtgtggccattcctgaaagagctaaacacagaactaccatttgacccagcaatcccattactgcgtagatacccaaaggaatataaatcattctatcataaagatacatgcacatatatgtttattgcagcactattcacaatagcacacacatggaatcaacctaaatgcccatcaatggtagactggacacaatgcagccatagctgtaaaaaaggatgaggtcatgtccttcgcaggaacacgaatggagccagagaccattatcttagcaaactaacacaggaagagaaaaccgaatactgcacgttctcacttataagtgggagctaaaagatgggaacatgtggatatatagagggaaacaacacacacagggtcctattggagggtgcagggtgcggcgtgggaggagggagaggatcaggaaaaataactaatggctactaggtttaatatctttgtgacaaaataatctgtacaaccctcatgacatgagtttacctatataacaaacctgcacatgtacccctgaacttaaaataaaaggttttttaaaaatgaggacttggaaagggagctaaatgcagtaaaagtacgaaaccacaatggctcagaggtccagaattacataggatatgtttctctaaattctaagaaaacgctcacaccctttttcaacctctttgagcctggatggacacacaactgactgagcctcaaggttgctgtgggcaaatgtgccaggcacagggtgaaattatgtgagagacagagaggagaccacagcccttcctgctcagctcagtcaagataagggttgggaccagcccctggtgattatgatgacagcagctatgatttattaagcactacattattaaacgcctctcttctatgatcttatttaaccctctataccatcctacaaggaggacgttactataaccctattttactgattagaaaactgagaggaccagagaaggcagtgccttgtagcacagtggtcagaacatgggctctggaaccaaatcatctgagtttaaagcttgttttctgaacatcataactgtgtaaacctggacagatcatttcacctctgttggcttctgcattctcatctgtaagtcaaaagcaatggtaactctcctcctggggtccttgtgagttttttatgagtcattggatgcccgagtcacagtgcacacctacatatgttggttgctgctattattgccattattgctgtttattagtaactggcccgtgatcacgtgcctgttgagggaaggagagacacttctggcccaggtcttcctgacttggaagcctgtgctggcagccgctgggctacaatggaactatcacaaaaagcagaggtggtcattgactttgcagagagttttgtattcaagggaggagagatcacacacacttgagtggtgtgggacatcaagaattaagactgtagaaagatgaatggtctccaatgaacagataacgttcaaccagtagagatggatggagagaccccttcagatactaggaagaaaatgttagcaagggctagaggggaggtggacggcagtatgtagagcagtgagaagcgtgccttggctggggtggaggctgggagcagggatgagtaagggtaacctgaaaaagatagcttgaggctatgtggaggggagtctacaattttggatgagagctttatcatcgactctctgaacaaagaggcttcaagggagtttctagagtgggaatgtaacatgattgtcaactctgctctcccacaagtcggagccgctttttcttcctcccttctcttcaaagcctttgcccaaagcattgtcttctccaggaagtacccaactcagccttggaactggagtttcctaaaagctagtttccagctgttcttacctgattcccctttagatcaaatctaggccaatctggaacaatactgggctcacatgtctgaatccaagtcaccgtcaaccaaagcaggccagtggcttcctgtttgtgcatcccagtggacccagtcgtggattttactggtccctgtggtgataaagatggggcctgggctcaatagtgctcccagtcaaccattcccagcacccaccatgtgtgagtcagagtgtgtgatcctcacatggaaacaggcagagagagacagtcattaaactttaatgagcacacgtctctttccccatgctatcaaaatattttgatgagaaaagaaaatttcattacaatcagacatagaatttttctctgccttcccatgtgttgcttgttctctctctctctctctctctctctctcacacacacacacacacacacacacacacatcctctctctgaacttcagtatcccctttgcaaagtgaatacactatgattatactgctccttctattaagtacagtcacatataaaacactgcactggggggattgacatctgtagcaatgtttgtgagaatgcatggcccacgtccagacctagtagctgttggtaaatgttctttctcctctgtagtcccatcaatgcatgggggttgcttagggcagcatgtgggccactggcctgaagtgggccagtggcctgagtgtggccctcacctagtggcatggaatctcttgaatctctggtcaccaggtgttgagtgtatgcagcattccctgtggaatggggccttcctcatgcagggaggcccgccttggagatcctggagtaaggcctaggggagagaggagacactcacatgttcctccaatgatctctactcagtacctgccattctaaagcagctcaggagccagcacttgtgtggtattatcatgtggaaaaagtcctgcagcctttgcaggatgtcaggaagcaccaatagaactaattttctcatgtgaactaggaacaattttgctaggagaaaacataaccattttttatgtgtgtgatttttaaagttacaagcataagcaaacagatgtctccaaatttttcaaaaaaaaaaaaagcttttaaaatgaggacaattgactgtttccaagagtttttaaaagtaagcgtttgctctgtatttattttgtccattagctgaaagactttctagtttttatttatctctttatttagtcactcttgcattcatccattcttcatatagttatttggtgcccactctgtaaataaattgtagcaaatgcctagagctttcaaaaccattatcagagaggccgggtgcagtggctcacacctgtaatcccagcactttggaaggccaaggtggctggatcacttgaggtcaggagtttgggatgaacctgaccaacatggtgaaaccctgtttctactaaaaataaaaaattagccaggctgtagtggtgcgtgcctgtaaccccagctactcaggaagttgaggcaggagaatcacttgaatccaggaagcagaagctgcagtgagccgagatcccgccactgcactccagcctgggtgacagagcaagactcaaaaaacaaaacaaaacaaaagcaaaacattatcagagaaaaattcaacagtgagaacattttctttctttccttttttttttttagatggagtctcactctgtcccccaggctagagtgcagtggtgtgatctcggctcactgcaaccttcgtctcctgggttcaagcaattatcctacctcagtctcccaagtagctgggattacaggcgcccaccaccacgcccagataatttttgcatttttagtagagacagggtttcaccacgttggccaggctggtctcgaactcctgacctcaggtgatccacccaccttggcctcccaaagtgctgggattacaggcgtgagccactgcgcccggccaacagtgagaacatttttgttgcatttttctgaaatggggaaaggttgcgccactttctttcagcactggcccacctggaacagctccaggagtgcagttgctctgttttaacctgagctaaccagcacttacacagagcctggggtgctcctcttgcaaagacagtgtacatggggcctgtgaaagatgcttaacccacagaaatcgacttcaacaagcagaatatctgcatgaccagcactgattggtggggaattgtatagataacacaagatccatgggaagtatcactgttgaccccggagaggaggcagggaccttcctctgggcggcttccctccaggccagcactcacccctgtgcagattgtgcccatctgcaggtgggaaggagacagtgaggggacccagtccagcccactcgccaaccatcaagccctgcagcctggcatggagccacatccccccaaaaaagggggttcccttttccactttgcacagttgcatcctggctccagccccatgtccagatctcttccaacttgggacactagcttgttttttcttaacaaccatcctaatgttgtgttctaactggagcttttcatgagatgcccacaatttttaccgaggttaacagtagaatcctcttcagtctccctacggctcacaccctggaaacccaccgggatggaccaaggaagggtgggtggctgtggtggctgctgatctcactcctcccacatcccattcatacaactttatcccagaggacacattaaaattggggaaaccactgggcacggtggctcaagcctgtaatcccagcactttgggaggccgaggtgggtggatcacgaggtcaggagatcgagaccatcctggctaacacggtgaaaccccatctctactaaaagtacaaaaaattaggcaggcatagtggcgggcacctgtagtccctgctactcgggaggctgaggcaggagaatggcgtgaacctgggaggcagagcttgcagtgagctgagatcacaccactgcactccagcctgggcaacagagcaagactccgtctcgaaaaaaaaaaaaagaaagaaaaaaaggggaaaccacttgagatataatgagtgccccaaacaaagtacatgacagtgactggctacactgtgagacttaactgtagtttcatttagtgctgtaaatatcacaaacttttcattaaggtggaaaatgggaacagactatgtgttctaattattgctgaaccctgaccattttcccctccatgtccacaaccgagcacgttctctctccagcctcctgcactctctgtggctccatcgcactctcgtcaccaagattcacccctgcccacacccacacccttcatggggaggccggggatgggaaccaggaggtgggcttcttcacctctcccctttgtggctctcttctctaacccctgagaaaccgaatccacgtcattctccatagaagaccctataggtgaggaggttctcagggtcaccctggcaacatgttctccctttaaacctcatatttcattaatgctagtatgtgtcagatgctctgttgtatgatattacattgagtcaccccactaactgcataagaagctgaggcccagagaagtcaagcgacttgtctaaaaactcaaagtggcagccccggtcttcagcccctgcatccagcttgctctcccttcagcttggcctggaatagcaccactgtgtgcatcccagtcacctcagttatgtccgtgacactgtttcaggttatttgtggagtaaatcagaggtatctacctatgagtcctgagggactctgagcaaggaaagcctgcttaccccaggggaccctaggaggggacaccttcagccctgctcccatagctgactctccatcccctcgtggctactttcacagaggattgtggccgtgggaccaaaccgtgggtgcccttagccaggatagatgatcgtaaactatgtctatgagtgagccctcctcatcgaaggtgttcatttccatctctctcttcaggacagctacagaacagtacacattttagaatgaaaatgaggagtcactggtaactgcggtacctaaaacataatttgctctgtgcatttcatgtttgctatttttttgaatcttaaaaagagacacacatgagaataaccaatctcacattccagtcctgtaatcccagtatgtttgggctactgattctctttttaaaagtggcatctctcatttttaaaagagaaaatcctagatagtgactcctattatcatcaagtaatatatatcaaggccccaaggctaccttgtcacattttactctggcatagaaatctaattccttctctataaagtcaaaaagagagaggtgagttatagatgttttctaatttagttcagggtcaacttataatcctcgtcctcaactgatggtttagcgataacttaaaaggtgatgctgcaaatgattctttgctggatttcagaaaataaagaagctattccagcaaaaaaaaaagtttctatttttacctgtattctgtcagggatcacagtatatgtagttttgaagatgaatgttttagagtcagaaagacctggatttatatccaacttccgccagattcctaactctgtaggctttttatttatcttctaaatttcaatttcacgtaaacagaatgggattaataatcatgtctacccccaagaccatagggctgtagagaagattaaataaggtagtgtaagtaaactgatgaacagaatgcctgcattactaagtaaacactaactaaataaatgtaagttacttgttattattgttgtcattaaccagagtcaggatcacgtgttgctgagcaacggctatggccccagactgtctacatttgaatctctcctaccctacttactaatggtgtgaacttgagcaagttacttaactcctctgtgcctcagtttcctcatctataaaatgaagactcctaatatttacctcttagtgttgggaggattaagtgagttgatagaactttctagggtaatgggaacattttaaatctgctccatccaatgcagtagccacgagccatatgaggcttttgagtccttgaaagatggctcgtgcaactgaggaactgaattttttacatttcacttaattttaattaatttaattataaatagccctaggtggctagtggctactatattggaaaaatatagactgagaacatttcctaaccaccctagaaccattagcattggtcagtaagtgttcatctaagtgtcagctaaaagcaggggcagtgcctgtggtgatgagcagagtttgcaaacaagaaattgcccattatcaaaaatgatcacaggccaagggggagggaaaaatacagtttccagaaatacgtgcaatacatgattgaaagtacttgaaataagagctgttaggtgtgctaataaatcatgtatttcaaattgccaacctcacttattgttactctttctcaaactttttccttcatttcagtttcaattttgaatacagttatgtatttttaaagcatatgcttagtggaagatatcttgtgatttctaaaaaagtaatttctttccaaaaagtttatataagagaaagagagtatgtgtgtgttagtaactttcttgtttaccaaagaatcagagtagcagctcattatcatgaattagtataaaggacaggaatgtcaatatcagtaagtgatatgtaacttgaaaaagcatactacgggttgatttttttaaaacagagagagatattttcaatagaatattgagaaaaacttaaggccatcaagtatatgcaaaagcatttgacgtcaccaagtaagacatatgctttattcttttctctggcccaagtaatgaatactcttctctaaagcaaatacacataaaagtttcttcttgaactaaccttctctaaattgcctgaaggctccctttatttaaggttttatgagagcaagaaaatgaaaaatatgactgtgaaaatgaaatgaaaatatgactatgcagatatggaattatgctttcagcaataaggaaaagggagctttgcagattcctaaaataatgtgatgcaaacagatattttctccccaaatagtcattgttctcagcattttgtaggtaccatagcatggtgcatcactgaaatcaacacataacgtgaaaacactatgtgttggcagcattttcctcaaaagaagcaaggagagggagacacctccagttacatttcccaagcagaacacagtgatgtcgagcattgggtaggtttttacatttagtttggtttgagtgtctaaggctcattatcatcagtagtcagggacaggaagtttacattctcggtgcaggagacaagtgtcagaaaagggacactggtctttgttaattgcaaaagaaacacactacaaccagagaagggcttctcctctcacccctccccatccttctccctgctccccactccagcatcagggaaatctgggcagaattgatacacccatgccagcatctaattacagagacaatactggaagcaaactgattaggcatgacatatgaaattacctgagaaggtttaatgtcctgaacatattcagatctgaagcctatctatgatggcccaattgcatgggccagtttctcaaatactaagcattccttctcactgtcatcagtgacctggaagggtgtatttcactttccacagcgtaggaggcttcatgtagagccagtctactggtatgggaagggttcttaatctagggttcatgggcccctagaaaaccatgtatggacttcataggtctatagtgcatcccctaaaaatacatgcccatattgtatatatcttgtatttgtcactgtgtatgtctgtgtagaggaaaggtcagtagctactatcagatatacttttgaaggggcttatgcccatccttatatagcataccatggagaagacagatggctccaaaatattttttccagaaagaatatagtgatcatagcaaacacttttgccaataatgtctctgtggcagctccatcttcttcagtttagagagcttttgtaaatgctatctttattttgtattttttaaatccaaagatgtttttgaaatgtttcttaatgcaggaaaaaatatattggacacacttgagaatgaaatcagggacaccatgtaaagtattctgatgtattgctacaccttcaatatctaaattgattgaggcagggcctctgggaagaaagtgaaaaattcagtctgtcttccacatgttttgtctataccagtggtttccaactggagggcaattttgcttactaaggaatatttggcaattgctggagacacttttggttgtgatggctggggtgcggggctgctcctggcatgcagtgggtagacaccagggatgttgcttaacatcgtacctggcacaggacagctctgcaacaaagatgcatccagcccgatatgtcagtagtgttgatgctgagaagccctgatctagatcatgattagtgtttttgccacagccttcaaaccaggcttctctctccacaccccatgtgccagccagcctaaaagtaacttctggttcatgttctagtttgcctgtcattgaaccagtctcctccccattaggccttatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaagatctccagttagacagactttaacttcaatcccaccttggtcatttggcagcttcaaatcctcattcaagttacctattttcctgaaccacagttttctcttttataaaatgaaatgcctggcaccagtgatcctgccctagaaaacctccttcttcttaagggaataactattattatagtctgatcgagctgatacaaatatagcccttgtgttgtgaggcttatgtgagaatatatgtgaattatggttgtcagctggggctggttctttgtaatcaacaggggtgcctcaaataaatgaattacaggatccacccattaccagactgaggattgctggttaaagtgctggactccctgcctggcacacgatccatgctgtctaggtgcacctgctgttgttgctaccatgaccatcgtctgcccctctcctagttcccctgaatccagctctccaccactgccctccaggagatgcggatttaaatgtaacaaagtttagggagttggctgaaagtttcgtttttcttatagacttaagaaatcccatagccataaatttagtcacaaagcatggcttgatgagtaaagccataagagtgtattcttcttttaatcgatatataataattgtacatatttatggggtacatgtgatttttcaattcatgcatacagtgtgtaatgatcagatcaggaagattttattcttgactgtagcataagtaagcaagggtcctcttctctgggcaatgtccttcctctttacgtccattcttaaaaacgcctcatttccatatattttctcccatattatatagtggctaaagaaacatggaatagtaatggctgtgttgtcatatggaagatccagacatccagtaaattccatttttgagccattgacttaatttaataaatatttactggacattggtattgaagtactaagtattggagttaaaagtgggctgaaatataaggtgaataagacaaactacccagagcattgctaccctaaaaagcatcaactgtaatgcattgggcctttgccatgtgccttgcaatatgtttgccgttttatgagcatttttcattccaaacctttcttgcaagggaagaactattattcttatcttattcccaagttacttagagcttatacagatccattcatttggtatacatagctcctaaacaaacaaacaagtcttatagccacctggcattttgcggcacattgcgtttatgttggaaaagcatatggttctaaagtgtgtggcatacagtaaacacagcttaaggtatagtaataataagagcattctacatagatcgccccataaaagtgtcagcccattttaaagacaagaaaactgagtctcagaaagcctaaatcacctgagtccccactgttaataagtgttgaacctggcactgagctctggctgtctcctgtggtgttcttccaaatacctgatacttctgagagtcataatagatcaactcaccaacaaataaccttttattttcctggactctggtactgtggctgtagaagaaaaatctcctttccttattttagtatccaggttcctcttcatgttcaacagtaaggactccatccttggcatatttcttgcgaatgtgtctaaaactaagaaggcacatgtgccctgaagcattttctacttcttaaactcaggaatcccctttgttccagcaggaaacttgatgcctatccagaagcaaagttcacttggccgccctcaccgtggaaacgtgttgccacaccaaatgaacatccccctcctgctgtcaaagagcagtcagtggccaccgctattgacctgagctctaattaggctggttttataatgaggaaaagagtgcgattctaattagtaaatttccatctctttctcaataggtatcctccagtcaaagcaatcagctatcctcatcacactggttccattgccaaaaaaataactgtatcataaaactctagtaaaagtgatgatggttaagacaacaagagagcagaacgaggttttatttgctgctaatgacctgcattctctctcttaggtccgtggcactcaggtagttggttctgacatgactgtgacaattcagtttaccaatcctttaaaagaaaccctgcgaaatgtctgggtacacctggatggtcctggagtaacaagaccaatgaagaagatgttccggtaaaccttgggttggggagaccgggcaggcagtgcagggctgtgggaagctttctctgtgtgtgtcttttccaaacatagatctgctccccagtgaaaatgtcttggaagctgcctcctccttgccgaccatttctgtagggcgtggagtaaaactagggttggtttgaccagcactttcatcatttaatccttaaagacaccctacgatgtagatactgctattatctcccttctgtagctgaggaatttgaggctttgagaggttgactggttacacaggttcagttacacagtttatgaaaacagagccaagattcagactcaggctggtgaattccagaacccaagtttgaaccactttgctgtactacctactcacgtatggtctcttctcatctttattgagctcctaccacgtgtcagatattatgctgagagatacccccttttcatgggtgctttgtctccagcctcacctcacagattttaccatcccaatcagtgtctacaactgttggattcaggtttttttttagttgagcctaaagagctctagatggttccccattcaggggaccaaagacaaccccaggttctgtaatgatatgaatgaaactcagcctcttccacacacaggccacttcaaattgtgcttgacaggtctcagtttctgtgacttctactaacaaagagtgtgacccaacaagataacccattccatggtcaggtagctctaacagtaaggaaacaggtttttctaccatttgatcctgccaatgatcctaattctgccatctggactgacagaaagtaaggcccatctctctaccatctgatggtttgcaaatgtttgcaaacagctgtctcatcttccttgaatcttttctacctggggacaaatatctgtcctgactttatttctctctcctctaacatggtttcagctctctctctctctctcccacacattccaatttgtcactactcctcttaaagtgtgacacccagaatggatcccaatctttgaggtttattactttcatttctaccacagataagtccttgtcagcatcaatcaatctagcacatttcctgtggagtgaccttctaaggcatagaaagggaggtagaggactttggaaactgcctcatgaccagatatgtcaagaattttcccgacaccctttatggaagcgaccccactctggaatctgtgggataaatgcaaggcctcacttataccctctggggcaactttattgcccataaagggctctccgcatttctttcaaattacaatgctcatagcttctgcatctcatcatttaagagatgccttattgcagatgcaataaacaacagagaaaataatcttagtgcttttgaaacaacgcaagcacaaaacatagcaaccttcctgtgctaacaggaaagttacaggaaaaaaaaataagtaaattagtaatcaaccccagctacatagagaggtcagcagccatacccctgctttcgtcagaaacgacagtctcactcacccattctcgcaccttcccactcaaatcagatgcaagaatcgttcaggcaaagtgaaacacgtttcctcttccatacagccccctgctgtatccaactttttccttcccagacagtaaacccacaagctttatctgagtgtaccggaaacttctctatctttacaccttggctatccccctagaattccaccttggtcaaggccaacacatgaaaaaagacactgtgtgtcttagacaaaagatgaattattacacagtgaattattacacagtgcaatgacccactatttgggaggcctcaggctcaaaataggttaaatctccagatggtttgtttattgttaatgtctgacattggagtggagcaaagtggagtgaatcgggagaaaggatggataaggccagtcccttcttggacacagatgtcctgcccacacactggcttaaggtactgttagtagttactgcaacacgtaagtctaggcagacaagtagatagacagagagctagctgctcttagtcagtttgagctgctgtaacagaaatgccatagactgggtggcttatacaacaaacatttatatctcacacttctggagtctgggaagtctgaggacaaggtgccgaccaattcggttcctgatgagggctcccttcccagcttgcagatggctgtcttttcactgtgtcctcacatggggcagagagagggagggcaagttctctggcacctcttcttcgaagggcactaatcccatcatgagccccaccctcatgacctattctaatttagttacctccccaaagctccatcgctaaatggtatcacactggagtttgggtttcaacaaatgaatgtgtgaggaccacaaacatttagtccgtaacagtcctcaatctctctttttaagttttttttactgacacattgtaattctacatatttatgtggggcaatttgatgtttcgatacatatatatgttgtataatgatcaaatcggagtatttagtgtatccatcaccccatgcatttatcatttctttgtggtgagaacattcaaaagcctgtcttctagctcttttgtaatatacaatacctactgttaatcatagttaccttatcatgcaatagaacaccagaacttattcctcctatttaattgtcactttgttctcattggccaacctcttcccatcttccccttcatgttctcctcctcagtctctggtaaccactgttctgctctttgcttctatggtataataattttttttttttttttagtgtctacatgtgagtgaaatcatgtagtatttgtctttccatgtctggtttatttcacttaccatgatgcccttcctccaagtctaattcatgttgttacaaatggcaggattttattctttttatggctgaatagttacagaaacccagcttcagggtggaatatctcccagacaagagaagctttatttctcagagacagtcaaaacttgggctaaaaatcatgacatagaaaacatttgttatctaagatgggcttacaacttggagcaagtgccactttctctgtttactcctcactccagcacacaccttcacaaccaagacctgagccagtccgtgcccacttccatatggtcagataattagaagcactccactgtgccctatgttgccaagatctgatctaggagcgccagatccatgtaacaacttggacgcctagaaagtgcaattccacaaaaccaaaatcctttgcaagaccgtatttctttctagaatacagctcttaaatagttggggaatcaccacccccactcattcacccacaccctgccagatgtggtgtctagaaggcaggggttattgaacccaaagcagagggcctggaaggtgaggagctggtaaacagggaattggagccaggaacaaagaaggcggtgctgtgtctcacccctcactcgcagtgagccaactctactctgaaatggtttatcttcctgctcttcccccactgcctccggcctgtctcagatgtgcagaggttccacctccacagactcttaactttctgcacttgatgcttccagagcgtcaaataatttatcttccagatttattttgctctttagaaaatgatccagttcaatatgttatttcaagagaaaaactcccccactttgtgatttgggcttaaactttaagtttctcaaataggacagaagctaaggtctagacgcacagaggacaaaccatgggcagttgcagtttattgtaataataatcttatttgcctgcgtgcattcaagatgataaatggccggtatctcctgatggctcagcacgttactgagaatcgtttatcacaacatccatccccagaaaataggattactccaacattgctccacttatcaaaatacttttttctctgttatgaatttatctgtatgtaaaatagcatgcatacgtatcttcatgtatgagtattttcatgtatgagttttttcgtatgtacacatcattatgccggatggttttatgagtaagagaaaatgataagagggggctaaatacttagcttctatttgaggtggttatctacagtacatggtctcaggtcgggtccttaaccagggccactgtttcacaaagtgcttctgattgatcacttgggggaaccagaggagagagaatgaatggatacaggtaacaatagcacagctgttgagaaataaatatcccaaacttatattggtattgaattgagcactgagaattttctctctgcatacaggcaggagaaactttcctaaattatcttgcaaagagttcaatgaatcctccatgaacacttccaggacactcttattactaagtcaaaaagtatctttcctgcttgagaaataaaacctatgaaaaagtaagcacaatggtcagaaaaagccttttcttcttttctttttttatttctataggtttttggggaacagttggtgtttggttacatgaataagttctttggtggtggtttctgagacatttggtcacccatcacctaagcagtatatactgtaaccattttgtagtcttttatccctcccacctttcccctgagtccccaaagaccattgcgtcattgttcattgttatgcctttgcatcctcatagcttagctccagcttatgagtgagaacataggatgtttggttttccattcctgagttacttcacttagaatactggtctccagtttcatctaggtcactgtgaattccattgtttcattcctttttatggctgagtagtattccatggtatatgcataccacaatttctttattcactcattgatgggcatttgggctggttccatatttttgcaattgcacactgtgctgctataaatatgtgtgtgcaaatatcttagaaaaagccttttcttatagaacatatggtgtacacttttatgaagtgcagtgaagaggagcagaaagagtatgaatatgggactcagaaaaacccgggttcaaatttcatctctgcccatttaccaattatgtgatcttgaaaaagggacttcactggttaccttccatttttcttgatcataaaatctgctgaatagtatctgcctcaaagaactgtcatacatataaaacctgaatataatctcccaaggtttataggggaggctatatgtgaagcaccccagagaacactaaatctcaccaaccctgattagtctcagtctgcactgatgtgggcttgttcgtgacactcaggaagacttcagggcaaaggctgggaggaagaggagaacactagaaccatgaaaggctatgtcattagccgcatacattagggcattggcaacaaatggtagcagaaagttgcataggtggaggggcccaatttggtggttgaaataggaatttgaattacagaacatgaagattctcaaagtcaaatggcagcaggcagggctatattccagatgctgagcctgggaacaaggtctatcccaagggagttggcaaaagctaattcgagtgtcagggcctcagcaaaggcagctgggggattcatataggactgtaattccaggaggaaactagtggcaaaaactgagctgaggctcagaagatcagtcacatagataaggctactatggagggcttggagacaagctagagttcagttgattaatggttggatgggaatcagcccagctcctgatggccactgggaggctggcggatgcatcccagtggaaggaaccatgacccaataagactgtcagtgacaggttctgcagagctttatgtgggggcctcatttggggcataacttgctgaatcagccagtgagagtcttcagtgtcctaagcaccaactgagagaaagaaagcaagtgacttaggcaagagttttcattgcttcctgatcaaagtggaaagctggatcttccaacctctcctctcttttccatcctttcagtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgcatctgtgcagaagtgaatgcttttaattttcaatataacacactactaatcacaacttcttgagaaaccatccttcctccgcagtagacaacccaccctggataggaaaacaacaagcatttatcctctaaagaaaatgactctaacaggtgttaatgtcacagttttcttcacctctctctttctacattttattaactatattcactgaaggatcaagttgcatattagttcaaaaaccagcttccagaaactataaaatctctgtagatattttctcataaataatcttatgaaccattatggtgaatcagtggatagccagcatggagacctagcataacgaacacatgttatggtcttatgataatcacgtataggagatcctatattcatggcagacatcactgaacaattgtagctcagataagacctcagaatctttctcatttccaggtagcaactagcaattgattttaaactggcacacaatcaatagcttaccaatgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggccaaaactggaagcattccctttgaaaactggcacagacagggatgccctctctcaccactcctattcaacatagggttggaagttctggccagggcaattaggcaggagaaggaaataaagggtattcaattaggaaaagaggaagtcaaattgtccctgtttgcagacgacatgattgtatatctagaaaaccccactgtctcagcccaaaagctccttaagctgataagcaacttcagcaaagtctcaggatacaaaatcaatgtacaaaaatcacaaacattcttatacaccaacaacagacagagagccaaatcatgagtgaactcctattcacaattgctaaaaagagaataaaatacctaggaatccaacttacaagggatgtgaaggacctcttcagggagaactacaaaccactgctcaaggaaataaaagaggatacaaacaaatggaagaacattccatgcgcatgggtagcaagaatcaatatcgtgaaaatggccatactgcccaaggtaatttacagattcaatgccatccccatcaagctaccagtgactttcttcacagaattggaaaaaactactttaaagttcatatggaaccaaaagagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacaaaacagagctctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacagcttatacaaaaatcaattcaagatggatt

SEQ ID NO: 706 - DNA, 60595 bp, Human; identical to SEQ ID NO: 650

SEQ ID NO: 707 - DNA, 185766 bp, Human
ccaatttcaatgccctttatttctctcttgtctgattgctctagctaggagttccaattaatggtggtaaaatgggcatccttgtcatgttccagatcttagaggaaaggctttcagtttttttgctgttcaatatgatactaactgtgggtttgtcttatatggcttttattattttgaggtatgttctttttataccctgttttttgagagtttttatcatgaagggatattggattttatcaaatgctttttcagcatcaattgaaataatcatatgttttttatcttttattctattgatatatcacattgattaatttgtgtgtgttgaaccatccttgcattcctaagataaatcccacttggtcatgatgaatgattttttaatatgctattgaatctggtttgatagcattttattgatggttttattggcctgtagttttcttttattgatgtatctttgtctgatttttgcatcagggtaatactggacttgtagaatgagcttggaagtattccctcatcctctattttttggcatagtttgagtaggagtagtattagtttttctttaaatatttggtaaaattcagcagtgatggcatcaggtcctgggcttttatttgctgggagactttttactacagctttgatcttttgtttacttgttactaatctcttcagggtttggatttcttcatggttcaatcttcgtaggttgtatttgtctaggaatttattcatcttttctaggttttccaatttattggcatatagttgctcatagcagcctctcatggtcttttgaatttctgtggtattggttgtcatatctcctttaacatctctgattttatttatgtaggtcttctgtctttttttcttaatctggctaaagttttgttgattgtttttaatcttttcaaaaaatcagcttttagtttcattgatcttttgtattgttttcttcatttatttctgctttcatcttcactattttttcctgctgattttgtgtttgggttgctcttgcttttctaatctttaagatacactattagattgcttatttgaagttttacttcttttttgatgtaggcacttataactatacatttcccttttagcactgtttttgctatatcccataggttttagtatgttgtgtttccaatatcacttgtttcaaaaaaattttcagtttccttcttaatttctttattgacctattggccattcaggaacaggagcatgttgtttaatttccatgtgtttgtatagtttccaaagtttctcttgttaatgatttctagttttattccactgtggttagagtctcacccaaggcccacagcatgtactacctggctaccactcttgactattcagggcccaagggctctttagtcagcagatgatgaatcctgccaggactgggttcttcccttcaaggaagggtttttcttctggctcagggtgtgtctagaaatgtcatctgggcatccaggagatagggcctcagaactctgcctcatgccctatcctactatggctgagctggtattcaagttgcaagacaaagttctctttactcttccctctccactcctcaagcagaaggaaggagtctcttttggagctgtgagctgtgttgcctgtggttgtggaagagatggtgcacatgagctggtctcactaggtcacatgcccccaagttcactgtctctgagcccagcacagcaccaggactttcccaagaattgcagtccttgtggcctagactgcctttcaagtttatttaggacctcagagtactttagccagggtgataagccttgccagaattcaggttctgacttctgggatgggtgattcccttttggctagggctggcctgaattcaccctccattgagttttgcctgtattgctttctgctgtgacagggcaagactgagtttcagtgtaaagtctaacaatcactgtgctctcccttccccaggcacatagattctctctttgaacaatgcagctgctgcaggggatggggaagggatggcactggcaattcaagactgcctttcctacttcttcagtgcctctttcaccaatatgaagttaaaaccaggtactgtggtcacttacctgatttttggttcttatgatggtgcttttttttctgtgaatagttgttcaatttggtgttccttcagggaggatgattgatggaggctactatttggccatcttgctctgtctccatccatactaatttttttttttttttttttttttgagacagagtctcgctctgtcgcccaggctggagtgcagtggcacaatcttggctcactgcaagctccgcctcctgggttcatgccattctcctgcctcatccatactaattttttttaaatctgcctgggccctgtagctagagtaaggtcagagtctggggcagaactaaacatggaagcagagtctgctgctccagctcagagactagagggtcagagagttgaatgggtgctgacattgtggatccccagtgagaacttgctcctgcaaccttacaagaaaaactgcttttctacaggagaatcaccacgttacattagcagtttatttatttattttttttggaatggagtcttgctctgtcttccaggctgaagtgcagtggcataatctcagctcactgcaacctccgcctctcaggttcaagcaattctcctgcctcagcctccaggatagctgggattataggcacgtgccaccacgcccagctaatttttgtatttttagtagagatggggtttcaccatgttggccaggctgttctctttctgatcacttattgataatcttgacctaaatttagaagtaacttgggtatcactagatacatatgggcaactggaatgcattctaaactgagtaattagaattgaaataatctgctcaaaagtaggaacactgctttccattttatatttctttatttactttgggggtttctttagtgactcttccaggacttgtatgtgggttcattatttacttgacagttaaaaagttggtcagaaaagttatgtctgcctcctagtcataaatgaaaaggtaagaaatccagaggaaaaaattacatattctctcttagtttatttttattatcaataaaatgtcagtgccctttaaatgctgaactttatcatgcatatgaactttgaattatttttgttcagaagagagaaacatggaaagaaattatatgctccctcatataactcaaaggcctgatccatcaaagctagaaaagttattgtcatcttgggtgacttttgatttctcccttgttcttgtaaggcctactctcttccactcaccaatatcttctagtagcttccccctggtgatgtgtggctggctgagtagcttcttgagaacatagccattattgagcttaattgtctttcacttattattctagtgacattctattacctcaagataacatacaagtctaatttacctaagtggatactgcttttgtgtgttacattatgctttagaatttcaaggttctgaaattattttatgctttttaggaatccaaaaattaagctgttttctgttattttctttaatcttcactagtaaatgagattaacatgcatggaaatctggccttgggagaactaaacccaagtggtcacataaaacccaggaactatgtcagccttaaaaggccaatccatcattcctagcaaggtgaatgtaccacacagaattatcagagatccccccttacaaaatggtaataacaaaaatatttgtcatttttggggtactttctaggtttccttataaaatgataataacaaaagtattcatcatttttggggtactttctaggtttccaactctttagagatattattctaaggcaattaactgggaaaatagaaatagttaaaaatcactttctttgcattgaagggcttccagtataccatggtgctaacttaattctccagttttagtttccattcctctataaaaaattattttatctaatcagaatggtctgtttctcaacaaagcagtctctcaataccagtacaggatgctgattaggaaattaaaattgttcttctggagactatctttggtttttcactgaatttcttattctactggacgttttcagaacatagtgcaggtattagtcactgcagattactccccttacccctcttctgagatcttagaatgttctggatgatctgatggctggttcagagatggctgttttataagttaagagtaattcatttaaaacagggtccccaacccccagaccacggtctggttaggaaccgggccacacagcaggaggtgagctacaggtgagtgaacactatcgcctgagcagtccacctcctgtcagatcagtggcaacattagattttcataggagtggtaactatttgtgaactgcatatgcaagggatctagattgtgtgtgccttatgagagtctaatgcctgatgatctgaagtggaagagtttcatcctgaaacaacctcccactctggtccatggaaaaattatcttccatgaaactagttcctggtaccaaaaagtttggcgaccactgatttaaaaggacaatttacacaaaatcaccctcaaagtgcatgtgtgagtctagcatatgttgtagtgtacattttttatagggtgtgcatagtggcaatatgtcctctataatagagttgagatatctgctttctcaaggctagactctgagttaattaggtggagtgatcctcctgatgtgtaagacagttccaggcaagtgctatttatgcctgcttctccattggtgccagcagtaacttgactctccccttaactccctaagccttttatctctctcttactgagagctttcatcacctccatcctgtgttgtagatctagctatctactctttttctcccttcttgtttttcacattgcttgactcataatgtttgcttaatacatatggtaatcattgatattgtacagcaaatatttccagctctcagtcttctgagcagatgataagattgtactttccaccatctttggccaaatgactcactttgaccaaagaaatgtgatcagaagtgatgcaaattattttcaggtgaaatcatttaatagccactgctcaactcctacttttccttcctattcactgtgatggtatgtagagatgaagtctgagtccctgaatgactgcaatgtccagagtctcctgctgacctgcaaagtgcatgtagtttaaactagaaatatacttttgattctttgagccattgagattttggggtggtttgtatacagcataacctgacttattctgacaaatgcactggacctgtactttccaatatgatagccaccagctatatgtggctattgagcccctgaagtatggcatcttatttcattttctgttgctgtaacggaatactcaagaccgagtaatttatagagaaaagaaatttatttctcacatttctggaggctggaaagtccaagaggatggtaccagcatctgataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatatgcaacattaatgtaggtttaatgaacaaactgtgtctccatttatatgtagtttaacatttaacaaataatgccgttctcaacatgaagtttgtttgtatttttgtgtttaataattccttcttgtaattccgttagctaaagaataactcaaatctttttcaatcatcagataattgaatatcatattgtgatgttatgtttatgctataataagaaggctggggttatgcccattaaatacttctcctgatgaaattttttagcaaggtcactccttatggctaacattttcttatctttgtaaaaataacaaagaagtccctgtttgttcagtcatagttgtgacttttatttcttttccaatatctgccacttaggatatttattaaattaggcccctttgcatggggccttgtgctacaaaccaaaaggaaacagaaaaagagaaatggagctgccatgaagtccttctgcagcatcagctgtggggactgcacatgtgaggaagcagttctttggatttttagatgagtgagacagaaagtaaaataggtggtaaaaagagtcactgaaaggaacaacataccttaacaaataaagggtgggggaaacacaaagtaccaaataggctggaaaacatcttaagcacttaataaattatagctattgccatgaaagtgtacgaacccagaaggagttatggacggatgcatactaggctgttccattggctaaggagcggcaggggaggtgacacaggggaaggggaagatagatactctcatcaaaagaccatagaattagcaaaaacttgtccacaaaccaacttatatactattccatgtgcataaaatcacatattatgtgtatgtgcatagaaagatattacaacagtggttaccaaactgtagtgattctttctctgtatggtggctgaatctcaggtgacttttactttctttgttacacattttgaatttttctccagatgagcatgtatcatctgtatactcagcaaataatctgatctagcattttttcatttatgggtaacatcaggacaaagattaagaacccaaccaaaaattgtctatattatttgcattctgttgaatgctaatttttaaaataaaactgtcaaattattataaatataaaagtaatcagaagtatactgccagtacatgcattttggttatcacagaatatttaaaatgtacatgtttataggcctagtatcctcctccctgggttaggctccaattgattttctaaatgacacagggaagtagctgattcaggtcatggtggcatcttatctgaaagtgaacatttcttcagaaataaaaaatgcttttgtaagattatagaagatttgggaattatgccatgagggcacatgctgagtaatatgtttttgaggcaggctgccaagtttcgtcaaagaaaggcaagtacagggtttgttttgcaatgtctggaaaacttggaactctaatttcttggaaaatctttccaaaataaattcagtatgaaggcattctacctcaacaaattacatgtagcaagaggaaaggaaaaacaaagtgtaacaagatgtgagatgagaaaaggagattttttttccccaagagatgcgaccttgttgagttcaattacatgtctgacagcatcagagaaaacatcctcgtaatgttaattttactcaaactcctgagtgtgggtaaagtaaagaaattatccttcatcatcagttcacttttatccatctttaaaaatgtacaaaatataaggtgtcatatatccaaaaatattctgaattgctggagatcttcagcaagccgtttacattttctgggtccatttttctcctttgtctaatctggagggtttagatgtaaaaagtgctatggtctctcctaggtttaatttttttaagtaaaacaaattattatttttgacatattcacatactctttgatatatgtcagcaaaattttttccttatcaaggtctaattcttatatggtgtgaaaagcactgtggttacttcatagacatgatcgaaaactaggaccttccccattgtcccttccagttctccatacactttgaagcctttgcatggttgtcagaagggttgtagtgattgataaacaggaagaatccaactgacacaggttctgtatcaatgagatggctgtgcagagcaggagacagcaatattctccccctggcaaggataaactacccttgtcctcaagtcttcttggagctgccctgctgctggtgactctgcctaatgaggtgggagatctgctcaggttctttaagaaacacaatctgggtcttcatgaggcgagtccctactgttcccagaggctctcagccacagtagtgcatggaggtatgaactaagaagctgtagaaggatacaagtgcactttgcttggcgactgcttaccaccgtctttccttatgggcttgggagctggtggaaaccaattcagcagatttttgagtgacttttgaattgaaggtgaattctaggagatctgactgtcccaagtaggatgatactttaagcctttctgatgtgtttaccataattcaattgaagaacatttatgtatagtttattcatgaatcctacatttattgagtgcctgccctatgccattttggtggggagaagtataaaaataataaaaaagtataatttagtacagaatgactaggtactaattaaaattgagacagactcatagaggaggtaacatttcactcttagtgaaaagaagagcaagccatgaaaaggtttgatgtcaggatattccaggagagggattggcaagggaatggtggggaggagcttcacatgttcagggaaaaggaagaagtccagtgtggccggagtacatgagcaaaggggagcatgacaggagttgaggtcagggaggtgggcaggcgtgaggtcaagtgggccttgcaggccatggggaaaaatttggattttattgtaagagcagttaaccattagagggtttaaacaagagaatgataggccctgatttgtatactcttcttggttcctctggctgctaggtgaagaatggatagtggaggagtagagagaatagggaattagttatctagtcatccaactgagatgtgatggtgactcagacaaggttagtggcagtggagaaggagagaagtgtcatggctttgggatgtatttcagagtagagctcacaggacttgctgatggctgcctgtaagagaataagaaaaggcataaatcaaggaggattcctatgtgttggacttggaaaaactgggtgtatggtagggctatttatgaggagggagagacctggggaggaactggtttggagacttaccaagagttctgattttgccatattaagtttgggtggcctaatagatattgaaggaaagatatcagacaggcagcttgaattgctatggaaagtcctgggctggagatttcaatttgggaaccattggcatggatctgatgtgaattgtgaaaagataagtaaaagtttaaaccagtcctgtaattcatcttgagcatgtgctactttcagtcaggaaaaaaaagaagccctcctttatgaaatgatatggtaattattgcttactacttagagtctttgtagcagttgattttcaggcaattagaataaccacatcacttttatctgataattagagctaatttgcaagtactgatgataggctcattcactgaataaacaaaatgcagagcacaaagtttgtttctacagccatatatgtgaagttcctcttcaggtcttttgcaccacagggctgctgaattagtgcagagtttaattcagaattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaaatgcttatgacaatgccagttgttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatccctaagggccaggcacccctgcaatcccagtactttgggaggcctaggtgggaagattgcttgaggccaggagttcgagaccagtctgtgcaacagagtgagacccccccatctctaaaaatacttaaaaattagctggatgtggtggcacatgcctatagttccagctactcaggaggctgaggcaggaggattgcttgagcccaggtcatcaaggctgcagtgagctatatttgtgccactgaactccagcctggcagcctgggtaacacagcgaggctcttttcacccccatccaacaacaacaacaacgacaacagaaaaaacagaaaaaagtcccctgaagtatacacacccctaccccgcctcttacgcctctggtttctgtctaaatatttcagccccatcctcaaattcatacctttcttctccccaaccataccttcctagtacactctaggattctattacttacacagacctctcattctttaacttttcccttaatatttccctacactcttgccaaaactcactcttggctttattctaaattacaagttcctgagccacattcttcactcgtcgtcatttctttcaattttctggctctcagagtgaggagcaggagccagagaatttcctgcttcccaccagcacatccagtctattgcttgttcattgcctctcaagaacttgtgttgtgaattccactctatcctgtgtaccacacttcttccatcttacattcaactcacaccttctgctcacttctcaacctagaagagtccacttttgctgactctctctttcttctatcatctcatggaaactgctaaacactttacctggtgttccaatccctggcctcagagatctttggcctgaggacattacggaactttcctttcctttccctttcccttctcttccctttttctttctcagagtctcactctgtcacccaggagggcgtgcagtggcatgaactcggctcactgcaacctctgcctcctggattccagtgattctcctgcctcagcctcctgagtagctgggattacaggtgtgcaccaccatgcctggctaatttttgtatttttagtggagatggggttccaccatgttggctgggctagtctcgaactcctgacctcgtgatccacccaccttggcctcccaaagtgctgggattacaggcatgagccactgtgcccggccaaagaactttatttctaattcactcttgctccttataggcacaaccacacttcagacctgcttgacatttgaaactgccccttatctgaaatgatcttctcggatgatacccagttatagttctgcctctttgcaatcttctcttgggctgaatcttggctttattctcagtgtaacagcttcttgcctcatccattgccttgacatgccacactggcctcacctgcctctctactcatgtggaccgtttggtctgccatttgagctcagtttttgatagttccatggacttcaggctctgatcctattttacttgctctgcaaatctccaattctaggtatcaccatctgatttctctccgcctcctcttgtattactgagtacaaaaaaaggacatgaatcttgatttttgttaacaataaggaaaatctgctataacgttttagcatgtaactcacagtcagtcccatgattggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccaatcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacattctcagttttaatttccattatttctatttatgtaccccataagccaatcaaaatggaaatccctggctattcttttactgctccccatattttcccacctctgtctttgttctctttctctgaagaggactacccctcaactctgcaagtgaaattactgcacactttaaggtctaactccggtggcacttcttttaaaagctttcctggcctctctcatcctcagcaagaaattatagtcttttccgaattttgtagtagattatcttaggttacttgttaactctgtatgatattttttattgtagagtaaatccgcactttgttcatatgttcttggaaactgtgaagttaagtgaaaccaattttaccataggctgattgatataaaaagttaagttcaggccgggtgtggtggctcacgcctgtaatcccagaactttgggaggccgaggcgggcagatcatgaggtcaggagatagagaccatcctggctaacacggtgaaaccccgtctctactaaaaatacaaaaagattggccgggcgtggtggtgggcgcctgtagtcccagctactcgggaggctgaggcaggagaatggcgtgaacccgggaggcagagcttgcaagtgagccgagatggcggcactgcactccagcctggtcgacagagggagactccgtctcaaaaaaacaaaaacaaagcaaacaaacaaaaaaagagttaagttcctaaggcatatttctggccacaaaaacatcaccaaaactcgaaataagacaaaacacttctaacattaaacattaaaataaatgtaagctatacatacatttaagaaagatgaataaaaacaagtaagataattatttagacacttcttccaaatcagagttgtgagtgatcagagcctattctggcagctcagcgtagctcagggcacaaggtgggaaccaaccctggccaggagccattccctcccagggtgcactcagacacacacccacactcactcagactggcaccatgcagacacgccagttcaccgaagatgcacgtttttgggatgtgggaggaaactggaataaggggagaaaacccatgcagatatggggagaacctgcaactccacacagacaatggcctcgtctgggaatcggtttttgttctcatcaacataataacagagtgacgctattcaaggacctgctgtacatccactgtggattgctctgtaggcccagttttcttagtttccactaatatcatttgaacaatttttcagttgcttggtgtttgattgttttagttgtttagacttttttccattttcctgacctatgatctcacgaaagctaatagtatctgttatggacttagaggacatccggcttctgaggccctttgggactgtacatgattttgcttggaaaaagcccaaatactgtaactaaaattgttcccgtggttattttgtccaattgatatgaggttgtttttgtctttttggttttgatgcagtgttttggtagaaaaacatagcaaacaagattttactaatatcactaagttaactttgaggtacccagttgttgctaacgtagttctctacatcaccaaatattactgatcccaccattacaagacctctgaaatctatccctttctctcccttcacactgtaggggccggatttctgaccctcaccacctctctgccaccagcttcatcctactgctatctgtctgcagaagaatcatctctggtggggccacttctctgcttacgcacattttctgatttcctattgcttccagaattaagtccaagtccatttgtgggacctctgagtccctttagattcaaatcccagttgccttccccaggttcatctcttgtcacttgcttagctgtgtctcctgtccccagccacattgagattttcactactcccagaaagacccatgttcttctggggcttgaaagatccctctaatttcttcccctgacccattcccattcattatttaataaaaactcaagtattacctcatctgtggtgcctttccctacttcctcagagagcagccccctttctgtgttcctataccattcattcactcattcacatattgaaatccaggtagttaaaaagtgctgggaattaagtgacctagaaaccttagtccctggactgtaaggggctgtatagggatgtaaaaaagaaaatgacaacattgagggcagggaggggaccaaattagagagactccatgcattagaacaaactcgaggagttagtgcctgactctgtgtgtgggaatgcagaaagcggaagagaagagaacaatccccatattcctgccttgaatgacacaggtatgtggctgtccatggacacaggaaatgaaaggaaggagcaggcgaggtgggaagtgggaccagtttaactttgaggtgactttaggacatctgagtgatatgtccagtgtgcaatgggatttatggatcaagagctcaggagaggaagcggagattaagttaagtttctgggaggttccaacaagcaaatagcagttgatgttaggaaaatttctgaatttaccaggtgctccatgcccttcttttgttccgtatcatattgtatatctggtgacatagcctgctttcccataaggacactcacttattaattcacctcgtatcctcagtgtctactacactgctttgcacataaaaatttcatttcaagtgagagaatgaatatgagttcactcagccatgtcttactcatgggtgagagaatattgaaattgatccatttaataaataatgtattgagcaccttctatgtactgggaagtctcctggccactggaaatacagcagtgaaaatgatagtgggggaacagtaacacagtaaataagcaagataatatcagatcataaaaatgatcatagctaatactatggagttcttattatgtgtcagggcctgtcctgagcatttaacatgaattttaaaatttaatattcacaatatcttataaggtagggaaattaatcgagtaatatggtggcaaatggtcagagaaggctgtttgcagttataatggagctgaattgtgaaggagccagcctcaatgagatctgggggaaggatgtttcatgcacagttcaagtaaatttaggttttattaggttcgtttttgccattaaaagtaatggctaaactgcagttacttttgtaccaatctaataaaaccttcttcttttaatgtgaaaagaatacagacttttcttaatcactgcaagttgcattcactagccttcaaatactctacaccttagttcacctacaaccaatcaaactagcagtagttaattgtagaatctaaggttagggcaaaagacctttccacgtacattaagacacacatgtagcttgtagtgagtggagattggggaattttacctcatttgtactcactaatgtattatgataaagatcaacaggaaaatgatatgaaaacacatgtagaaaaatgatttagattctaaggtagattaagttaggaaagagcaaaatcataaagatatacctactttatctgctcactcaatcagactaaattcttaatggaaaagtttcttaggaacaagcaaatataaacaattactttttaattcatttttcctgatctgtataggttatttgcatgtaaatcatattgacacacaaactttactttgtcaatcatttagggcaactatgaaaagattaatacagtagttggacttttgattttccatcttgttcttacgtagaatttttgatgagactgtgatggctaaagggagggaggaagttcatcaagggcccgaaatgtctgtctgttattagaaaggagccttcattttccagaacgaatttatccatagcaatctgtaaaataaatctgtgtagaaagacgtctcaaactaggcatgataaaagttagggccatactgcaggaaagaagcttagaaggatcttctcatccagtgccctcagtttataacccaggagaggccagctgtcttatctaaagtcacaacctagaagggatgagattctgggtagcatttcttgataaacttgcatatttacttagaattatgcattttaagcttatctatgtattttaattattttaagttagaaaactgtaatatagttttaatttttaaatataattatattttattgccttaagtttaatagtttaatagtttaatttatgtgggcattttgtatttaatcatgggaaagtaaaaactgttataattcaatttgatttactgaattagtgaataaatttatttttgtctgagtttttattaaaagagacgaattttaatcaatagaatttatgtatatatatatgtatatatatatatgaaagtctaaaattggaacaaaataaaaaggtgatgcaactaggagcccctttgtatctctactgtcttttgggcttcctatttttgcattatttccacttttattgataaccaaacactttccaaatgttaagtgtataatctcagagggctagttaggaatttgctgaagagtggtagagaaagccatacttttaactatctttaagcctcctcatgctttctaagaaattaatcttctttttctgtttcccgatctcttcccttctgtctgtttcacttggtactagatcagctcttatcattcctcctgcagttgaatccacattctgtttccaggattttacgaatctcaaaaatttgaaagctactgaccattctggaaaataatcagttatgggtgcacttacatatgtaaactttaatatatcacttcacattttaagtggaccttaccattgtttttgcctccttttgtgatataaatgtggggtaacctgatctgctgagggagtagctgtgatccaaacatgtgagttgagtgcccacaaggcagggctgaagccttggaggacctcgcatccatctttagctacaagtcaactggcttctcaaaaacagaacagcctcaacaatttgttgattcaaaacttttaaatatcaatatttttcagattaatacttttatttgtctaacatttaaatttatatatttttcttagctaaatgtttgtttgcttaattttaaattggtaataataaaaattggcttataagtgaacaattttgatagattttagttcattatttagttcattatttgtaaaatgcatattttccttcccctttatccctgtgttcaaatgaggagttattatttgcttcaggaagcttctcttggggattaaataagcattttcttttcttttcctttctttctttcttttttctttttctttttcttttcttttctttttttttttttttttttttttttttttttttttttttgaaacagggtcttgctctgttgctgaggctgccaggctggagtgcaggggcacaatcacaactcactggagcctcaacctcctgggctcaagggggcttttcatctcaccctcctgagtagctgggaccacaggcgtgtaccaccacgcttggctaatttttaaaaaactttttgtagagacggagtctccctgggttgcccaggttggtctcaaactcttgagctcaagtaatcctctcgccttggcctcccaaagtgttgggattacaagcatgagctgctgcatcagggctaaataagcattttctataaaaggtttattagcataatatctggcctataggaaggatggaatttatgttagttgttgttgttgctactattattgccagaccctgtgctaggcaccgaagatagaaaggagataaaagtgtactatctcaaaaggatcaaagcctggtgatgaggcctgtagggatcgagttagaattacgattgttttctaaagatggaactttgtggctattttgtagtttgggtctggagccttctgccattttacacaccaggtctatgcatctgttctttaatgcaatacatagacctgcaaaaatacacaaaggattacagaaggtgaataaagagtagtatttccataacatagcatggaacccagcagcctctagttaaaaagttttactgtgcttcccaagttcttgatttaactttattagttgaatcttccatatgccttcaagggaagcataactgaaatacaactagcagttgtatttatattaagcttcatctagtttgttatcaaagtataatttttgctttgttgaaaattttttagatttgttttgattagtctgtgtagtgattaggcagatctgtggaaaacgggtactttccaatttcttgaaattctaaacatgttttaatggtttgtttcaacatgttttactttcaatgttttagtagctaaaggcgcattactgattagaagacaaataagctcttttgagttactttacaaattttcatttatctctcatggtaatttacaattactagagaacttcggttaccttaaaaacatttgagagtaatttttcttagcaccatagatggtaatgttgatatgtggaacaaaatcttcaatagtgactggctctgatttccaaggaagttgaaggtacattgaaaacattttcagtattaagaaaatacattaaaaataacccatttaaatatgctctactagatcctcaatagtaatagtatcatgttcacagtttattctgttaaatatttggatttttcaataatgggtttctttccttttaacagttttctcctgagtggtccataataccaacttgttaaatttgcaaaagagatttgtatttcaaatttaagtgcaagaaaaagctaatgtttctactgatgttgtttataacaagagagtgagaaggcccagtgaaactgtgagaagaatgatttatcttacttactgcattagaaatcggcctgttattacttcgttggcttctacaaaagagcttgtaaataaaatgttatagccctaattgaaaataaaaggatagtgaatggaatttagccctattcatccttttggatttaagcatgattcatttcagctaaaaattttaaaaatcctcactttcattatggtttttttttttttgtttgttgagacagagtctcactctgttgcccaggctggaatgcagtggtgcgatcattatgtacattttttaatgcaagtttaatgagtatccatatctcagattagcacagcaattttttgaggcatttagaaattcccagatgtactaccatgggcagctgaatgctttggtgcaagcgcaaggtaggatcagagcaacctagggtgaaatcctactagctgtgtaactgttgcccactagctgtataactctgagccagttggttaagcgtgtgaagtctcagtttctttacttgtcaaatggggaacaaaacaaccacctcacagggtagcttagagaagaaagagaaattcattatgtagagcatattgcagtgttttgttaattatacttggaatcctttttaaaaggatggcagtaggctgaattacattcctgcatggcagtaggctgaattcttacccagtttagtatcatctgatattgaatacagctcacttcatataggatgaagtgaataaatagtctaagccagaggagttggcaaactatagggccttctgcctgtgtttgtaagtaaagttttattgctaattaccctgatttgagaaacatgacactgtaccccataaatatgtacaattattttatatcaatgatacataaaaaagttgttttattgcagttcagccttgcttattcatttaagtgttgtctgtgtttgctttcatgctatcatggcagattagttgtggcacagaccttgtgacccataaagcctacaatatttactgtctggccttttacaggaaaagtttagctactcctggtctaagctgttgtcaggggattgcttaattgatattatgaagtgttgtggtttgcacaaatgagaggatccattttaagtgaattactgtaggaatagactacagcattacttagctatttttgggctcaccagagaagtccaaggattatctgtgattagtggtgagatcctctggaatagatgggaataaaaacctagtacctacagaagggcatttggacaggaccaaaaccttctgtggttcagtttcagagtggggagaagccagggagtgatattagattcctatatgacatcctttatcagcctacagctatggaaattgttccaagcattcattacaaagtggatttagttattcttaaaaggtctttgtgaatcatcctaaatcttaaattaaaagattgtaacccgatattactatgtagagaccctggaattaatgcattttacctggttattagagtagctgcttcaggtgccagagtaggcaaaactagacaaggctctgtgtgctgcaaatgactgaaggtctgaagccatattccacttaatttaatcatttttaaaaattattattttagagcagggtctcaccctgttgcccaggctggagtgcagtagtgtgatcatagctcactgcagtctcagactcctgtactcaagtggtccttccacctcagcctttgagtagctaggactatagtcatgcaccacaatgcctggttaattttttaaattttgtagagatggagtcttactatgtcgccaggctggtcttgaactcctggcctcaagcaatcctcccgcctcagcctacccaaatgttaagattataggtgtgagccacagagtctggcttcaatttaataattttgatagatttaacatcagatcaattgctggcctctactggaagttctgagaagtctttcatttttcataataagtaatattctaccatcccaaagtctgcttttctccttaattgatctttggggagttagacaatacaatcatcattcctgagagctatttggtgctttagagtttacaaagtgcttccatttacacaattttattcaaataacataatcaccttacaagctagaagggttggaatcatccgtatttcatactgataacaacttcaggttctacgaagttaagccacttgcctaaggccatacaactctaaagggtgaaggagggacttgatttgtcttctgacttcatatcccatgttttctctgccaagttattttgtctgatgttaactctccgccaagtttactgaaaaatagctaaaatataaagtctcattagtttttaaagtaagcatccagaggagagaacatagagaccttttcaccagaaacacgtatcatctagatcagagctggcaaactgttggaccataagtctcatctggcctgcagatgtgtttgacttagcctctataatatcggcctgtacatggctttattaaacaattacatggatttagctgttaagtaatatcacaaataagtccagatttccaacttctttagaaaagtcagatctggccacactgtgcccacattcatgcatggcagtaggctgaatttaaacagttgtctcctttggagggggcatttgctttctagtttctacaagtcactataatgccctgttgccctcccattcaaacctcacttcaatcatttagggtacctacctgactcctggaagcatttgagtttgtgatccctgatctagactaggatactcattttgtgaatgaagaagtgacattcgaagtagtaagtcaattaggcagcaccaagattacaacttgttttcctgagacagagcccttttttggatcctggcttcatggccagattatcattactgaagaataacagaacagcaagggaatagtaattagaaatgccaaaatgatgcacacttttaaataaatggatatggttttagtgagggtctgctatatattttatatttatgccatattagccagacttaaaatatttcaaacatcagactatgtattgtatgtttcagttttgaaaacatgggtcactgtaaactgaatgaatgaatttcattttcttatgttggagaagttgattggagggtgcatttttgaatgaatttcagcactgagactgagtttcagttttagaagcagaaggtgcctcatgttagataatagcacatgttaaagagaaactgagggaaagagcagtgatcggtattgcgggtatatactgagaaactgggatgagtggatgcaggagtggactagcactgtcagccacaagtaggagcatgtagaagctgagtgagaataggcagtttaaaggaattgacggtgggacctacccagtgataagaaggggtgtcagatatataaatgagctgagtgagtatagtgttgatcacttattttatttcaatggcttttgaggtacagtggtttttggttacatggatgaattgtatagtggtgaagtctgagattttagtgtacctatcacccgagcagtgtacattgtacccaatatgtagtattatttattcctcaccctccttccttctcattctgtgtccattatatcactctgcatgcctttgcctacccatagcttagctcccacctataagtgagaacatacagtatttgattttccattcctgagttacttcacttggaataatggcctctggctccatccaagttgctgcaaaagatgttatttcattcttttttaatggctgagtagtattccatggtgtatatatatcacattttctttaaccactcattgattgatgggaacttagcttggttccatatctttgcaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacagggtgtactaatttatgttcccaccagcagtgtataagtgttcccctttcaccatattgacaccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgcgtaaaacaaaatatttgatgaaaacattttcagattatgatggctgttcttattactattcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcccatgttaagttaatgttttggtggcttagagaaagagacaccacttctcctagcttgactttctgagggatgaggaccaggaatttgaactagatctgaggggatgagtaggatttgaaataccagaggaatggtagaagtttgtttagggagggccttgacttccaggctagataatttgcatttcaaagagatggtttccaaaactgaccaagtgagcttggtgctaagatcataatatacatttaaaagtgttttggttactctggaggctgaggcatgagaatcatctgaacacaggaggcggagtttgctgtgagctgagatcgcaccattgcactccagcctgggcaacagagtgagactctgtctcaaaacaaaacaaaacaaaacaaaaaacaaaaaaaaaagtgttttgggatggattactttcagtggagtttgtaaaatgcctttgtgaatagctgcgatttagaaaacagcttgctcaggagagaatcaaaaccttcctaagcagaaataacccctcagacttgcacctggagtccacttggagattctcccaggtattacttaggatacacagagactaatatacaaatgaaggaaaatgtacagatagtgcctactggtaatagattacagttggagaatcccattttgctaaagatagtattgagtctggaatgttatttaattttcagttcctgtataggcctatggaagtcaccttatattggagtctttatagagtctctcatgttacagggcgctgctcaattaccttattttgagcagcagaccacttgaggaagacacattagacctaaacgagctcatcagagctatttttatttgctcatagagatgtagctgacatgatgggtaaaaaaaaggaggcaaataaatggaatacagtttctgttattattcctagagatatgagtttgcaattgcaggtgctggatataattttaaacatgccttttaaagcaatgcagcagatattttgtggatattacaaacatacacctcaggacaaaaggaaagctaacctaatatgactggaattcaaggtgtatggtaagatttccagtgagggtatgtattagtccattttcatactgctatgaagaaatacctaagtgtggttccacatggctggggaggcctcacaatcatggcagtaggtgaaggaggagcaaaggcacatcttacatggcggcaggcaagagagagtgttcaggggaactgcgctttataaaactgtcagctctcatgagacttattcactatcatgagaaaacccacccccatgattcaataaccttccacagagtccctcccatgacacataaggattatggcagctacaattcaagatgagatttgagtggggacacagccaaaccatatcagggtagattcagaaaatgtttctctaacagtttagactgatgcaaaggtgtactttttggaaaactctttgatgacttaaagtttaagtggaaatgtagagtctggataaaactcatggaatttatagcattccaagattaatatataattttataggatgtgttatagaatatggataattaaattaattatataaccattaggtttgaacaagtattaatcctggagggagtgaaggttaattttacggtcaatttgagtgggccatcgggtgcccagattaaacattgtttctgagtgtgtctgtaagggtgtttctggatgagattagcatttgaattggtggactcagaagacttccctcctggtgaagtcgggcatcatccaatccattgagggcctgaatagaacaaaaacaaaggaaagagaaactcaccctttcgcttcgtgccttcttgcttgagttgggacctctcatctcatcttctcctgtccttggactgggatttataatttggctcccctggttctcaggccttcacacttagactgggaataccactggctttcctgggattccagcttgcagatggcagatgatgggatttctcaaactctatagtggcatgagccaattactcataatctctctctccacttccctctctcattctctcctttcctctctgtgcatatataacctcctttggttctgtttgtttggacaactctgacaaatacagatggtcattataaagcaactttatttttgtcacccacttttgttcttttaaatttattctgtgctcctacttattattgttctggtttgaaatttagacacagcctcatggttcttccagtcacttctacttccactggaagtacagtctgcttagtatatttattccaaacttcagaatttattgaagttaaagcttcccctttctcccagtgcaggactgctgcagacgagccctcattagtgggagatgtgctgagaagcccttctctttcccactcagtgcttctacttcctctcatcctctcctagcttactccccttgaagcatggtggggtatgtcatcagagtgaggagaggttggagctgaaagcacccactgtcttctgtggggcctggaaatctctccctcaccggagatcgctcatctgtgcttgtcttccatgggtgaaaacatttctcctggttcgtctctcctgatgctttgctcagctctgcacacaacttcagtttccttttgatgaggccccttgcttgcttctcagcattcattttttttttttatgattagcaagatttttttaattatactttaagttttagggtacatgtgcacaatgtgcaagttagttacatatgtatacatgtgccatgttggtgtgctgcacccaccaacttgtcatttaacattaggtatatctcccaatcagcattcatttttaaaactgtggcaaaatatatatattacaaattcatcattttaactattaaattaaattaatttatttttgagacagggtctcactctgtcacccaggctggagtgcagtggagtaatcatggctcactgcagccttgacctcatgcgctcaggtgattctcccacttcagcctcctgggtgtctgggaccacagacacacaccaccatgcccaactaatttttgtgttttttgtagagacagggttttgccatgttgcccaggctggtctcaaactcctgggctcaaccaacccccctcctcagcctcccaaagtgtcgaaattacatgcatgagccaccatgcctggcaatttcaagtattttaaagttataattgtgtgattttaagtgtatctatagtgtagtgcaaccatcacaccacacatcttcagaactttttcatttccccatactgaacgctgaaactgtactcattaaacactaaccctccatttgctcctccctccagctcctggcaaccaccattctcctttctgtttctatgaatctgactactctgtaacctcacataaaataaatcatatgatatttgtctttatgtgactggctgttttcattcatgttgtagcatgtgttcaaaattttcttgtttttggaggctggataatatccgcattttgtttattggttcatcttttgaagggtacttgggttacttccatcttttagctgttactaataatgcttctgtgaacataggtatgcaaatatctgtttgagtccctgttttcacttttttggggtatatacccagaagtgtaattgctggattgtatgacaattccatgtttaattttttgaagaactgtcacactgtcttccatagtggcggtaccattttacattcccatgggttccaatttctgcataccctagccaacacttgtacttttctgtttttatttgtttgttttataatagcaatcctaatgggtgtgaagttgtatctcattgcggttttgatttgcatttccctagtgactggtgatgttgagcattttttcatgtgctttttggccatttgtatatcttctttggagaaatgtctattcaagtcctttgcctgctttctaattagattgtttgtttttgttgttgagcatcagcattcttgggtaggatttctggtgaccctgtgctggtccctgtgtgctccatcatcagggtcagggaagcatacagatggcacactccagtggaggaactgaggagagcttggtgaagagattattctcagaagtgtgggcagtgttgagatactaacaagggatgttgaagtgccttgtgtaacagtgtagagtcattatcacccctgggcctgaggggacaaggagaaggcatgaggacagagagcctagagagagctacatctgcaggagaggactgcccagcagaagctgtcaacttctctagaacctgtgctaacccagcagggagaaaactggggggataaataccccattctctctccccttccttgttcttgtcttctgcaggtgcctcctgttggacaaatgtagctggaagtctgtgataatttccatcaaggtcagtctcttgggcatagagcaggatagtaacaggtggaggctgggtctacagtggtagacaagatatatccagcacatgagtggaattcctctttggtccacaggatcttctacccattgttgggagtgcagttacttctcaaaccacaggcttttctctgctgccctaggctgcttcagtgagtcacttaccctttagggttctcaagagtgtgagttagtcgccattccaccacaaccaggaagcatgtgagctctaaaaattccactgaagctccttactctaggcttgaggtgagggacaaattcttccccaaattcttcttgcggggaagatgagactcatagcacaccagtaactttctccaaatagtcttctgtaatctccaactacctagacttttatgccctcagtagagatgaggagaagggtaaaatctaggaaactgcaatctttacgcagtcctttcacacctcactgtgaaatatgctggctatgggctaggaactttagcagaaactggggctgaattggttgtattttaacatcctgtaacaaacatcatatgcagtccatatccctaaaagtttgtatattttggtaaatataaacacatttttaagaaagtcatctgagtcagaaatgggaaagattgctttatatttgggattacttcatatttggggatataagatatgctttctttgacattttcccaatgtagaaacacaggccaaataggataactcatgaattccatgaaatttatccaagtatctcttagctttaagtagctaaaacctaaattaggtaaatgaaaatatttcaacatttggtaaggtgtgcctaaattaaagttcacactagaaacattcttgtttaatttcaggtgagttcagtagagtagtttccttggcataaataatttcacatctaactgtttatacttttaaatgtattttaattgtgaaggcctaatttctgaatttagtttagaataaacctctagccattttctttcttatgtatgtgatccccaaagcagacgtgtcctaggcatcagttttcttatctaatcagagaaccagtgaagaaaggaggaacctgtcatctccatgcagaagcaagggattaagtgattaagctgtcatttctcaaagcctttctccaatgcttgccccataagttttgggttttaaatgagtttagtggaattctgcagtcttaacatatggcacatatccatgacttcagtaaattacaggtactaacttttgttctttctggtgcagatgtgttatcattttgctctgttttgttttataatgtcagccttctctgtgttattaatgtagtgtcatgtgctaccattttaggtaaaaagctttttctgttatttcctatgaatctcctaggaatggacccatttggagaaccagactgttcattctttcctttccctccttttctcttcttccactccttcaaagtattggttgagttgctatattatgtgtcacaggcattgttccaggtgttggagaatctgaaatgaaacacaaagtccccctgctccaggagcttgctatcgccatccaatggaaaggaaagcaacaagtaaataaaaactgccacatgatatacatgtcagacaggagacacatggtataatgagaataccacaaaggggcctaatggggtgacccaaggtgggtcctgagggtttatgaggcaatagttccataatcaaggagaagaaaggcaaccctgggcggagagcacagcatgggaaggccaagaccagggaatccctggcatttgagcagtcaacaatctcagcgtcagccatgttcatggtgtggtacagtggtacttttgtggaggcatacattttaaattcatgccctgggtggccagtgtacaggaggaaatcacttaatgggggggcgtgtgcccagctggctgctggtatctgcttctttgtttggctctgtcttttgcttgctatcctagatgcaataactcctatgaaatgaaagcaagaactttctgtcttagtgacaaatggtcatcttatgagagttgaaaggttaaattgtcacatgagtttatgcacaggaaatgtgatttgggggagaaacaagtgcctctgcaaacatttttgtatttgggaagtggggatgattgcaaggtttatgcctgcagcgacagggagggggctgcatacatcatgttgtgtgaagagacggggcattggaggaagagcaggtttgttcaaggtgacgggcaagagggaaagggaaaggagggagaagaaagatggaaggagatgatgaattctgttgagtttgaagagagatccaggccagaaatgctggttaggaaggcattggtgctgcatggtagtggaagtcacaggggtggactaggtcatttgaagaatgcacagagagatgagagggctaaggaaaaatctgaggaacagcacagggcatttttagggtagtgaaactattctgtatgatactgaggatatggtagataaatgacattatatagttgtcaaaagtcatagaactacataacacaaagaaaactctattgtaaactttggaatttagttaataataatgtatcaatattggtttatcagttgtaacaaatgtaccaccagaatgcaagaggttaataataggagaaattgtgcagtgtggggagaggtgaatattgtaggagcactgtattttctgtaaacctaaaactgctctaaaaataaagtctattaattaaaaaaaaaagccagtgaagatcagttatgtgcatagcagctatacttctgcagaatctccttggtgagcgtgcttttttcaggcttacataatacagttaaaagaaagaaaaataacactcccctcacagagaaataatcagctgaacaaatcactagttatcagaatgcaggctgtagtacatcctgtttttctaactcctctaaatttactagtaaagcaacccaaattgcatggaggaggggaggtcattgcttgctgtcaaggctgcactaatgacattagggtggcattagcgtaccagggctctcctagtcctcactacaccacattttgaatgagttttgcttggacaagtgttgagggtgaggtggcgggagagggaaggagagagatagcttgtgctttgtcctattacctgaaccagactcaattgtcaaacatttttagtgtcgttttcctgtgctcacggaatcctgagagtgtagcactactgtggggagggcaggagccaacaggtatagctggcttatcccagcatttcttccttcccatctgtgcacagcgtaagtggcacagtccacagagtccgctcccattttctctcttcccccttaatggggcgggggcgtgagcccagctggctgctggtatctgcttctttgtttggctctgtcttttgcttgctatcctaaatgcaataactcctatgaaatgaaagcaagaactcaaagctcaagtggtcaaagctcaagtggcagccaagtggtttcttgtgatctgctgaggtcggcttctgataattagaagtgacaggtgatgactatgttatcataacctgcagccacaccaccttcttctggttctgagacaatgtgtagtagaaatggttatttgttcatcgagctggtccccacaattcacacccaaagaggccttttcatggccctgcacgcactgatggctgtttcaggtagacaagcccagcagtgtgggaacccagatatctcccattctgtgtgaaggagctacctagtttctggaatttaactagattagaacctcaagtgatgcattataggtctgaagaagcatgccaatcatgacctttatcttccattttatgaacccttggagtggagcctttagaaagaggaaacagcagagagagggccttaccttgtggcccatgtggtgacattttaggagctgcaaaaagggtccctttgcctcccaaaaagttccctgaggctgattcattcaattctatatttaatgtttcatttagtaacactttagattgaggattattgttttatgttaaaatataaataccttctgggtattaactcttttcagttatagcctttatggtaaaggagttgccaagggctcagaatttgataaggcaaatggaggagaaagcatgagggcttagtgggtgggagtggtggagagtgatatggagcgagacagaaactgaaaactgaggccagaggagaagaaactgtgcctatttattcagtttttcctgggagtttccttgagaagaatggagctatgtgtgtgtgtgtgtgtgtgtgtgtgtgtgtgtgtgtgtgtgatatgagattgcttgtgcgcctgtgtgcatgtgtgtatgtgtatgtgttgaacgatactgtggaaagtttgggataagaaatgataactgggaagagccagacatcgaatgcaatattctcaactaacattcttcttagaatgatgcttggttccctggagactttatgatcatgagtgctaaatgtgtgaggggtgtgtgtagggaggcagaaacagtgatggtttcatagatgtccaagttgctgctacctttgtaaaatcattatttgtcccttcatctctagcctgttaggtaccaatgtatttattgcccactcgaactacttcctctcatcatgggggcctcctgtttttgaggcaacataggaaattaggactgatgacgctgcatcagaaaagcttttgttttcacttggtttaagtctgatagagaagttggctacatagaacctccacaggcagttgctccaatgacttaaaatgaatttgtccttctgcctcaactctccacagttagcatgtgctcattcacccactcctttttatggcccttggattcacccaatccaaggtgaactacttccttacttctatgtcttcactgtcttacgatcttgatcaaacagacaacacactcaacgaaggtgtgggtgggaacggaacccacccacatgattgtgaatcacctagagactggcagcagaagaaaatcactgccaccctaagccttgagtggccagaggagagagacacattcattttcagaactagtgagagctacagctctggtaaggaacctcccaacaggagttgtggccatgggtaggacagctcaagaccataagctggcaaggaaagatcacagaggaaccagtatcctgatctttctctattcagctatttcttcccattggtggaagcccaagagaaacacaagaccagggtccctaaaggtcagcttctcaaggcacagagcagggcacagaaaggtggtgtgtcatactggaggggcaaaaaagctggcaccatctcactttctgcatgtataaaatgaagacgtaaactgccaggattgaatgtgatctacatacaatcatttagcacagcacctggacaataaaaaggaccctataaatgtagtttagtagtagcagtgatagtaatattagaacatttttactacattttagctatatcataagtaagtggctctccctgtagcctaataattaacatcccttatcatatcctaaaatttgtaagaaataggcttaagtgagacttgcttgtttagtgatattcatacctgtagatgtgaatgtatagctacatgcttctttaatttggacagagagaaatgtagagagttgtgatttcatgatttcaattctacagaattctatagattagatgtatagggcgttgctgccctaatggataccataacaaagaaataccccatcttttcctctctccatgactgagcatctgccttagtgcagattctggaaaggaggggatggaccatgaaatttaaattgcatatatagatgtggctatggaaatcatatagaaccaacattcctccctttcttccctctcctacatattgtatatgtaatacgtatgtgtgtgtgtgtgcttatccacagaatgtgtgagtttgaggaaaaaaacaagataaaacacattccgtaggtagtgcagtcacacatagctgaaaaacctgtatcagttatcaattatctatttgtttggagcaaattcctgcaaatcattaaatatacaaatttccactttcattgttaaattacccaaagtataatctcaaataacctctgacctcctggagttgatgacagttttatactgaaaatagaatttttttttgtacatctatagtgtatcttaaattacctaaaagaaagatgatgccagggtagttaaggagggaggtttcagttttggccaagtttcgtacatcttaattgcgatactttgcaccccatggatacctgtgagtgcaaaaatgtctgctttgtttggacttatatttatttttattgtcttcccacttttattttagattcaagggatacatgtacaggtttgttatctggctatattgtgtgatgccgaggtttggggtacaaatgatcttgccacccaggtactggtcatagttgtttgtagttttagaagaaaaaatgaatgagactcaatttaacactggtaatatcccttctttcccagggaaatttagtgagttgaaagttgcaagagtaatgctgttagtgttagtcacttttcaaaagtgttttgccatttaatattcatttttggggtcttctgtgtggtcatgtgggcctactatattatactttgaagagatcagtgaagtcatatggtttaaagtttcacttgatgaatgagcaaactggtgttcacaggggcaaagtgacttattcgaggtgataacactggtgagctggagaacaacctgctatcactttatttcccttttttttttttatcttggagacttttattgaaaggaactattcaaacttttcaaacttttaaggtccatatttctgagttctgagtgttctaatttgattattcataaaaaatatgcacagttcctattctcatggagcggatagttgatttatgaatatatgtgtatgtatcctgttaacgagtcatcatgactaaattaacttagttaagctacttaacttttcagagccttaagtttcttataggcccagcaagttttattggaaaaaaatgggcttcgaaggcagagagatgtggtgttttctgtttactagctgtataagtaactcatagaggaataatagcctcctcatggggttgtttagagggtaaaatgaggtaacctacatagaatacctggtttatgcattcctattgtatctgtaagttggagatgacactgtgcaacctatttaccacatggcattgtgattaccatggagacaatggttggaaaagggcactgtgaacagtgaagtgctgctgtcacatcacttattgagggattttttttgtttgcttagttatttcaacgtaagctttctattgagggacaacatgcacacagaaaactacacacaagagtgtacaactctatgaattttcacaaagtgaacatacttgtgtaaccagaacctagataataaaagagaacctcctagaaagccccaaggtacccttttcccatcactacctcatctcaaagataattatcctaacttctaactccatagattaatttctcccattttggaactcttaaccaatggaattatacagaatgttctcttccctttctggcttctttgactcctattatgtttgagaggttgatccattttttttctgtgtagttgtggttcattcattctcatggctctagagcaggggttcccaaaccccggtacggtctgtggcttgttaggaatcaggccccacagcaggaggtgagtggtgggcaagcgagctaagcttcatctgtatttacagtcactccccatcactcacattaccacctgagctctgcctcctgtcagatcagtggcggcattagattctcataggagcgcgaaaccctattgtgaactgtgcgtgtgagggatctaggttacgtgttccttataagaatctaatgactgatgatctgtcactgtctcctatcacccccagatgggactgtgtagttgcaggaaaacagctcagagtttccactgattcttcattatggtgagttgtataattatttcattatatattacaatgtaataataataaaaataaagggcacaataaatgtaatgtgcttaaatcatcccaaaaccatctccaccccctggtccatggaaaaattgtcttccacaaaaccagtccctggtgccacaaatgttggcaactgctactctagagtgtcctattgtaccccacaatttatgtatctattcttcagttgatgggcttgtgggttgtttctaatttttggcttttatgaatagtgctgccatgaacattcttacatgtgtcctttgagaacatatgtatgcatttttgttgtatatatatcttgaaatcaaatttctgggtggtaggatgggtatacaaaggtttgattttaataaatagtgacaaataattttccaaagtgtttgtaccaatttacatgactacaaatataatattttttaacatctgtaaaattgttacattcatagtgggatatacaaaaatacagcttgaatcattgaaaactgggtttatgtttttctcttttgttgacattctattttagttatgttcttagattgcatggaatacagcctcatttccagtaacttagcttgtggggaagaagggtgttattgtaaagattcttatgcatataaactcagaaaaagctaaacagtgaagctttaaaaaggccagaaaaatgtacaggtgccaggctgtgggatcttgagtgttctgctctttaggattgattctggtatcctgagggtctgtccatccttgtgggacctgtattctgcaggcaggtaccataaggtactgctgtaggccagcatcattctgagtgagcatctgttttgtttggttgctcttctaccatgcactttgttaaacatttggtcatcatcctgcttaagggaagcccatatttgcaatcatttgtcaggatttccagccctctatgtgaactatgttaccatttctaagcaattaacttctggaagctacctgctctcattggtccctaaggagtagatggatgtactgtccgcccttctagatttagaggttgttagatactctgtatttatactagatgctaaatgaactacacagaatcataagaaattcataagaaaactttagcaatcacaattttttaactaataatgtgagtttttaaataatagacataattcttaatgtaaacttctactaagactactttacaattttttttaatatcttaaaaaacaaggggcacttcttgccattttgtgctaacttagtctttattggttgaactagtgctaggcaaggaaggaattagctatagggagcagggaagacagatctaaacagttctgcacttatgagcatattagtgaataatagagatgctccttatggaacccaggcatgaaaaccatccttggacctgtcacatcttggaattatgtgctggactcttgtattggttcgttgactttagttgtagtttaggaagtgatagccagaaacttgaactcttgcttctagcttttagaccttctacttaagacagaagaactatgtatttcacctcgtctaacttctagtatttcagataatttcttctcagatacttttttttggctcaacctatgcttaatatttttagctaatgctcactctgtcatcattaaagtggtttgcagaagaatatatggcctacgcagaagaatatatggtctatgcaaataacttctcactgtacattctctatacagacctatacaaatattttcataaaacttctgagctggaggtggaactattacaaagtgttgtggttgaaaaaggttgatggattgaggttattcctcaagacctctttccaccacaaaactgaatatcctaattagagaatccattagaaggaacttgaccaagtctgtggcttaatttatgcctcaaagtgaagtgattaatattattcaatgcatgcataggaccagaaattcttatttgaataagttattcaacttatagggtaattaaaaactgaaagtaaactgtcatttcactgctatattcctatatattaaattaaactttaaacattatttaaggattcaatgtaatatatttagcttttttttttaaaagcaagtctggaagctgggccaatttctacaaatgttctgctcagtagctagccttttgtggaaactcaatagatcttaaacacttggttcatttaaattactcttctttttgctttcaggaaagattgagaagagttacagggaagtttagtggattagtcattcagttccttgatggatcacttgcatgtgccaatgccagggaacatttaactgattaaaacattctgaatgaatttgtcatttgggggtactctttgaatgaatatctttattgcattgactgtgtcctactgatatgacttaggcttacttccaacattaattctaaagaggctctggctaacttatctgtagaatgtgtgtccaagtcaagttcgtgatgtatttggttaaaaaaaactttgtggctcttgaaagaaatacaaagatttagtagtcagtattgtttataaagtctagggtggtcatatttaaataataaatctaagaattagatgagtactgttacacatttttgttaataaatcttaaatactggaaagaatagacttaagaaaaatattccaacattgaaaacctaagtatctaaacatatttcagtctcatatgccaaaaaatatgaaattatagcatttttggtcaggataaacgcctcctgcatctttttgtataagaagtattttgaatgaaaatagacttgccatgtcagactatttgaaatttaagttctgttttcaattttaggttcttaaaaaggtccaacttagccaatgaacataaaagtgcttactgctaatttagctgctgctgcagaacatgaaaggaaatcatgaggccattaacacatctagaaatagtcattttctagctttcggttcctaagatagcttagtgaaaataaaatattcagacaaggcagggtagggaggtgagtttttaaaggattttctttttaaactttccttccttccaccctcgctccctcacttccaccctcctttatttctccttctttatgtgtgttaacttagaacttcacttcaagattttccgagtgctaagtgataggggcagtgagatatacgctttatctccctgcataggcaatgagtaaaaaagatgtgaaattatggcaaattcaccagcagatttcaaaggtgaaaatgcccttcttgtaccagggttaatatgatctccagccatccattcacagatcatgctcactctgttgatggcaaaggaaagttctctttgaggccttgaaatggaaactgcacatcgtgcctggaaagtccctccaggctagtgttcaagaagtctttctttcacacttcagtttcttcattgcattatatttactgactgcctaccctatgttagaccctgtgttaggtcctgcagtcctgttcacaaggatattatagtcttgaggggaaggcagacattcattaaagactcacctcagtgttgacgggcagactgcaataaaaaagtatgcggcactgtgaatgtgtaacaggtgtgggcggtggtcagggaaggctgagactggttaactgggcagaggcaaagggttgcaggcaactcgcctgaggtggagaggcaaggctggtgacaggggcagggaggccgtggacagccgatatcacaaaaggcggtgctgaaagatgcaaggggactgaggacttctttttagctgagcaaacagtgcacatttcttccactcagacttttccttttctaattaaaaaaatggggacatccacatcttgataacacagttaatgtgtgaatataataactgcttaataaatccttgttgaaataggaatgctgattaaggcacttaggccagcagctgaaggaggcttaatatattcagagatgattcctaggtatctagaaaaggatattttaagctaagagaaaagagggacagttcaccagtttcttcccttctagggaaacaacataaaaggactggagttgttaaaagacagggtgagaagtctgttgacataaaacatgagaaaatgaagtttgtgatgttttgatgcagaagtaagttatcattattgttgagtgataatggcattaattttctgaagatgggcagctcctttcatcccatttaatgtgtatgtgtgtgggcatgtgtgcttgcatacctaaggctaaattaatttttggtacaatagggtagggttgctagatttggtaaatggaaatacaaggcatcaagataaatttgaatttcaggtaaaggaagtataacttttggagtatatatatatgtcccaaatgccctaccagagtggaattttcctcttaagaactctggaggcgtgttgcctcatttcccccatgtttttagtcattgcatgtataatgtttatatttatgtttattcgcagtttatttttgccacatatatttttagaatctaaattttcccaatagtctggaacctttggtgggtgtacataatgtgatgaaggattctcttcctggagaggctgctgatatatagccaagattctgtctttgtgctctgggcttctgtctctgtagtgttaatatttcaagaatgagactagagcatttttcttactttagtgccctttggagcaacagaaagctgcctttgctgcaaaggaccctgtggaatgattgttgatctgccttctagaaactgagctgtgcccaaaaccttttaccagtttctaaaggcacctgctttcattttcctaggaaggttctttaggtgagcgatagtcacccctatatctctgcaataccaagtgagcagcttgttgtgtgtagataccatgaaatagaaacagattcatgaagataagattagaaggtaatctttagattacagaaacagattcatgaaaataaggattagaagttgtgaatgaaaacaactgttgctttggatggctggatttaaaaatgttcctcaatattgatgatgtggtattttaattaaaaaataggatcagatcatgacacatagaagaagctataatatgcacaatgatctgcttttccaggaaatgagtatctttggggatcagcattgagctcactacacatgataaaaaataaaactcattggaaatctagaaattggcaactaaaaattgagtcaaaatgtgttttaaccaccccacccccctcttgtttgtttttattcacttctgataacctactggctgtttagttatattttatggttgttttggctatcacaaactcatacagaatagctggaattatcagtctcaacagggaccatgaagacatatgtgtgtaattcagtacatatattaaaaaatagctaatttacaatattacaggcacaagggagcccactgatgtgaagtttcagtgaaacagtgtaaagaaatgatgttagttaaatatcactatttctcaaagtaaaggatgtcattgtattagtagaatgttaaccctctcttttatgggtcagttacatcaacttcatcataaaccctcttcaaaaaacatgcattttaggacttggatatagtcaggtctgtgtttcattaagcatttgttcagattccagctctcttgctccacaaccattgatatttctcaatttatctataatttacaccctgactgtctccataaaagatataatgtttataaggaaagatatatgcaattagataataatttgaatgcttttacagggagagggaaataaatatgccacccaaacctaggctaatacattcattgaaagcgagtactaataattatttctaagcctcccagcagccaaggcaaaaagggactccagtaacataacatgatcattatttcattgtttacttttactactccctattccacgttgagattgttagagatatgttagtgatcacctcaagtcttattacctccagaaatgtaaagtttgacttaaaatcacaatgaactcttccaatttttttcatactatattgcatgtgcttaagtaattctttgggcttggttttagatttttaaaaattatggtaaaaagcacataacattaaatttaccatctcaaccatttttaagtgtagggttcagtagtgttaaatatactcacattgttgtgcagcagattgctacaactttttcgtcttgttacactgaaactctctactcatgaaacaactccccatttctccttctcctcagaccctggaaattaccattctactttctgtttctatgaatttgaccactttagatacttcatatgaatggaatcatacagtgtttgtcattttgtgactatttcacttaacgtaatgtcctcgagtttcattcttattgtagcatgtgacaagattttcttttttttttttaaggctgcataatatcccattgtatatatttacattttccttacttattcatctgttgatggacatttggactgcttctatctcttggctattgagaataatgccacaaggaatgggtgtccaagtatctcttcaagatccttttctgaattcttttggatatatacccacaaatgggattgttggatcatatagtaattctattttgaatttttggaggaacctccatgctattttctgtaatggctgcatcattttacattcccaccaataatacacaagggttccatcttctctacatcttcaccaatgcttggtattttacgctcttttgatggtgaccatcctgatgagtatgaggtgatatttcattgtggtttttatttgcactcttctaatgattagtaatgttatcatcttttcaagtgcttatgggccatttgtatatcttctttggagaaatgtcagtttaagttctttgcctattttagaatcaatttttttgttgttgttaaagtttcttatatattttggatattaaccccttttcagatatattatttgcaattattttctcccattttataggttgcaatttcactctgttgattgtttcctttgacatgaaaaagtttttgtgtcattccatttgtttatttttgatttcgttgtctgtgcttttggtgtcatatttaagaaatcattgctaaattcaaagtcctgaggctttacccctatgtttctttctaggagtttaacagttttaagtctaatttttaggtctttaattcattttgagttaatttttatgtatggtacaaggcaagggcccaaattcactctttttgcatttgaatatcctatttttccaacactacttgttgaagaggctgtcttttctctgttgtgtggtcttggcactcttgctgaaaatcatttggtcatatatgcagtggtttatttctgggctctctattttactccgttggtttatgtatcttactttaggccataccacactgtcttaattactgtttctttgcagtaggttttgaaatcaagaagtgtgatgcctctgactttgttctttttcaagattgttttggctcttttgggccccttaagatcctgtagaattttataattatttttctgtttatgcaaaaagtgtcattggaatttttatagagtttgcattgtatctgtaggttgctttgggtattatggacaactttacaatattaagtctttcaacccatgagcatgggatgtctttccatttacttgtatcttctttgatttctttttgcaatgttttgtagttctcagtgtataagtcttttatctcctgggttaagttttttcctaagtatttaatccttcttgaggctattgttaacagaattattttcttaattttctttccagattggtcttgttaatgtatagaaaatgcaactgatttttgatcatcgattttgaatcctgcaaacttttctaaattcatttattagttctaacatttttgtgtgtgtgacttaaaagaccatgtcatttgtgagcagagacaatttaggttcttcttttccaaattttaggctttttatttctttttcttgtctaattgctctggtaagaacttgtagcaatgtatcgaatagtcgtggcaagagtgggcatctttgccttgttcctgatcttagagtaaaagcttttagtcttttctcatcgaatatgatgttagctgtgggcatttcatatatggcttttattatgttgaggtagtttccttctattcctagtttgttgagtgtatttatcatgaaagcatgttgaattttatcaaatgtcttttctgcattgattgagatgatcatttggtttttgtccattttcttaatttggttattacattggttaatttttatattttgaactattctttcatttcatttataaatccctcttgatcatggtgtgatcaacgtgtgcttgaatttggtttgctattattttgtttagggtttttgcatcagtattcatcagacatattggtctacagttttttttgtgtgtctttttctggttttggtattaggataatgctagcctcatagaatgagtttggaattgttctctcttaatttttttggcagaatttgaggaggattggtaatcattattcattaagtatttgatacaattattcagagaagccacatggtcctgggattttctcttttggaaggttattttttttttttattactgcttcaatctcctcactagttatagatctgtttccgtcttgataggttgtatgtttctaggaatttgtctttttttagattatccaatttgttggcatataattgctcatagtagtatattttttattgctgtgacatcagtggtaatatctcttttttcttttctaattttagccatagagtcttctctcttttttctttgttagtctagctaaggatttgtcaattttgttgtttttttgggaaaaccatcccttggagtcactgattgtttctattctttatttgatttatctctactctaatttttatggtttcctttgctctgctaactttgaatttagtttgtttttctttttctagttactgaaggtataaatttaggttgttgattttagatcttttttcttttttaatgtagatgtttactgctatgcacttcccttttactactgctttcactgcattccataagttttgtatgttgtgtttttcttttcacttgtctccagatattttctaaattatcttgtgatttcttcttagactcattagttgtttatgagtgcattgtttaatttccacatattactggattttcctattttctttctgctattgatttttagttttattttattttgattggagaaggtattttatatgatttcaatcttcttaaatttgttaagatttattttgtggcctaacatgtggtctattttgggaatgttccatgtgcgcttgagaataatgtgtgttctgctgttgttggatgttgtatatatatatctgtagacccagttggtctgttgtgttgttcaggtcctcttgtttccttattgatcttctctctgattctgttgataactgagagtggggtattgaagtcttctactattatcatattggtgtctatttctctctccaggtctgtcaattttgcttcatttatttaggtgctgtaatgttaagtacatatctgtttttttactgttatatcttcctggtgaattgacccttttatcattatacagtattcttcgttgtctcttgtgacaatttttgtcctaatgtctactttgtttgatacaactctggtcacttctcctctctgtaggttcctgtttacatagaatatctttttttaacccttttactgtagcctatgtgtgtctgtaaggcaggttcactgattaccaatcagtaattctaatttctatcaattgtatgagacagaacactcaaacaagttaagtgaagcaactttataggcacagttaggcagcaagggacaacaaaagcctaggattcatagttccccaaagctcagagtgaatggaatctttctgtgtgttacctactttgcagtgcaggtgaagaactttgaaagcagtctactctggattgtatacccaggggcaatggggattgctgggctaaagtgctgcagggcatcctattcttggagggacaggaacagagcccaagctgtttcagatactttctccttatctcaagatgctgcactcctaatatatcctacagttatttttgagaactacaattgagaaagtggggaagagtgcagtcagtcaaggccatcttggaattcgttctgcactgtctctagtgctaaattgagtctcttatagacacaacatatggttggatcttatttttttaagtccttcggccaatatgtgtcttttaattggtgcatttaagctatttacatttaaggtaattactgatagggaaggacttactattgctattttattgttttcttattgtttttgtccctcatttcttctcttgttgtcttcgtgtttcatttttttttgtagtgacatgttttgattctcctctcattttcctttgtgtgtagctgtgtgtatatgtgtatatataaaaatttatatatattacatatatataaaccttaacgagtttgagtaagaagcagttcatgaattgggaaacaccaaactgaaagaggtttagtgttctgatgacaaagcataccttacatatattctatagatagtttatttgtggttatcattgcaatgagataaaacatcttaaaattatgacactgtattttaaactgataacaacttaactacaatcatgtagaaaaccttttacatctctgccccctcccagtttatgttattgatgacacaattatctgccgtcatatttcatatccatgaacatagatttatcattactttttatgctttattaaatagattttaaaaatctataccagatttataagtgttaatttttctagcaggctttgatatggttggctttgcacttgcctggggtgcaggatccttttaactggtttctagatttctctcaggggcattggtccattggtcatttttaagttcatatttttgtggttgaaggggagtccagggcttcctattttgccattttaatgttatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttttgactttccctaggaaaatctgagaaagcgtatcataggtggtctgaatttaaggcaaatatgggtggcgattagaccaattatagacaaacatataagaaagctgtgagaatgtgtgtgagatgaataattatgaaacaccaatgaaccagtgcagctggggatttaaacatctaagtgggcttaatgtatcattttatatagctgaagtaaattaaaacaatattttgtgtgaacattaaacttttcttcctttggtatgaatactctggggatttggaataagcatgattattataattcacacctcttttaaaatcttaatgttgtttgtggctagttgagcatgtgagactataaagtagtgaactctgcgctctttatggccacagcttttgttcctaattcttcttggcctgtttcaacctgtgtgtcatgactcccaagctgaactaggtaaaagaatgtgaatggatcatcatttctagaaaagcatctcagaacatagtccatttagataattggtttaaaaagtagccttttatttcatagaaagcagcacagtctaatacaaggaactggtgtgctacacatgaggacatgctctgccttaataattctctggctgtcttaggtagaaaagtttggggttgaaagaaaagtgatgtctgtttcaaaggaatgaaaattcttagggtgtaacaatagcttattagtgaagagcctaactttggctcaagcatcagactgcttgagttcaaatacaaattcctccatttaccatcaatgtgagcttggtcaagttattcctccaatagtcagtttcctcatctgtaaagtgagcacaatggtaggaccacaatttaattgattctgattggaattaaatgtactactctgtgtataaagaagtaattagtccagtgcctggcacatgataagctctcaataggtattagaccttttttttcttgttaattttgttgtttatgttatctttattataaccatgtgggaagttttatgctgaaaaatatataatactgaatttttttaaatagataatatgcaacagcatctgtaatgactgcataaacaattcttgcattttcctgaagtgttcattttaaatgattgattcatggctcggttcaagtatacacacagattagcctttgcaaataattcacttaatactagctacaccctgtggcagttgttttaaggtttttgatctctagggggtgtacagaagtgttctacttgtgcaaattgttttcctttttatgtcatcaattctgaaaacgtaggcttattacaggaatttttccccccatatatttttgagcctcatgcaattttgtatagcagtagccagtgaagttatccatattgcttcctctgatatagtctctgagtcaatttgttttaatgtttaaaaacttattgcctacttttccttgacacttacatgttcggcgtttcagtggaagataaaatgaagaaacttgatttccactccactagaaacaggctattttccttctatttcatcaaatctcaaagcttatagagattataactgcatgttggttattttactgttcttgcctatctatctatctatctacaaatctatctttctatcttgttcattttagggataatgaagaagcatttagtgggaccccacaagcataataaaaagtgtcactgtaagatatatttacaagcataaatataaaaagcaatatagtacttagcaaaaaatataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcatagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatggtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtctgacatgtgagtgaaaaaaaccttttttcttaactttcaaaagtgctaaaatgccctgtgtagtatcatgtaaaatagtgacactaatgcctcactcagtggggaggtagatgtggctgaggagggacagatgaatggatctagtcagtagtaacacatttgaagttctggctgatccacagagtcttttacttctagggtcaaggtggtaacagccaattaataggagagcaggttggaagaagagtaaaagatctacatgctcatgttacttgtcgtgctcacagaaaacaaaccagttttgtgtgagaaaattgtttcccgtcaacttgaaaacattgaatttgctcaccctggagctttctttgatgctcctctcttcaagtcccatgtggctgtcttccttctaagaaagctatttataaactgcagtgctctacgcaactgtaagcacagtggctgcagtctagtggaaatattttggggtcacaggtagttctgtattcaaatctcagctctggctctttctagctgggagacttgagcaaattatttaacttcctgatctatagcttcctcgactctaaaatgggggtaataaaactttgtttacaggattgtgtgaggattgagactgacacaggtaaggcgtcttctaccatggctggcacttagtctgttttgcttattacttagggctcaactttgaacgaacttgaggttacaaagctcagtatcaggttatcctcgggttgtttcctctgtaatcctcatttccctcagagcatggtgagagtcttgaagacatgaaacattttatgcttttctaccttccttgtgccttgcagagtcctcagtatccagtcagcacttaatgcttatactgccacttctggactgcctttcaacaaatttctcaaagttagagaccatgaagggcatggagactggtgcttttcatgccgtgcttctgcagattttggtggggaggcggtaataggggaatgaaggtggagccatatgaaataaactcttaaaggcatgatagtgaccaggaaaataatatgtaccatattgtgtgacaatccctatgcattgccaaaattgcccagtgtatttttattatgattaaaaccacaatgacacatatgatgcccatttaacatgctccaaaaacacaacaggaattcaccttcacaaagaacaatagacatggggccaagaccttggattctgaccagttttaaacacctgcttcctcctacacagtcgagaattatcttacacgattcagccttagaactgggggcatggtttaaattgtaatgtctgaggagactcaggttggctgaataagaaggatgacagtgcctttgtccagttaaatctgcagaggttgtcttccatcctatgcagctgcctaccataaaagaggaatctaggaaagattttccatatagcaggcactcagtacttatgtaaagaatgaaaggacaaaaaaattgttctctttgtatgtcttaatgtaaccctaagagttccaagccaattgttgacattattctaacatagcataaagatttggacagacctgggtagcacattgtaatgatatttggcttgttgatttctcagctctaagagaatctctgcttttgccaataggcacacataagaatgttcttaatgctttagtaataacatagttatccaaaatgttaaactttattccgcaaaattttaactcaaaaaatatttttcagcaagtttacatgtattccctgggcaacactggtcaggcattcattcaacagtagacatttaagtatatattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctatccaagggaagccaagagggaccctgccatgagggacagtgctatcaggaccagatactacgcttttcccacagtcttcgcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgacctgggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagagcacctgcaggaaggggcggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattccaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagcatacacaagtatcaatagctgaattgatcaagtgaaagaaaggatatcagagattgaagatcaacttaatgaaataaagcatgaagacaagattagagaaagaaagaatgaaaaggaaggaacaaagcctccaagaaatatgggactatgtgaaaagaccaaacctacatttgattggtgtatctgaaagtgacaaggagaatagaaccaagttggaaaatactcttcaggatattatccaggagaacttccccaactgagcaagacaggccaacattccaattcaggaaatacagaaaacaccacaaagatactccttgagaagagcaaccccaagacacataatcgtcagatttaccaaggttgaaatgaagggaaaaatgttaagggcagccagagagaaaaatcgagttacccacaaagggaagcccatcaaactaacagcatatctctctgcagaaaccctgcaagccagaagagagtggggaccaatattcaacattcttaaagaaaagaattttcaacccagaatttcatatccagccaaactaagctttataagtgaaggagaaataaagtcctttgcagataatcaaatgctgagggattttgtcaccaccaggcctgacttacaagagctcctgaaggaagcactaaatatgggaaggaaaaaccagtacaagtcactgcaaaagcaaaccaaaatataaagaccattgacagtatgaagaaactacatcaactaatcggaaaataaccagctagcattataatgacaggatcaagttcacacataacaatattaaccttaaatgtaaatgggctaaatgccccaattaaaagacacagactggcaaattggataaagactcaagacctattggtgtgctgtattcaggagacccatctcatgtgcaaagacacacatggctcaaaataaagggatggaggaatatttaccaagcaaatggaaagaaaaaaaaaagaaaaaaaaagcagggattgcaatcctagactctggtaaaacagactttataccaacaaagatcaaaaaagaaaaagaagggcattacataatggtaaagggatcaatgcaacaagaggagctaactagcctaaatatatatgcacccaatacaggagcacccagattcataaagcaagttcttagaggcctacaaagagacttagcctcccacacagtactagtgggagactttaacatccacctgccaatattcaactgatcaacgaggcagaaaattagcaagaatattcaggactggaactcagctctagaccaagcagacctaatagacatctacagaactcaccaccccaaatcaacagaatatacattcttctcagcaccacatagcacttattttaaaatggaccacataattggaagtaaaacacttctcagaaaatgcaaaagaatggaaatcataacaaacagtctctcagaccacagtgcaatcaaattagaattcaggattcagaaactcactcaaaaccaaactactacatggaaactgaacaacctgttcctgaatgactactgggtaaataacgaaattaaggcagaaataaataagttctttgaaaccaatgagaacaaagacacaatgtaccagagtctctgggacacagctaaagcagtgtttagagggaaatttacagcacaagtgcccacaggagaaagcaggaaagatctaaaatcagcaccctaacatcacaattcaaagaactagagaagtaagagcaaacaaattcaaaagctagcagaagacaagaaataactaagatcagagcagaactgaaggagatagagacacaaaaaacgcttcaaaaaaatcaatgaatccaggagctgtttttgttttgaaaagattaacaaaatggatagccagagtaataaagaagaaaagagaaaagaatcaaatagacacaataaaaaatgataaaggggagatcaccactggtcccacagaaatacaaactaccatcggagaatactataaacacctctatgcaaataaactagaaattctagaagaaatggataaattcctggacacacacaccctcccaagactaaaccaggaagaagtcaaatccctgaatagaccaataacaagttctaaaattgaggcagtaattaatagcctaccaaccaaaaaaaagaccaggaccagacagattcacagccgaattctatcagaggtacaaagacaagctggtgtcattccttctgaaactattcaaaacaatagaaaaagacggactccttcctaactcattttatgaggccagcatcgtcctgatatgaaaacctgacaaaaaaagaaaacttcaggccaatgttcctgatgatcatcaatgtgaaaatcctcaataaaatactggcaaactgaatccagcagcacatcaaaaagcttatccaccatgatcaagttggcttcatccctgggatgcaaggctgggtcaacatacacaaatcaattaacgtaatccatcacataaacagagccaatgacaaaaaccacatgattatctcaatagatgcagaaacgcccttcaataaaattcaacaccccttcatgctaaaaacactcaataaactaggtatttgtggaacatatctcaatataataagagctatttatgacaaacccactgatatcatactgaatgggcaatatcatactgaatgggcaaatgctggatgcattccctttgaaaaccgacacaagacaaggatgccctctctcaccactcctattcaacatagtattggaagttctggccagggcaattaagcaagagaaagaaataaggggtgttcaaataggaagagaggaagtcaaattatctgtttgcagatgacatgattgtatatttagaaaactccatcgtctcagtccaaaactccttaagctgataagtgacttcagcaaagtctcaggatacaaaatcaatatgcaaaaatcacaagcattcctacacaccaataacagacaaacagagggacaaatcatgagcaaactcccattcacaattgctacaaagagaataaaatacctaggaatacaacttacaagggatgcgaaggacctcttcaaggagaactacaaaccactgctcaaggaaataagagagaacacaaacaaatagaaaaactttccatgttcatggataggaagaatcgatatagtgaaaatgatcatactgcccaaagtaatttatagattcaatgctatttctgtcaagcttccattgaatgtctttacataattagaaaaaactactttaaatttcatatggaaccaaaaaggagccggtatagccaagacaattctaagcaaaaagaacaaagctggaggcatcatgctacctgacttcaaactatattgcaaggctacagtaatcaaaatagcatggtgctggtaccaaaacagaaatatagaccaatggaacagaacagagacctcagaaataacaccacacatctacaaccatctgatctttgacaaacctgacaaaaacaagcaatggggaaaggattccctagttaatgagtggtgttgggaaaactggctagccatatgcagaaaactgaaactggacctcttccttacaccttatacaaaaattaactcaagagggattaaagatttaaatgtaaaacctagaaccataaaaaccctagaagaaaacctaggcaataccattcaggacataagcatgggcaaagacttcaagactaaaacaccaaaagcaattgcaacaaaagccaaaattgacaaatgagatctaattaaactaaagagcttctgcacagcaaaagaaactgtcatcagagtgaacaggcaacctacagaatgggagaaaatttttgcaatctatccatctgtcaaagggctaatatccggaatctacaaggaacttaaacaaatttacaagagaaaaaacaaccccatcaaaaagtgggcgaaggatatggacagacgcttttcaaaataagacatttattcggccaatgaacatattttaaaaagctcatcatcactggtcgttagagaaatgcaaattaaaaccataatgagataccatctcatgccagttagaatggcaatcattaaaaagtcaggaaacaatagatgcaggagaggctgtggagaaataggaacacttttaccctgttggtgggagtgtaaattagttcaagcattgtggaagacagtggggtgatttctcaaggatctagaattagaaataccatttgacccagcaatcccatttctgggtatatacccaaaggattataaatcattctactataaagacacatgcacacatatgtttatggcagtactgctcacaatagcaaagacttggaactaacccaaatgcccatcaatgttagattggataaagaaaatgtggcacatatacaccatggaatactatgcagccataaaaaaagaatgagttcatgtcctttgcagggacatggatgaaactggaaatcatcattctcagcaaactaacagaggaacagaaaacaaacaccacatgttctcactcataagtgggagttgaacaatgagaacatatgggcacatggaggggaacgtcacacaccagggcctatcaggggttggcaggcaaggggagggatagcattaggagaaatacctaatgtggatgacgggttgatgggtgcagctagccaccatggcacatatatacctatgtaacaaacctgcacgttctgcacattgtatctcagaacctaaagtataataatttaaaaaaaggaaaaaaaagcataattatttttatattaacactagcatttcatatcttaaagcaactgatgtttaggaattactacacgtggtggctcatgcctgtaatcccagcactttgggaggccgaggctggtggatcacatgaggtcgggagttcgagaccagcctgaccaacatggagaaaccccagctgtactaaaaatacaaaattagcaaggtgtggtgacacatgcctgtgatccctgctactccagaggctaaggcaagagaatcgcatgaacccaggaggcagaggttgcactgagccaagatcgtgctattgcagtccagctttggcaacaagagcgaaatctatctcaaaaaaaaaaaaacaattactacgagtggtacctttttttgcattagtgtcttttatgtggcatcatgaaaatttctgatgaattaatttccctaattaacgtaattccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcctttttatttaaccttggtttttaataatctaaaacttgtacatgattccaaaatcaaaactatgaaacaaggtacatttggagtattcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggaccttgttttctcatgtaacaatacattctgaagatcattttatttcttttgatagctgcacagtaccatattatgtggctacataatattttattcattaggttgcacactgatagacataggggttgtcatatcatgctttaaataaatatttcccaagtggctgatcaggtaatctgaatgtctgtccattggtggttatatgtctcttggagactaatacctaacagaaatcaattttttgtgtgagttgaatgtaaaatgatatttatatcattttataaactaaaaaaatgtttagttttggcacaaccttgaggaaagcagtgtgacaagcctggtgccagatcccatggagaactaaccctggacagcctgggaaaactcctatgtaaacatggagaacccagatcaaagagtgtttggagagtgataacaatcacttaggacttaccttttctgaaaatcttaaaaattttaagattgtgaatttttaaaatagtgattcataaactatttaggtgacttgctgtggagccattggaccagagattttgttcaaaatgaaaacaacatgcagttaatcatatttgcaatggggccattgttgtctctttataggtttagttttaaggctggcattaaagagttttgcaaaattatttatttatttttctaattcctgggcactgcatctgccaccctgaaagaggccttcaggtaggtggtggtgtatgcattggtctcatgaactcatgcaatatttgccatagttttctcttgggaacaaagtgtgttattgggaacaaagagttccataatcaaataaatttgaaaagaactaagtttatttattgcaagatttcttagagcttttagtaactaatatgcatataacttctcaagatagggatgtaaaatgctggttttcacagacattttcctttatggagtctatttttcatggagcatgttttgggaaagttagatttaatggttaagtttcttataattgtgaatgacttagtgagttaattggagggagagagagaattaattgaacagagtagttgttatcatttctatgttacaggagaggaaactgaggcttcagtgttagtgacttgcctatcatggattgaagacagatttctagattgtaaattgttaacatcatcatatttaaagacttaaaggaagaaaaagtatggaaagggtttagtaattctcttaaaaatatccaatttatataaggaactcaattaactagaaagaaaacaaataacttgattaaaaattgggcaaaggacctgaatagacctttctcaaaagaatacatacaaatggctggcaggccattttaaacagggtatatgaaaaaacgctcaacattactaatcatcagggaaatgcaaattaaatttagaatgagatatcaccactcacctattagaatggctaatatagaaaataccaaagattacaaatattggcaagggtgtggagaaaagagaactcttgcacactgctggtgggaatgtaaattagtgaagtcattatagaaaatagtatggagagttctcaaaaaactaaaaaaagaactactatatgatccagcaatcccactattgggtgtatatccaaaggaaattagtatgttgaaaagatatagctgcactcccacgttcattacgcattgtcgacaattggcaagatatcaacctaattgttcatcagtggatgaatggatatagaaaatatggtatatatacacatggaatactatttagcctttaataaaaaggaaatcatgtcatttgcaacgacatggatgaacctggaggcaattatgcttagtgagatcaaccagactcagaaggacaagtaccacctgccctctctcatatgcagaatctgaaaaaagtctcatggaagcaaagactagaatggtggtggctaggagctgggggaatggaggaattggggagatgctgttcaaagggcacaaaatttagttaggaggaaaacgttcaagagacccattgtacaacatattgactatagttaataaaaacgtattgtatacttgaaaatctccaatagaatagattttaagtatgcttatgacaaaaaatgataaatatatgaggtaatgcaaatattagttggctcaattcagccatttcacaatatgtttgtattttgaaacatcatgttgtacaccataaatatatacaatttttgtcacttgaaaaaatcctagaaaggggaaaaaagaatattagtagaaaactgatataattcaaataatatctgtggtttacttaatagtgctatacttatgttaatatcctagtttttgataactttagtatggttatgtaaagtgtaaacattagggaaagctggggaaagggtaatttggaactttgaatctttttcttttcttttcttttttctttttggagagatggggatcttgttctgtcacccaggctggagtacagtggtgcaaatcatagctcactgcagcttcaaactcctgagctcaagtgattctcccagctcagcctcctgagtagctggaactacagttatgcactaccatgcttggttaattttttatttgttcatttattgtagagatggggtcttgccatgttgcccagtctggtcttgaatccctggccttaagcaatcctcccatctcagcctcccaaagtgttgggatttcaggcatgagctgccatgtgcggccaggaactttgaatcatttttacagcttttctgtaaatcaaagactttctcaaaataaaaagttaaaagtaaaaatttataccaacatatatgaaatgaattaaataaaaatgcacatattacatcaattgttattatgtaatgcaaaaaatttcctagtcttattaggatttttttttaagactaaaacattttctaggccattcagcaggagtgggattgggcttgccactggccttcccccttgctacggatgtgggcttatggatatatgtaaatactgtacatcagatggtgatgcctttgctcagagtccctgcaatcagaaccctgataggaggatttatcctgctttcaacttagcagagagaaagaattacttttactcttcagacagtttatcttttcagtcgttccttttctctgacatttttccccttgactagagtaaaagtagttatccttaatgtgacattggaagagagagatcacggtcatattttttgtacacaaaccgtctctacatcacatcacattgaccttctcctattcggggagaagggtatttattgcctgctttctcaccaagttctctagcttttgatgtttaaagttgttatttcatgacatttcatgaacttattttctatgaggtttctaacatgactttggcccattcgtacaaatgattccatcttggagctccccctgccagtgccaccacccccactttctgttttttacagaagatacatatgaagtctatttaaagagaagatattacaaacaaatatacagtactattcaaacattctgaaattagatatagttggattcagatgaatttattaaataaaaagacaaattcatgagtgacatttcttaacttggtatattcacagcatatcagtggagaagtaaggagatttacttcattattcacagcgtgatcatgatcttcagcaggtgttcaagaactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgcccagctaattttgtattttcagtagagacggggtttcaccatgttgcctaggctgatcttgaatgcctgacctcaaatgatccacctgcctcagcctcccaaagtgctggaattacagatgtgaactacagtgccaggcctttctttctttttttaaattttaagttcagtcaggggtatatgtgcaggtttgttacacaggtaaaaccaagtcatgggggtttgctgcacagctgtcatcacccaggtattaagcctactacacagtagttatttttcctgactttttccctcctcccacccttcaccctccaccctccagtaggtcacagtatatgttgttcccctatatgtgtccatgagttgtcatcatttagctcccacttataagtgagaacatatggtgtttgattttctgttcctgtgtttgtttgctaaagataatggcctccatctctgtctttcttgcttgcttttgttgagcagggggtgggtaacactgcccggtgattgtgtcacctcacactgtcaccccaaaatttcagattccagaataactaataaataaaagtttttccacagttggggaaaggaagataaaaaagtttaggaagcaaagaagatggtaatggggtttttacgagccttcccctctttgaaggccagcagggtagttgaatgtgtgtgtacagaagccacatgctagcaatagtatgatgataatcatagtagttatcattttctggcactcactatgtgcctgaagtggtgtaaatgctttacatgtcattaatgctgttagtttctttaacagctctgtgaggtgaatgtattgttattctgctttgctaatgagaaaactgcagcatagagagcttagtggagcaatctcaccaagtttacagttagcacactgcagaggcggaattctcactgacatgttttctactccattgtctctgatttgacccaggaggaatggtgatggtaggcacctgagctattgagtgttgtaatatagaaggcagactttctgtgttcgtaaggcacaagagtctgctaaggatttccttttttgcttcattttacattttattcaaaggttcaaaattgataagcttaattaaaatatcagttccttaataaagcgctctaaaacatatttaaacaaaatgccatacatcatgccttagttgctttactaatataatgttaaataaatatttcctggccaggcatagtgatttacacctgtaatcccagtgctttgtgaggtggagacaggaggatcacctgagcataggagctcaacaccagtctgggcaacatagtgagaccttgtctctacaaaaaaaaaaaaaaaaatagccaatagctgggtgcaaatacttgtagtcctagctacctgagaggcgtgaggattgcttgaacccaagagtttgaggctatagtgagctatgatcacaacactgcactctagcctgggcaacagagcaagaggccccgtgtctttatatatatataatatataatgttttctaacttttgtggttacataattatagaaatattagcaaaattaaaggaaggggtgagattttatatttatcaattgtatggattgaccgttcagtattggttgattgattgagacagggtctccttctgccacccatgctggaatgcagtggtgtgatcagagctcactgcagccttgacctcctgggctcaagcaattctctcatcttagcttccccagtgctgaggttacaggtatgagccaccgtgaatggccagtgcttttttttttttttttttttaatctctcttcttacacatcacttttgtttttatattattgttattcatatatatgtcttgtcacccccctattgagttggatgctctttgaatgttttttatttcatgggttctcaataaatatttgtgccacaaatgacttaatattacttgttactatgaaatttgtgcctctatatatgttgggtgacaattagaaaactaatgataattattgcatcaaaaataatttgagagcacaaatcttatagcattgtcatgtaagatgggtacatatagatttttgttattcttcatttgttgggcatgtagaataaatccacaataaattcaatagaagtaaagcttatttctgcatgtatatctagataaacataaaatattgattctctgttttggaaaaaaggaaaagataatgactaaaatttctttgtggtctctatgatggtttaatcacatgtctctcaaaaatctaattttctaagaatcaatctgtctgtgtgctagcagactgtgaaaacctactggtttctttaaacatcaaaagaagtcagcctttaaatatttggacgttttcctctgagatacggctgcactaggcaaacacactgacattaacatttctaaagcaggctcaaaataaatgagaataataaaaaaaaaactccttccaatacctaattgccattttaattaaagcttctgtttgtcatcagtgacaagagattgcctcagaaagataaaataagactgtgtgtctttggctttcatgaagacaaaaggtttgtgcaagaagtcaaatacccagataactttgctgttactttttaaattaaacaatttgctaagcatcaggtgaaccaaattattcataaattaacattttttttaggccagtacatctcaaatctagtttatggatggatttcctggtttgggtgcttaatctagtgtgtgctagaatcttatatcacaggctgttttatagagataaaggaatctggaaatggaaatcactttcttaaatggcttttgatttgaaattttatttattcaggttaccttaaggttataagatcaaataagaacatactacaaagagctttgtaaaagataaaatattacttgttatcttaattattattatctggaaaacaaagttaaatgcatgtgtttattccacccctccctctgacccaattaatgcatcaggaaattgggaatttgctttggtgcatctgtttaaatgctaagaactgggacttggatttgctgctcaagaatccctagcccagcttcctaaactttataaagtcaaataaaaatagggtcaccaggtaacatggaaagagcaggcttatctttcctctcagcttctgaatgaagttgaaaatgtgttttattgtagaacaggtaaaatgtgattcttataaatgggaacaaaagaataattttaatgatgaatttgaacctggaatctgaacaacagataaaatgcaatcagagaagcactgagactatgcagtgcatttgacacagaaaataccaagagcagcattagcacttttctgaggccttatcttaattaaacttggccagatgaagtttctttggtaaatgcaggttcttctcacaaagcctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacggtatctgagtctctgtatttcctcacatgcctactatccaagaattcaaaacacatatgtggttgaatgagtacccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgtgtgtgtgtctgtatgtggtgcacacgtttctgtttttatttttttattttaaaaaatttgatttttattagctttttcttttcttattattatactttaagttctagggtacgtgtgcacaacgtgcaggtttgttacatatgtatacatgtaccatgttggtgtcctgcacccattaactcgtcatttacgttaggtatatctcctaaagctatccctccccctcccctcaccccacaacaggccccggtgtgtgatgtcccccttcctgtgtccaagtgttctcattgttcagttcccacctatgagtgagaacatgcgatgtttggttttttgtctttgcgatagtttgctgagaatgatggtttccaacttcatctatgtccctacaaaggacatgaactcagggatctagaactagaaataccatttgacccagccatcccattactgggtatatacccaaaggattataaatcatgctgctataaagacacttgcacacgtatgtttactgcggcactattcacaataacaaagacctggaaccaacccaaatgtccaacaatgatagactggatgaaggaaatgtggcacatatacaccatgaaatactatgcagccataaaaaaagtttttgtttttaatgtttgcaagtaagttacagacttcctgtccccttatacctcagtgtgcattttgaaaaacaaggacattctcttgtattattaccacaatacaattatcaaaacctaaaaattaacattaatagacttcattcagattctgctgattgtctcatcaatgtcatctctaacaaagggcaaaaaccaatttttgtggtctaggaaatcaatccaggatcacatgttgtgttgtgctgtcatttttaaagtctcttttaacttagatcagttcttcggtatttcgttgtttttcatgaccttgacatttttgaagtgtacaggccagttattttgggttaatctgatgttgtttaatgattagattcagattatatgtttttggcaagaacaccactgaaagaatgttgtgtcctttttcatgtctcgtcatggtatctatttctgcccttacttgtgttcacttaattaatgtggtatctgccatatttctgcactgtaaaattactctttgtcccctgtaattaataactatcttgtgggagacacaccaagactatgaaaataaatatatctattagtgttaatgacggtcagttttctcattgttgaagaagaaaggaattatagatatgaaaaggtagaatgctagagtgaacccatgtgctgttggattaagattagcaataactgtatgaattcgtggtttttatagctatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaaggggctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaatacaaaaaaattagccgggcatggggtgtgcacctgtagtcccagctactcaggaggcagaggcaaggagaatcccttgaacccagtaggtagaggttgcagtgagccaagattgtgccactgtactccagcctgggcaacagagccagactctgtctcaaaaataaaaaatgtatgtagtatgattgattgaaaatcatcatttgttaactaccatagtaatggttgtttgaggcaagaatcatcaatgaattctcttttttaataacatagatttgttctttctgactcctccctatccattcagtgcacagcttttagcacacaattgccttggtcaaatctgttcttaagctgggcttccccttcccattgtaccatgtgtgtgaatatctaagaccacaaaatatgctgcttttccactactgaagtaatatcttacctcatctctgtttagattcttcacacattccaaggaaacacttagctaattttctattagtttgaattaagttgagatgctagagaagtttgctagaatcatttttcattgccagctaacataagtgcattttcaaacatgctattgataaaatctggataagttagagggaactatctgcttgggaagcagataaatgagagtctattgggggcaaatgagacttttggggttccttctatatcatagaatggatggacatataatttcatcttctgccttgaagacaggtgttgagaattgacctaagctgatttggtcattcatagcccttagtggttttttcctccatggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctcgttatacaacttgttaggaagtcccagttctgctaccttgcataaaggttcttccaaggcagacagggcaacatcccagaggctggatcctgttacccttatcaatccagtgggcaatgccaaatcttcttaaatcaacaggtggacactgggccatttaggaaaaaacctcaggtttgtctctgggggagaggctctctggatccttatcctccattacactagagtggagaatatctctaaaatatttttgctactccacatactcttgattgtctttaattttactcgagagagtccatttctaaattcttcatattaataagccactagttttaccaattaaaatccattgctagcatacattatactgattattaaagtcttaggtgttaataaaaatcaggataatagaagtacttatagtgattgcttctggagtattgcctttctgataaaatactggataaatgtacagtcttgatgaaatacactgggagaacattacatactatagtgccatcttggaaattaaaaatgcatgttagctatttagaggttaatgtcctgcaataaaggaaagctgcttagttttgttcgaccttgcatttcccaaacttagttgaccccaagtccttttttccatcgcactcttgaaattagttattcctgggaaaggctttagaaaacattgctttagagattataggagaagcttccttcaacatccacttaactgacactcagcattctctttataaaattcgaggataataggcacctatcttaaatactctctatcaagttgagttctgtgcttacaaagagtcaattgagattttttccaaaacggttttattctatttgtacttgtaattacagttacataacttaattaaatattacataatcccgtgacttttgagtgtaaatataaagagttattgtttctttgaaaaataaactgaaagttttggaaagactctagaaaagaattgctgaaagtgttattaaataaggtgagggtaagacaactatgaaagatttgggaaaaatataaaaaagaatttctaatacaacttactttgtaagtatcttttaagttattgatgcattttcaagaaactgaaatgtatcatttttcaagaaagagttcaagcagagaacttgaattagtggagccatactcaaaagccttacatttaaataaaacatgtgaggtatatgtatgccaatttttattattttctgcttttactgaattttttgattaagtgactaagcataaaccttgtaagagtcagaaaagggcttttgttctagagagagagagaattaaagagaagacttcacaaagcaaagtgtgtacacacacacacacataccccttgtggcatgttttaaaatattccacatagattttgcccatatttcctcaagccaggctcagttgtcttcagaaccctttggcattcttgacacactgcttttgtgttttttcaactttattgtaagtctgtgggattgcttaataccttgttaaagaaaattagagttaaaaatctaatttctccctgggagtggtccatatatatatacatagttcatggctgggaacaaagtttactactagtgtattttttcagtgttattttgtagtaaaagttcttaaaatattgtgtaataaataatatttgatttctatctatgttctcttaggcttggtcccatggcagcctataattcaaggttaaggttatgttgttatttaagaatttttagcatctgtacttgtatgtgctgcataaacaaaacagttattctattgcagaccagtttttccttttgaaatgtagaatacaacaatcacttctcaggtttaattaagactgtgtttgtacagaggtctgtagtttataaaagcagttaagcaaagaaatgcttttgttatatacaaacagaacaaaaagggaaaatactgtcttgatcctttcattaaaggtcaaaaaaaaaaaaaaaagaaaaaaagagttcactcaattttttatctcgtgttttttcacaaataccagaaacagagctgtaagatagtaatttgttaaactacacattaagctggtatttgaatatgaaaaggtatttccaccccgtgcaatattgcttttttgaaatactaaaagcccttacattagggtggtaattgaatgactgcttaaaaacaaaccctgtctgcttcattttgacaggttctttatacatttttgtggagggtaaacatgtcaggatgtagcagactaaggaaggagctggtattgaacagggttcatagtcaaagtgacatagtttctcattctcaagaagagtagttggcatggttgttttgggacctgcaatatagtttttctagattcaacatggaaaacattattctaaactctagtgatctatctgcccatagcttatgccaagcagcatggattatacatttttgatacctgtagacgttttaggagccttcttgatgttatgttgaaatcttattcctgtagttatccacataattttctaccaaatcaccctgtagaactgatgcataattacttcttaggatttgtttgttactgtaataatgaaatattttcctgtctcttggtatacccatgtgtatactgtgttttttattttgtaagtcccatgaaggagaaaggacttctatttttgttttattggagttgaacacttcttgagcctccttcttggagattctcaggtttctgatcattcttgttatagttaactgattatttttgtttccttagatcaatttagagggtcacaatatagcactttcagaaaatttgtcagagcttttattacattaggaagagtagccatttaagtgtgcaaacacatcactcattgactggctcactgaacatctatgagtcaggtagctgctgagaactagagatgttaagctagatgagatagttctctgcaagattggtcaatattcctttttcagctgctatgttctagaaaatgtatggtaccatatgaaaagataattgaaatggagaacatgttatttgctagaatggggcaaacatatgtcttaacctacatgaaaaatatgggagtgacattgagattggagttagggagagggaatagatcagatttggacattttgtccgaagtagggcaataaattatgtcttaaatacgacttgataccaaatccaaaagtagaatggttgcaacaatatttcttctagttatacttctttttctgaatcttactttgttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtgtgccttcaattggtcttctgctagagtttcatgtagaaactgatagatgaaacaatacatttacccaaatatgtgaaccaaaggactatgtgaatagagagggactgattgtgtctactcagtaaataggccaaagaaagggcaacaagcgaatcacaaggactgtttaaagccctggccaatggggggttgggggaattgtgtcttttgcataagttgctcccagtttgaaatcttcttagtacactcccaaagctgctctgtggctgccagcagtgttagcctgagatctcttaatcctcatatagatcagcatctctctaaaataaatcacttgactgttttctgcctaacattgcaggaatggcttgggagactaacccttcggtttgaaatgtctgaaaactgcttctctgttttacaatcttgaattttacttagctctgctgctctttttagctttctcagaagtggattatattttgctacctttgccactgaagtacaaatataatcgttgttattttcttgtctcacagagtatattttgaccgaaataagtagacaatgttctgttttctaagttccaaccacagtgttttttttgtttgtttgttttacactcagtaatccacatattgttatttctaggtaattatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagtgttcattcaaggaagaaatcattgtggactagaatgtgtcattgaataggtcggatacgaacatagccatgaaacataaataggactggtaagtggaggagagaatattctaggtgaagagagcaaaggtaacaaggttgatgatggagttgagcatggcatgtgttttggacaataagaggagaccaggtgacaaaaatcggtatgcaagagaaacaaaaaaataaagttgggtatccccccttccttgataagtgaacctcaattttgtgcctatctgcaagtgatgaatcatgattggtctaacccattcatgatgattctatcctccgcctttccagtctcctttggagctagggcagctctgtgatcgtgttctgccttcaagctgaagtctgctgatggcatttctggaaatgtttttgttctttgataaaatgttggcacctccttttcctctcctccttgccttgaatgaagatgcaaggtctgtaaatatacagcaaccttgctgttatgaggaaaaggcaaagagttattgtttctgatactgctgaactgctaaacccacaccaacagctgtctacctctggacttcctgttatgtgagagaaaccaacctctgtttatgtaaaacagtataaattatggttttagttgtttgcaatgttttaacattattttagaaaggttaatctgcaatagcacaccagctgaaccggaaggtgatgagaattgaggtggtggttttagcaatatgggtcttaagtgaagaagttctgggcaagacttgtggccaggggaataggaaggaaggcagacatctcagagaagaagcaaaagtattcagtgcagattcagtgaaggatagaagaagccagataacctcaaagtttctaatcaggaagataagtgggcctgcattacagctttggggataggcagataatggtaaagacgagttctgtcttaaggtatgttgagtttgagattatgatgatggaacatccaagtggaaatattacgtgcatagtcagaaatacaacatttgatttgaggcgaatctatacaatgcctatgaccttgggcatggagaaacagaaaagcaataaatgatgccaccagttatttgagaggaagaaaagaggtcatttgcataaacagacagagaaaggagataatacggggttggtacagggatgaatatgtcatcatcagtatccaatgatctagagagatcaagaaaggtgaggaatgaggagagaatttggtaaatctgacaaaaagtgaatctggtaaaaataggacaccaatgatttccaagagaggatatattggctgcccagatctgagcagttaagtgggaagggaagggagtccaagatgaaagtggtagtgacagatcattcattgaaggagctgggaattgagaaaggctgattcttgcaagggtggtagacctagtaaaagatggttttaaaaacagtgaaaactgggaggaaagaatttcatggaaaggcccaacatttaaatggaaagaaaggtataaacacacagagaaagttaaagaaatgtgtaatgttggagaaagactttagtttcaggacagttcagatattcctctgaaattggaggcagggatgacaaggaggctctggaatctaatgagtggaagcaaatatacttgtaaacagctgtctctactgggtaggtgaagtcctgtgttaggagctggtctagtggtagggagaagtgaaaggggagctagccacttcatgcagttacaaaatcatgcagccttgccatcaacgtggcaaggattgtcaagggcaaggctgcgtaattttgtgtctttctcaggcaggaccatagcggagaaccagaagctgaagaggagacccagaatcaggtggaggttcatagggagttgtgaaggtgagagaatctagaacaatgctcctggagagggaggagaaatctagtgttctcaggaagaggttaaagtccaagtgcagattgtccagagaacaggtttggttgggggaggtggcagagaaggggatggtggcttgagcagagtaagtccaaatctcagacagagcttgaaatggtgagatccaaaaattgcttctgagtacctggacacagcagcttgttacaagtagagatttaattcttgttctttttttttttttttttttttttaaatgagaggctaatttgtcacacatttcttttactttctctgtgtatttgtacctttctttccacttaagtgttggtcctttccacaaagttctttcctcccagttttcactctttttaaaactatcttttactaagtctaccacccttgcaaaattacacaacatattttcagtatattctagtgcattatttacttataaataaaattgaggccaagtataaataaggtacaaatgtactgagttttatctcactttggtgagacttcttaaatacgaaataaaaagccatccatgttccaattctggcaatatattccccttccacacattcaactaccctcttgctgaactcaaccttgggtttctacagtgttactgaaacctgccatccattcacagtggcttctcctagtgatttccatggagcacaattttttaaatgtccttaaaaaagcatgctactttaattatatggcagatggtgtgttgcatggtttcctaactggtgttacttccacactgtacttgaactatataaagaactttgctctcaactcaggaggaatcctgcgaagctcaagtttgtattaacttagagaggaacaatttctgtaggttgggacaaattttaatgtatatgttatagtactaattttattatgtaaaaactacacataaaccaaaaccataggggtttcaaataatcattgcaaattatgattaatttagtaagactttaaactgttgttttcttctgatttttaaaagtgagtcattatcatgtagaaattttgaaaaatggagaaaaatagaaagaaaataaaaattgctcttaatctcaacttcctggagatagtcactcttcacctatttttgggtgaggggaggggcactttattttttaaactgaatcatattaaacaacctttgtttcctacctcaataggtcaattgacttttaattctggtttcattttctgaaaactctgtaaggtcagcaagcaaaggtgttagaagtaggtagcatataacataggaattagcagatagcttatttctgtgggaaatagaaaggctgactaatctgtgacatccagtaactttttactgagaaaaatgtggttgcaatgagtaaagtctcccatgtcactattctgtagaagataaacaatgttttagctttattatgatttataccgtattcttttcaggattaactctaagcgtagaacattttagttttataccttgattagaatcatttatttatatcccaaaacatagaaattaatttggggtgataagtccttttgttgtcaagttatttttctcttaacatttgtatatagttttttgtattatgtttcctaatggaactcacatgtccattagagtcaactgattattcaagacagatttgctttaatctcccagtgtttattcagtttcatttaatattgtacttttatgagggttatgaatcataggaatgtagataatatgaaacatattgcattattttagatggaaagttagactttgtaatttagataggttgtcctcattttattacatagggcattttcactattatcttaactgtggaaatatttgatgagtcagttcatcttgttttatagaatttccaaattgacatgaaaagaaataattgttttgcattaatttatatttaatataagcacttgagaggtaaccaggaatgggaggaaaggaggaagacattcatggatatgcattctagagtaatgaatttcaactgccggaaatcaatggctctgccagattcatatgttaatttttaatgagtagacatttacttagaaattgatttatttggactcagatgaaaagcaaaaatggctgaaaattgtcaataatagcatacaattgcctctttaggtttagctgtgattatttttgaaataaaatcctcagggatgttggaagtgagccctaacagggtacacatgtaccattttatttgacagagatcttcattgcatatatcctaccacttttcatttcaatgtaacgagcaatcaaaaactgcttgttgagtttgaataaaaagggtgactggtggggggtggtagtatttgtcccttttgatgttttcatagtttaagtttgaggttggcaaactatagcctgcaggcctagtccagtttgccatctgtttttgtaaataaagttttactggaacacagacataatcatttgtttatgtattgtttatagctgctttcatgctacagtggcaaaattaagtaattgcaagaggagctatctagactgcgaagcctaaaatattagtatctagctctttactgaaaaaaaatttcaactaagtttagttaaacttttcccttatagtactgtatttcttaaacctgatggtatactattgtttaacatgtcaatatggaatcaaattaccaagatgctaaaggagaaagaaacctggccgaataggaacagctccagtctacagctcccagcgtgagcgacgcagaagacgggtgatttctgctttgaaaaatttttcagataagacataaataagtaaaacagagaaagatatatcactttataatcgagggctaaattgtatgatagtatcaaaaaacccttttcaggctcagtggctcatacctgtaatcccagcagtttgggaggcccaggcaggtggatcacttgagctcaggagctcgagaccagcctgggcaacgtggtaaaatcctgtctctacaaaaagtacaaaaaattagcccggtatggtggtgtgtgcctgtagccccagctacttgggaggctgaggtgagagaatcatctgagcttggaaagtcaaggcagcagtgagctgtgattgagcccctgcactccagcctgggcaacagagtgagaccttttctttaaaaaacaaaatcaaaacaaaaaaccaaaaccttcatatattctgtatcataaatatatgtgaattgaaagtcactttaatgtggtcagagtcagagttctaaagttctcaaaattgcaatgttagcatactaatgtagtaggatatgttttgatgttttcgtctagaaatgggaacatcaacttagtgccatatagttatatggttgtatctaggttagccagggttctaaaggaatctagagcttttctagaaattgtggggtcagaaaggatgatgtactaggcttgcttgagtatgaaccaggagagatgcatgtgtgtgtatgtgtgtgtgtgtgtgtgtgtgtgtgtgttttgttttgagagggagtctcacactgtcgccaggctggagttcagtggcacgatctcggctcactgcaacctctgccacctaggttcaagtgaatctcccgcctcagcctcccaagtagctgggactacaggtgcacgccaccaggcccagctagcttttatatttttattagagatggggtttcatcacgttggctgggatgatctcaatctcttgatcttgtgacccgcccaccttggcctttcaaagtgctaggaatataggcatgagccaccacgcccagccaaaagatgcagtaatttcaggtagttctatgatcagtatatagggatgccaccacaactgtttctgaagaacacaattttaataggacctaggtagggaggcttaggattaaaacatgttgaaaatctgtcttcagggactaaatgaagctggaataaataacatggcacacagttgaacatatattggggaaaagggtgatcttggaaggggcactagaagcaattataaattggtgtgaacttatatgtgaacataaataacacaagatgatacattggtaacttgtatcatttacatttggttttgtatcttgagtgtcttgcataataataaagcagatcccagctttaaagagtggagtgtttctgctctatattgaaataactatcagagggcagggaggttaaaatcagaagtaggtacgctccttgcataactcttccatgcgagtggtggcagattaagaaccttctgtagtagaaccattttgttacacattgccaaccacaaaatttcatagagtcaaaaaataaaaataaaaaaagaggtcaatgtggtggcctggactaactgggaaaagctttatggagaatattggattttctctcagtttctgttctgagtaaagtatgaagctgcctttataaagaagcaagttggtgactctgggatttgaatgagtttcccagtcctgttggggtactataataaaatacgttaggctgggtaaattatagtcaacacagaaatttattgttttacagttctagatgatgggaagttcaagatcaaggcaccagcaggtttggtgtctggtaagggcctgtttctcatcaatgataccttttatgtgttctcacatggcccaaaggggcaaacaagctctcttagacccttttataagggcactgtattagtccattttatgttgctgtaaaaaatgcctgagactgggtaatttataaggaaaagaggattgacctggctcacagttctgcaggctgtacaaagaagcatggcaccagcatctgcttctggtgaggcctctggaaacttccagtcatgcagaaggtgaagggagagcaggtgcatcacgtggtgagataaggaacaacagagagggagaaggagagagagtggggaggtcccagactcttttcaacaatcagatctcatgtgaactcattaccatggggaggacaccaggccattcatgagggatctgtccccatgacccagacacctcccactaggccccatctccaacattggagatcatatttcaacatgagatatggaaggaacaaataaccaggcactaaccatattcacctcctagcggccccacctcccattaccactgcactggggactaagtttcaacatatgaattttggggagcataagctttcagaccatattcagcaatgagcatggtttgtgtagaagaagaacttgggcaaagtgaatggcttatgcctcaagttgagcagattagttgcgtagtaagaaaggtgaggggagataagggtgggagagtgatggaacataagggaactaaggtaccacttgggtcagcctagtttctgtgattccgttacattatgggattgagtgtttaatgctcagtgacatctcatagaatgaatcatagggagaccaagtggtgtgcacaggtctacctggtttgggaatcactgagattgttttgctctgctccaagttgcaactgaagacaaatcacattcctggagggaaaggaacatcaagtgactaaaatgcaacagcataaatcctctctcataatagacagcacctgtagccttttgaccctttgttctaaatcttttatagaagagtgtaggatgtagataggaaataaataaaattgcctcctgattttatgtcactatggagctggttgggagtctctttccttttcagagaagccacagagagaaagaagaaaaagcaaaggcaagaccccttctcttacatatcccaatggactttgagtgttagtgttgctttttaatgaaggtggatggcagagagagattttcaatatagcttaaccataaattttcttaagggggttaggtggtgctgtccaatactccagggtgtggtggtggagctggcagaggctacaaaaagcagcaggtgcctataggtctagaaatccccagctcattagaagtgctgtaaatcatagcatccttcatgtctcttgagtgaaacttggcacctccagcttacaactgtgtggtggtcacactgtccctgacttcaataatgttaacagatgacaacttccattgaacgatgaaactgggtgagccagtgccagtaatgatggattgggtggctgaaagtttctgcagagaggacagcaagaggatgccaaggaagctggtctgtgtgtaactaaaagactagtaaatatgagaattgatgggcacatctatcacccatggggccactgtgtcctgaaagaccttgtatgaaagctttgagaaaggctttggcaaggataaatgccccagcgcttagacaagtatgggtctctgcaggccggactggttgaagagggcaacgaggtgaggtttcgtgagttggaagttggcctcctgtagtgtgcagtctgacacagaaaaggttctagctcacagttgcctggttggagcatggaaacagctccagcttaatattcaggacatctgtctgccgaggcctgttttttttctgtacgttttcatggctgtttgtagacagtggtaggtgagattggaagaaataagagacttgaggaaaacagagttaaacaagaaagtaaaagtaactcttcaatacccagtacatggttaatatgtagatacttgaggatcctttatccctcttatgtctcaggagatggggtgctggggttgtggggagggcaggggaggagtaagggaaaaagggaaaagacaaagaagatatcatctatttgagtaaataaaatggagatgtagtaaagatatcattttgggaaccttgagattgataaaaaaaaatacacaacttactagaactttttcagttcaaagctgaatgctaaaaggttgttttgtgtgctgtatgacagacaaatattttaaaatatgtctcacaacattcctttggcttaggtggtgatatttaagttaagacttacatatatcagttggccagtttgacagataggaaattatttggaattaaaaattccccttctagtttttcccctaaaaagtccctgcttaattcatgattgttctctcctttgcctcttctttcctaattctttatcttctcccatatccaaaagaacatctggcaactatctctttagaggcatctatgatcctggattgaatttgttatccagtcagcaccttcgtgagctgtgtttgattttctgaaattgggtttccgcaaatggtcatatttcaaagtgctatgccatataattatttgaagggaaaacattttaacgtggtacaatgacaacgtaaagaatgaaaattgtgctaagtgagttctgtctctttcaagttcaaattggtaggttttcctggcttgaacacaaaatgaagtcaaattgaagggtcagagatacaagaaaattataaggagaacaaactcattagaaagggaactgaaaaatggataacaagaggaacaaatacagggattttccatatctagggaaaaacaatccataggttctatggggactttaaaaatatagaggattgagaaaaaaactttgtattttgcaacaattttaggttaatagaacattcgtaaagatagcaaaaatagttcctatatactctatatccagcttcccctaatgctaacatattacagttttagatttttaatggttatgataaacatgagtctatgatttatagatgtcactacttttttatagtattagaagaaaattagacatataattttctacttgaaaatttatattcttgtttacactttaagaatatgtaatatcttccaaccacattcatatcaagaagaacaaaaacaagcaaacaaaacccctgatcatatcttaaaaaaacagcccttctctgagttatttacatttttagcaggatgcaaaactttatgcccaaattttccaaatttaggtatgttaccatggcattttatcctggaaaattgctttgactggaagtttctttggcaaatctcacttttatttatttattttattttatttagacggcgtcttgctctgtcgccaggctggagtgcagtggcgcgatctcggctcactgcaacctgtctcctgggttcaagcgattctcctgcctcagcctcccgagtagctgggactacaggcatgtgccaccacggccagctaattatcattattattattattattttttgagaccgagtttcactcttgttgtccaggctggagtgcaatggcgtgatcttggctcaccacaacctccgcctcctgggttcaagtgattctcctgcctcagcctcctgagtagctgagattacaggcatgcgccaccatgcccggctaatttttttgtatttttagtagagacagggtttctccatgttggccaggctggtctcgaactccctacctcaggtgatccacccgccttggcctcccaaagtgctgggattacaggcgtgagccaccgcgcccagcccctaatttttgtatttttagtagagacagggtttcaccatgttggccaggatggtctcaatctcttgacctcatcgtgatcctcctgcctcggcctcccaaagtgctgggattataggcatgagccatggcgcccagcccaaatctcactattttttagattaaaatggaactgttgtggggtataatgtaaaatttatgcatttttaaaaagcaagagatagcttaaaatgggactctttggtggtctctggcagtgtgcagactttggtggtatgagttcactctgttttgtctttatagctatagaggttgaaaaaaaaaaaaaccattaccttacactaattgacataaattttggaagcattatttcagcaccaaccaatacaggtttcccatagtccttattggatatcatagaatttttgataaatatttgtgaaatgaagcaatgagtaaaaataaggaatgtcattttgaaatgtggggccttttctgtgtctcctcaaatcccacctgggaagtgctcactcattccaggtaagacaggctttgctgattctgggccttggactggcagggaagaagggactgactaggttaagtatctcctcaaggtgctggaggcctctaaataaaatgaggtacctcccccttcattcctagcctggaagaagactggagcctcgagattacagttatagtctctgcttattatataaaagtaatcatatgctatatatagcccatgatggtataaatgttgtagctgaagggcaactgacaagagaaggcagtggagacttgggaaaaagtgggattttaggtctgagagaccttcaagttctagcctgggctgcaggatagaaccctaggtttggtactttgaccctcggtttggtacttatcctcttgaggccatatttcattatataaaatgggaagtcagtaatctatagtgagagctacatgtaagagtgaatttatcttatgaactaatcattggccttttttgctgtcagatctattccttttctcccacttcattatctgcatggctgaaggttcaacccctgcaggctgatttcctagctctttcccagctgggtttagccaatgagaggcactggcaggagatgggcaggcaagcacagctgctgtgtttgctttgtggctccagcttgtgtaagacaggcccactgtggttccagctttttccatgactctggccctttggtgctggtaataccatcctctccttctgtccctccagccaaggagtggtagtagctacctgcagttgttagcctccgggttgcctctttattctcttttggcttcttagctcttttagcagtgatgtatctaagtcactgtattacattccctctttttagaatgttggagtggttcctatttccctcattggacccttattgatccagtccatttcggtaatctagctgtgagctgcagtacttcaactaggctggttgtgatagaaatagaaaggaaggagagacctgccaaaggagaaagagagcagtaacctattagatggggaaaagatcaggagaaataaagcaattcagataattgtgactgccattgttgaagacaggcctttggaaggggaactggtttgggtgtagaaccaatgggttttgtgtagagcatgtcaaagaagataaacttcatgatttcactgcctttcccacttcagtgtattgcagctgcaggagtatttatggagttgcctttctctcttgggaaagggtaaaaatgttcagaggaaagagatcaggggtagctacacttatgtcagataaaaatagactttacgtcaaaaactacaaaaagaggcaaagaaggtcattacataaggatacagaggttaattcctcaagaagacataacaattgcaaatatgtatgcacccaacatcagaacacctaaatacataggtataataatgtgattcaagtccaatattcacacatttacacataggtgtaaaagtataattcaagtccaatatttattgattttttgtttagatgatctgaacagaaaatcaataagtgttggacttaaattacattttcaaccaaatggacctaacagacatatgcagaatactccatccaacagcagcagaatacaccttcttctcaagtacacatgaaacagtctctaggattgatcacatcttaggcgacaagacaagtcttaacaaaattcagagaggacagcagtgtgtggcccagaagggaatgccccctggtggcttgctaagcctggaacacatctaacaccattgactccagccccatctctgtaacttttttgggagtagaataggaacccattctttgccagttgggcagcagctctttaccaagggaccaagatgagcaggctgttccttttgtcagtgcaacatttgcaagaggagtgctgtgggaggagataaaaattgacttccaaatggccagcaaaatttcagagacatttttgggactggcttttaggttcagacttaataagtaaaacagcagatacttaagattttgatttccctgtgggttaagatagttcatagtggggatggccaacattgctacagcaagctggaatccacttcctcaatgtactggggcattatggaaaataatgatctctgagggagagaaatgattccacatctttgggaacaatatctagatatattaagaaatgacctcagatgaaaaacaaatataaaaacattttggcaaatcagaaggtgcacattatatggcattcatgatgttttatatagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctctgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaacagatttttatgataaggattgtatagccacctttacatctttttctttccttttaaataaatgatgaaagctccagtgctgtcataaaatcacatttatttgtagtgatagggatgaaataatcactgtttcatcaccgtgatcagcggtcacatacacacaatggaacctgacatgctggcagcctcagctcattacagctttccaaccaacctccaagcttatggctggaagtcaaatggggtgggcaggttccaagtaggaaagaaaaataattggctttggagataaagggattatttaaatttccatatgaaatttccacaatttcttggcttcaaattgagagggagttacactaagatgcctgtgtttcaattttaaaattaaaagcattcaaagaagtggagaaaattattatagacaacaaccatttcaataacatttctctgtcttcatgttgtttatcacactattaattacctgctaattaaaaacaaaacaactggaaaattctagcaacagaatttttcatcaggaaggcttttggtttaataatttttttcttatccttacaatatcaagttgttcccctcccccccataaggattgattagtttaaaagattggtgtttgatcggaatgcaaacatcagtgggacaaagtgggacttttctggtactatgtagtttttggagaccaaggcctctgagtcagacagacctaggattacatttaagctatctctcctttgagccagatttgaatctcaatttatctttccacttcgtgatcttgggcaggttacttaatctttcaaagcctcagtttcctcatctgcaaaatggtgataatgaaaccaccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcgatggttgagacctcacagtgtagatagacctgttgaagtgttgggtgttgctgactttgatttgcacccctggacaccacattcagcacctggatagctttagcagcaatggcaaaagatgaattccatttcaatcaacgctatccacaaccttgatttggggtttttgaataaaaatagggttttatgcttgaggatatagcacattttgagctgctgagtgagacttgcacttggcatgtgtgggtgccctggtgaaaactcagggagctttgcatttcattatatttttaataatgcttggcaagtagcagaattaaacttgtgaatcatttgaacaaccacttttcttaatggagatgagcctctttatcttttaggagtcaatactctgtggttctaaattagagtcctcgatgtgattgtattcctctcaaacagtattaagaacttattttataatggagaggttcataatgaaagcagtctggggaacgaggcatcctaggctcttgatggtgctgggttgaaggacaggaggagctggtgaggatgtggccaggacctgttccctggtgtgggggtagtagggaggatactaacctttttttactgtgtactagatgctttgtacacattgtttcatttagtcttctcggtacacctttaaggcaggtattgtcatgcccatttcaaaggtgcagagagatgatttatccaagattacatagtgaatagaaaagcagtaataaaaggaggaaatatcagttttggttacccagtatattttgtgaaaatccatcaagatgtatatttataatttgtgtacttttctgtatatatgctcacttcaataaaaagttacttataaaaacaaacagatctgcctgacaaagtctatgctcttttctatcatactaccaccaaaaaagtatgatgcatggaactccaagtgctttacaaggaatttcctctgtcagtcacagctaggcgtggcgagaaatagtgctactcttattaactagacctgattttgaaagacttgaatatttccaagggaagatacacttagagaagtatagtttcctaaaactgcagatgtctatgtgttagacttagaagattattccaaaatcgtgttctgaaaatgcatttagcttgttgcagagttgttcatagtaatgtaaaattggaaaaaaatagaaatatccatcaaagagggattcaacaaataaatactatgtgacttaaaacttacctattttgaatgatgcctctgatatagtgtggagtgaaaactggttttcgaactgcagatatagtatgatggtatttttgtagttgttttttctttatgtaacatattcatataaataaatggctggaaagatatttgccaaaatattaatagtgatacctctgcatttttgtgatactggttgaattttactttccattttatgtccttctgtatggttggttttatatagacattgctttcctacaattctataaataaaattttaatttttaataaaacagtacctttaatcaaaggctgcatcccaaattaaatatatcccttctcaaggtgtctactgtaaaggaggaagaattcattttagtgtatgagtttcgatacatcaaaataatattaaattatagtcaaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaagttgctctatctacctgtaccagatatcatagcaatctaaaagatagctgttttacttatccaaatatgtgtcttatatagataggtcagtttcaaaaattctccgttctttttagattttagtataaagacatatgattgctttattttattttattctatttcattccattttagcgattccttcaatcaggctgaagacagaattaaaattatgcacattaaatactcatgcaaaaacagattatagagcaggatatgactttcatttttgtctttttcttaaagatttccaaggaactaacctaagagaatcctgagtacatcttactgtgggtgtcattgatatatactgtttcattgcctataacccccaacaggaatcatgagctctagctgagttcatataattactaccccctgaacacttagcagtcctgccatttgctccttctggataagcaggttccctattctggctactctcctgtattcttgtgtgactttatccatcagagaccaactcaagcttttggggcatagccaacgctcccctccaaatgtgtatacctatgaaaagggacaacatgacctgacaaaattctctttctgatttgtgagttgatacatatgaaaagtcttagagcatataaaaagaaatcaaatatttaaatttgatgtatctcattattaaaaaatatatgaagaatcaggatgttattatctggaaacatctgtttggtttctgtatagtaccagtaaagttgatttttatattgtatgttttacatactttgaggtagaaaattatctttaggttaactatgcctgacagacatcatctcttttacttaggcaaggcatttcatttgtggaggaagaagtactttgcttgacagagaagaagagaccgcgaggagcctggtgtagttggaagaaagtagttttggcactgagggacgagaaagctgagagaggatgggagagtgggttcagccaagctagccccctgcctcctctacccaggacacacacactcagaattttaagtacaatcatggagtttaattatgtgtggatttctcaggaaattgggaaaggttctgaattctctgttttgcaagcagggaaacctttgagaatagaggtagcccaggcaaacagagtaggaaagagatggcattttttgttgcaggaattccgtcgatgcacggggacagaggggctttgcgctgtcttgggctgtggaattggagacaggccatgtttaaactgatctctaaaggtgtcaggttggcagggcagcgcaaggttatctggctgcatgaggttatctgactgcacatactgttatgggcctgggatgtcccctccctgtgtacaaatgcaggagccacaggtgctgctgacagctcacaagcttctgataccctactgaattcgagtcctttgaaaaagaccactagttggctcttctcacttctttttcattaaaaatgaagaaatcagaaacgaccattcacttaaaatgtggagaaacaaaacctttgatagtctgtccattcatttcctgccatcttcaccgctgaaaagtgtactaactttaagtgactacggtaatgggcagtggaacccaattcaaaattcagcagaaaatttatgatctaattttgatagagatatgtgaattatcagtgagttgaagttgtctctgtgttaagtcattacagatgttaaatttagcaaagacatataaactcctgggtgtggagagtgctgaatgttgtagtgttaaacacaaatgtactgcttgttgaattggtctcagatgaattttcctgctgagctgacacagtacctctggccgagttggaacatttcagtcctacagttcaccatcgtgctgtcaatttgtccatgaagatagtttatgggaatgcattgacacacatgtacatgctgttggaatcttgatggatttctttctttccttcctttccactgccccaaacttttctatagaactttttgattagcatagttcaaatttatgttttgaaaataattaggttcaattaatcagagctttctacctttatatcactgtttgtttaaagaaataatgttgattttttttgttataaaatagtggtagatgtcatcccttgaggtgacttgaaaaatgccaccttcctttaaagtaccattaagtaaaatgaacataaggaatgttaatcggattgtctcaggatcaatgcactgatattgatgtgttaaatattgtggttattagctgaaagtatttattaaccctaataagccagcaactctatggaactttctatttaacttttctcataagctactttgggggtaaacaaatcccaattggaagtaaggactgcaaatcaacccagccaagtgtaatgattagcaatggaaatatcccattgtggaattctagttccatatgctcgtgaaaaaaagattacagataattataattaggaactcagtgtgtgggagtgaaagtaatgattactgaaagccactgatcatggtgggagtaggggtgtgttataaagatgtgaacattttatctaaaacgtgcactctgttaattagtaactttcaatacatttatatcttaccgatacaatttctattgtttcttgaacactaggaaatgcttgaggtgtgaatattgttttccagtgtgatttgtactacctacacattataaagggatgttaaccgttcgaatcctctttaacggcccccagcagtgaaggagggtgggcagggagaggaacagctgttgcctaagaggggaaggaagggagggaaggggaactagagaagctggcttcattggtatatgatctgggataatgggaagcactgatttaggaattatcaaatcattcctccattgcaaatgtatcgtcattattattattattattttgagacaagtctcgctctgtcgcccaggctggagtgcaatggcaccatctcggtttactgcaacttccacctcccgggttcaagcaattcttctgcctcagcctcctgagtagctgggattacaggcatgtgccaccacacctggctaattttttgtatgtttagtagagatggggtttcaccgtgtcagccaggatggtctcgaactcctgacctcatgatctgcctgcctcagcctcccaaagtgctgggattacaggtgtgagccactgagcctggctgcaaatgtattataagggtcaataggtacgttgattcttactttttcctccatacacattacacaatactgagaagaaatgtattccatcctgtctagcacggcagtggttggactttaataaatgacggctcccttcctcttcatctgagtacattgaactgctacaattcattagtcagaaatttgaattgtttaggacatggtaagattctggagcctaattccaggaaataaagtgaaattcaaaggaagccccagactgctccaaatctgcccttcaaattatttgtctcatttacacgttatttttttgaaatggcaaagattatcctttctgataaattttgtgcattaaaagacaagttttatctattctaggggagctccaaatttatacaagacaattgtgataaattttttcttaaaggaagaaatcctttattatgcaaataaagcttctttattaacttctgtatatttgaatggaggttggacttttctcagttacctacaatttatacgtaactcaattatatatacttctctagaactgcttatgtaaaataatatttcttaacacatttaaagtggtgactccctattatattgcaatacccttcctctttttttctgaactaacaatggaattaaaattcaagtgctgaaaaaacacggtttcagtatccttatattcttaacatggagccatcatataattaaatgcaatgtctagtttttttcataagtgtatgaagttgaatattctgatttggtgcagtgttttcaaattttcctgaccataagaatcacttgggggtgagcctagggtatcatttgttaaaaaaaataaattcctggcctcccccctttaacctactgaatcagatgtgtagaacctgggaatatactaagtcaatgagctatctcaggtgattcttataatcaggtaagtttgggaccaatgatgtaatgcagtaaaacttaagggtgtatcagaatcacccttgtcttattaaaacccaaaatttctgaaccccacccccagatccagtgggtgtagagtctgaaagtctgcaatttttaacaaggtccttggtgatgctgttgctggcagtccaaagatcacactgtggggaccactgatgtagtggaaagaatgtagtcttgagatgagacacatctgggttccagtctcatttaatagctggaaattttttagtatagttacttaatactatactaagtacttaatactatactttactgagttttttcctctttattttcaattttttaaaatatccttaaataaatttatacactcatacatatatattatgcttgggtttaaatgctaccttgaataaatatggagcacagatggaaaccgagaagaaggaggcagaaatgagagcaaggaggaggctgataagtaggttcaagggagagtgagtggtctgcacagtaataactgtgtcctagaataaccagaacccagcaaaacaacataatcagaagcaaactcaaagtgaatgtattaaaagtcaagctaactgtttactttgcaaggagaagagaaaggtcacttggctgtacaagtatgatagcattgattaatttgaatgctttgtctgaatcattactgttgagattctgaaagttcagatactgaaaagaggaaaataatgttgacatggagaaaccaatcatgtgagagctgtttttcatgtcagtgaggataaaatgattgctacctgctctttttacacacatgactaatgacatatttgtaaacttagttttctaagaaagaaacatagccatcatatttagggttcataccattatttaaatttgtatactgtgttccatcagcttttcatgggaagtatttttatcctctctgatgatttgaaatagaaaagccaatttgggtgtaaaatccaatgttcaggcagaagccttatgtggagatagtgttcccacagaattgaactcctggagtactggttaagagcaagtactccaggagtcagatatctgggttccaatcttgctttcacctcttagggcccgttctgttgccataggaatgttcaataagctagtaatcattatagtacatagctatgggatttctacaaacttttattcaacaagtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcgggaatttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttgaaaatttaagtaaaatttgtttccagggccaaaaggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatcattttttaaactttcccaaatctttggcttatcaatgatgcattattctgtcaccctattaatgtatgtttcctttgtcattcataaaacggttgtattgtttggccttatggaaggatgttgattaagtgcctgtgaatgtttgctttattggcattgagaaagaagagaaaatgatttgttttgccaacaatgaattattgcatctgtttgtggctgttaaataatttaatagaacttaaagggcctattttcccttgattaaactacaggaaaatatcagtctctgcctcaccttggatacaaagttagatgtaaaacatgtttttaatttgccttttgccagtttaggtgttgataagacactgagggatttttatattatgccatttttacatttaagttgaatatctctttaagcttgagacaaggaaaaagtgttatgaacaattttatttctaaatagcttgttcacttttattatataatattagtaatcgtgtcaaattcctaattataccaaatatcaagggttacaaattattattactgaaaatttcaaggaatataatttatttagtggaaatcctgagattaccaataccactattttccctctcctttgttagcttttctcctaaccaagctcaaaatgttctgcactttcaaaggtcactgctaagtactcttctctttttattctgccttctttccttaagttatctcattcagccccatgattttgaaaaccactaataacctgacagttcctaaatcccaaatttttaccttgaactcagggtttatcttaggatctagttccttatttacaattgtattcttaatactctagagccacttacaaatctgttccttctatagacttctctgtttctacaagcagctcctccagcctctcagttgcccaaaccagagatctggggatccctctctccctctccccattgctcccaacccagttcatcagtagctcctcaaataaatccacttttctcttgttctcaccttagttcagtatactgggaactctcttgcaatcaccaagtggttactccattaatttgtatctccaaatccattctctagcagctagatatattttttcttttgaaaatgtaagaactttcacttctttgccttaaaacctccatagaataaattccagatttataaaaaatggcttttacagccccctgccacagcttcatttcatttcctccctcctctcctatgcatttgctgtaggggcctgtgttagtggagtctcctcaggatcttcccgtgctgtttcttctgcatggaatatttttcccacactatttgcctggcaatttgcctagcttgtgttagttcctcaggggatgcgtagtaccccactccagtctaaattagttcccctctacctaaaatactccatattttctttcagagcagttcttatcattttaaattacatgtttgtgtgattatcctttaatatatctttctcctacaggtgccattacagtatatgcactatatatccagctcagtgcttgacactaaattgggactccataaatatatgttgaagaacttcaaatattccaaaatatgaagaattttccataccatgtcctcttttttgtggccctctttttttttttttttttagagacggagttttgctcttgtcacccaggctggagagaaatggctcaatctcggctcactgcaacctcccctcccggattcaagtgattctcctgcctcagcctcctgagtagctgggattataagtgtgcaccaccacactcagctaatttttgtatttttagtagagacagggtctcaccatgttggccaggctggtctcgaactcctaacctcaggtgatccacccgcctcggcctcccaaagtgttgggattacaggcatgagccaccgcacctggcctttgtggccctctttttgagcggcatttttgccaagtaatatagcactgttgggaagagataattagtgtaagtaacagttcttttttttcaacattcagtgagggaaaatatcaataatggtaaaacttgtattccttcccgtagtgaagggtgagaaaatacacttggaactagaaaagcatagtagtaaaatgtagaggtagtataaacttaaaggaaaaaaatttcaccaggactagaaatacctgggtttggcatctgactctgccactgatttatgtttttggcatgttgttcagtctcctgtgtcttgcattttctcatctcaaatcttcagagatgtcaacagaaaacaaatgtggaaaccctttgaaaaaattaaaacttcttagaaaggtgagatgctcttaccctccttattttgattttcatttttgaacacaaagtggttttacttggaggttcttaaagtaataatgaacacagtcattctcatagataagactagctgtcactttctctcaattcatgcaagtgttattaagaaaccacctagggatgataatatgaaattaagtgtagtgaattcattatggattgcctttctcattttttacaaggtttcctgatagcaaagctaataaagtataaatatgttgaggtgtcaagtattttttttaaagagattaattagagctcagtccctaagctatttgtaaattactatactttttcattgtaaagtgtttagtggaaatgctgttttaataaaatgattatagattataaatggtttcattaagtactttatttccctgtcactataccagttctacagaaataaatgactttaacgttctttttgctgataatttaaatgagatctaaaagatgaaacattattttgaaacaaatttaatttaattgaccctgcatggcttggaatctttgctgcccatgatccttttatgattaaatactaaagaagaaagtgtaatgtgaatatttttcttttatttctacatcatgggattcacacttcctgaggtgaaatatcttattcttttcagataatattagtagatgtattagaaatttatcctctcaggggttgtgctggtcagtttcatcaacaaatggaattcaagatcccttagtaaaacgaatgaacttatgtaacaaccacaccctacacacaattcaaatgtgtgttaaatatctttgtgttcagacaaattgatagcctagagatcagtatgtgctagcttatagtcctgcaaacaagtgtgatgtttattccatttaaaaattgccactgaggcgggcttacgcctataatcccagcactttgggaggccgaggtggacggatcatctgaggtcaggagttcaagaccagcctgaacaacatggagaaaccccatctctaataaaaatacaaaaaattagccaggcgtggtggcaggcgcagtggcaggcacctgtagtcccagctactcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggttcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatatttcacctgaatttggctcagatttacatgggctatgagagcattttttattttagttaccatttcttattacttataattatattctcattctgcagatattctcaggaggcaataagcctggtggtaattgagcagatttagttttttgaaaaaatatattgacaactatatttttcctgagagtgtaaaaatgattcagaaaatatctgctattttaagtaacattttgagtgtaatattgcattcattagttgaatgtcctgagatttcacatgttaaatgtagagttaagtacaattagtagaagagtattttaagtggcagagatgggcagaaattattttgtggagtgagattagttgagttcagataaggaccctctattaaagaagaaataaaggaatgtggattagaagacaatgaaagactttttggtgaactaatgtatactttctgaagatttgggagtgtgttgcggggcggaatgcaaaggcaaatttgtagttacatatctagacatgaaaatagagggataggccaagttcacctgatggagagcttttaaggctacattctatatttgatgattgtggttgaaattttataattattaatagtatgtatgctctgaaaggtaaaagaccttgtaacctatatgtaattcttactgagcccaatactttgggatatacttaaatcctaattcaatatagcagatttgaatcttattatcagtggagtgcatttaattgaaatcaaattgatttaaacatctagtaaggaattctcaagtttaaccttcttttccacctctgggtacattcatatgcttacatctactctcaaaccttagaggtagaaaaaatttgatttaagagaagatacacattttcattcaaattgattgtttaaatatttataagactaattttccagatacattataaaactgaattgtgctttggacattcttttcaccacagctaactaatattattagttctaaaatgtaagatactaaaataatttccaaatcagaggtctgacatgatatttaagggctatttttacatattgtattagaagtgcattgaccattctcaagaataataaatatttcaaatattgtatttaactaaaataacaccagtgtaattattttaataaaaataatttcaaaagagcccttgaactcctgggctctttgaaattttaaccgttctacttatgactcaaaaaagcttaaaaaagatggatgtcattaatctctacaaagtgtatctattgttctgataattcatgaggtaattataggactaatgctttctaattgtctttaatgtgcaaatatctttaatatgttttctcatagtatatgctaatatatgttaattttaaataatttgagcaatacagagaaagaaaattccataattttgctccctttttctagagataaccactatcaccaattggaatatattcttccagacttgtcataggtaaatggtaagctctcaagctctcatattatactataagtactcttctgttatctgctttttaagtatgcacacacacacacacacacacacacacacacacacacaatgcattttaagatttataggtctgcatcacccattatatgggctgtataggatcctgttacatgtaatgtaccataatttattttgccagtccttggaatggatgtttagtttattagtttatacttactttttaaaatatcagcagcatggcagtgaaccacctcttacttatatctttgctcatttactcaagtatttccttcagatttctttaaattcctaaaaattaaattgctggatcaaagtagatgcatctttaatgttttaaaatatattattacattaccttccagaaaagttgtacaagtttatattcaatgtactgttgtacaaaaatttccatttccctacctttagtaatctgataggtaaaaatagtcattttatttgtctatacctttgtaaacatatatatatacataatgtataattatttgggcatctttttatatattctctaaacagttatataattttgtgaatttgtcttttccaaaatttgtttgtgaacaatttttataaattaagaaacacatagcaaatatttccagtttcaattttttaaaaaatatcaatacagttttaagtttctatatggtcaaatctatcaatcttttcctctatgctttctggtcttaatatatttgttaagaaaaggtcttcttcacccaaaactatacaaatatactcttatagtttttcctagcatttctgtgttttatttaatctttaatctatttaaaattattttttgtctgacatgaagcagaaatctagcttttttgttcaaatgaatactcaattcgttaacactaataattgaataatgtattgtttcctttgttatttaaaatgcctcttacaactgcatccattgaaactatcccattgggcttttcattacaatttgattgtatttgtctgctaattagtgaagaatttgaattttgccagtagtatgtttttggtaatttttaacatttttatttatttaatttttccttttaactttaagtgaaataaaattatataagttttgcacatatcttgttaagtttattcttgacttgtttataatcttaattactgatttgaatgggattcctctcacccccattcacccctgccattatgtttagaaacaggttggcatataaggcagctattaatttttctatatttatattatattttgccactatcacttttactggttttaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtgggcttttttgttttgtttgctttttgattttcatgagaatgcgtctaaatcttcagcagttggtaaaatgttttctctaggattctgaaatggttttgattatgttaaggaagttttcttctcttctcagtttactgagttttgttgtgaattgatactgtattttgtcagatgtctttggggtagtttcagttatgaacaattgtttttctcttttaaccaatttacttattgaattacattgatggactgtctcatgttgactcattcctacattcctggaataaatctgactttttgaagaatatatttctttaatacattgccatatcttacttattttcataaaaagatctataattcacttctctggaattttatcagattgtggtctatgttttacaaagtactttagcatgctttatttccttttttccttgacacagccctatgaatcaggctaggaattatatttttttgacaaataaaaattatagacatagaaatttgctttgcaaaaagtcatgcaagtaggtggtaatggtgagtaaaatttattaatctctaatccaatactttggtttggagagaaggaatttaattagttcagtaatttctatcagtacgatatttatggactttgagttttattatctcaaataaaaactatgcttatgtagttttcttttacatttttctaagttgagagaatgaatttgtttccattttgaccatggaggcttcactgggtatgaatgggggtgagggagagttcaccctaaaggagtccctgagctgagaatattcattctctgatatctgccatctgttccttgaacatgagcagatgctgatgttcagttaatcagaggtaatgcaataaggattaaagtgttagatagttctaacccattccggaagttatgggtaaaacttaaaacctttaatcagattcatcttgacgttgaaaccaagttggctatttgagccaaaggttctgtatctctatgatagctagtcccaaaggacatattctattattgtcattaagagaaaacatattaaggatgtgtttgcacacagcattgggtcaagataattgacattgtattttatatgtggttcagagatctgtcttatggaaaactcagagattgctttaaggggtttgttgcaaaagaaatattcaattaggcagtttaaaataatttaaatgtcagttttacaatacagacttaatacaaatgcaagaaggagtccatttgttgatatatacaccaatttattaaatggtagaatagacttctccaaatctagagaaagatcagtttagactattaatgtattatttcttaagtttgaatagaattaggttttttaaaaattgaaattgaaatttagtctccttgtcccaagtgacatacatttataaaatgtttttaaaaagtaaattcactgtttttaaatcttctacagaatattttttgtaatgaaaaacctacatgtatatattactgtacagtacaatagaactgatttcatttctaagaaataccactagtcgttatatattttatgtcattgagttgaatttgtaagtgatgcatataacctggagttttgtccttaccaaatattgcatagaaaaccataaattcctggaaattgactatttttcaaactatctcattaatgaaaatttatgctctgaagaaaggctaattatgtctcttatttccacttaagctggtataactgtaaatgattttcttatttttataaatcacatctgttctaaaacttagctccaataacactctatgataataaatggcaaaactcacataatattgaagcacattgggtatttccttttcagttttaaatatgcttaattcaaatttagatgattaaagaatatatttggactccaaagtgactaaaatcaatgaaaataatatattggtgtgtcatagttgggggtaaatattaccattaaaaactgaaaagtcgagaatggtgtgaacctgggaggcggagcttgcagtgagccgagatcgagccactgcactccagcctgagcgacagagcgagactccgtctcaaaaacaaacaacaaacaaacaaaaaaacccctgaaaagtcgcaaggaaggaaaaacgattctgtgaactcactacataggacacaaagagaggtgggaaattttgtcaggaatgttcgtgacatgaactctatttaataatgtcttattcccgttgatattttaatttttcagataaagtattttaagtaaatgtgcaacattaattagaataaaatataaaagtatgcgtctatttgaaggcctacctaattacatataattttctgatgaatgccctaattaagcatcaagttatatgtttatacctgtgaaataattggagcattacatttaatctttataacaatacattgaaagagaagtattagccatgtaggtattaaaggtatacatttagctagacttcatcattgactttccttttaaagggacatgacatcctgttttccatcaagagaacatcgaattaatcctcacaccagaaacaacagtcagtgctggcataagctccgccaggattcctgggccctgctgtgcaggggtctcctgaggaaggacagaatcgtatctcggtctccaagcccacttggttcttggcacttctgctaagagttgcgcaggctacctattaattttaaatgtattgtttttgaggatgaggcagacatctgtcttagagggacaggactgatagccgcaagtcgttcctcagaggctgctgaataaatcgtcagatgacctttattgttgtcaccctcattttgttcaaattgacgcagctaaagcacagtattaacaaaactacgcattgcatgcagcagtgggattagtgaaaaggaccatgttgttgactagagaaatggaagttcacgtatctcataactgcgtacgaagcagtggactgggaaggatacaagaggagaatgacaagattaaaataagagacaaggcctttacatgaaagcagctgacactacaaaggacgtagtacttctgtttaataggcctcatcagccttttatgctcccttgtgggcttggctcatgaacatctttaatgttatttaaagctgtttttattgtttatttagaaacattctttatacattttgctctaattattaaatttgatgatctttgttcttatttactgatttaattagctacaaacattcatacattaaaatttattccggacaacattagtgttgggattaatgattttttaaagaacaaatcacttgtacaatgcatagcccagagtaggggctcagtcaatctttgtgtaaatggaagttgtatttgaaataatccattggatgtgtataataagaatcattcttgcagaaaaaccctaactggatggaaactatacagaagaagagcttgagataatcacttttatttagattgtcccttcttaatgagttctaatgagcaaatgattgcagtgaggtacagcacagtggaagcttcttctgtttacaaaaacaaatcaatggtactaactacccactctgaaatggactcttttttttttctcagcactctatcactagctttgcctgtagaacatcaattatttttgcttccaagtgaagagagtcatttcagagaagatgtgtaaaatttagagggtcactggctgcccatattttaattagtatcccatccccaccacagcgtatatatcagtgtgggtttcctaaaggagatggctttagtgcgttttattaaatgaatcaccttttataaataaaatttaatggtaaattcagacatagaacttaatttggctagagaaacttgcatgcatacacttagcattgcctttaattaattctgttgacttagaagatggtgtagacaataaatgctttttttattgatcataaaataactgttcagatccttaccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctctcccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttcccactgaaggacttttgttccttccctggaaccctttactctcagtcttgtcatggcagcagtttgggtctcatttcgttctctatcctaggcatcttaaaaggaacaccatcatggcacatgtatacatatgtaacaaacctgcacgttgtgcacatgtaccctaaaacttaaagtataataataaaaaataataataatttaaaaaaaaaggaacataagacattctcttgcccaagttagcagtaactgcttaactgctgaattcagtaagcttatcttcagatcttaatttccaacacgctttccttttagtcttggcttctgtggaagctcattctcctggttttcttacccctcagctcttcttttcttttaggtcttctctcctgcccagcctctaaatactggtgttcctctgggtttagctcatctctaactgcttttatttaataggtgactgtactatgctcaaggttctatttatccctttacgggtataacttccaacactgaaactgcagcccagacttctccctggaggtttgactcatatatccaactttccattgggcaacttcacctagatggcccatagtcatgtaaaatccaccatggcccaaagtaaacttagtttccacttcaacttcacttcccctgatatttcatacctcatttagtaatatttccattcacttctcactcaaaccaaaaacctagaagtcatcctttactcagtcaagaagttgttttacctcatgtttcttgatatttcccactcttcttcatcctttttattaggaacctacctaatcccttcatcctttttattaggaatcctttttattaggataccttcctaatctacctaataccttcatcctttttattaggaatctagctcaggccatcactatctctttattgtaatgctgaatgaaatagtcatctaatgtaccatcttcagttttgtccgtatcaaatccctttagcacatatgcagagtgatatatctaagataaaaatgaaaccttatcagtttcctccaaactctgtaatgtgctagactttgtcacagagtaggtacctattcttgtttgtcaaatgaataaatgaagaataagaccagaggcttctcagtatccaaggttggagttatctggattctagattgtatattgtctaccatcctttgagaatgtcatgtatcaaccaaatttttgtttctcagttttgcttggaacttcacaaaaccagaatgaatagcatatttttatagtgtataggttgtatatatgaacagatagggtctgtatggtgaaaatcaaacctatgtgcctatatgcttatcttttagtataatctattaaatttttattaataatttcttaagagaacttttcaaatataaatctttccctcccttacactatgtagctggagttcagtgttatgaaacaaagattccttctcatcacagtttgacaactggtgttttgatttctagtctttagagttgtgtaaatttgttctaacaaagaatcattttagaactgtttgcttaaaaaaaacttgccaaaacaccaaaaagtatatgtgatgatataattagatatttaaatatgctcatgaggtcaaaggcagggaagcttgggcttggtatttcctttactcacttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttgtattgaataagtagagttttctgggggcttatcaatgtgttttgaagaaaaatgatttttttttaaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcctattcctaacagtagtagataagcaacagtgttgtagaaaataatttaaaaattaaaaagacatttggccattttccccttgtattttgaaatgatttctgagtttagaaatcagacattatagcataagattagatagaaattatctttatgatataaatgtaatagaaacagtgctcatagataaatcaatcttgtgttgttttaacaaaaaagtatttgtctattgctttactagttcatgagactcttcttgattctgatgattgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaatttaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacataacataaaatttaccatttaaccatttttaagtgtatagttgaattgtgttaagagagaattgactctcattcaatcatcatcatcataattatgttttgtatttaccaagaaggaaaactgatactcaaccttcaactttttctagtctgtttaccttaatattcctactttctcaccatcaatctgccaagatcttcttgagggaatacagatgtaggggtgtaggactctggtggtggtgaagcttagaaggagatttggagtcgtccacccttcagtccgctgaggcaccatttccatctcccctcctcccaacctgtcagagccaatagcatggctactgaaagaacagcgtgattgctctctgaatccagacattgtcctttcctatgacagacctggagaaatatcagacaactgaaccttttccagcgtattttgaatgtacgtaatcttggctgtagtcatcagcagacaagataattattcgttcacacatgctctggccaagttttagctcatttggagacttgtaatgactttggattctgtcctttgtaaaatgacaacctaagaatcatgtctttttactggttccaagttttaggtgggattttgatataagttttataatcatgtaggaattgtgggtcaaagcaagaaataagcattatgggcaggtggattcttttgcaggctagatgtaaaacatgtatttcttgaaggcttggcattctaggagggaatgtcttgatttaaggagatatggcagagaagagccttgtaagagaaagctattctgacatgagtggttttgttcttacaaataaacagtgactcaagtcagtagcagggcgatagactgtggagaacgctagcataatatcatacttggggtataggaaccatatacattcatttagagtagcattaatttcccatttaatatttgttagaaactattagagattttatcactctgctgacaacaattctatttggaacatgagctgcttatataaaaatcatttttaatgtgaaagctctcattagcttaaaaggcaaatgaaatggttagctttaaaagctgagtcacagtctcatttaccatcagaattcacagttttcttctttattttaattagtagattaatcctgtctcagcaatgccattaggtgcctgccttgatggtgtggaaaaatacacacaaacatctgatatttctgagcatttgggttgtgacaaatttaaatgtgttctaatagatcatctgtgtataaatagcttaagatttatagatgttttttaacttaaggatgaggaaactgaccactataggataattaaaaacagcaactctttgtaaatgcaggagctaagttgtcaaatgccagggcaccaacaggcaatattctgtaatctaaattgggtaatttatatcattgtcacttgaagatctgatataaattggagtcactgaatcatcccaccaacatctcataactaaagcaaattttgtttccttttcatgggtagggttttagtcaattgaataataaattatcctgtcttttctgaatcataggataggcaagcttctgtaggcagaactgatgaaatgaggccccaaagaagatattttaccctgttttaaaatatttccaatgaaggatatggtccagactactttggttatacttttcaatatttgaaatagtaatcttatgtggttgtttgaaaaatattttcaatttatcaccgaagatttgtctgaaatgttcggaagtcaggaatgaattaacttctatataacacccaatatcctggtcagtacctactcatagtcctacagttactgggtgtaaaaggcaatgctcctcttcctttgaaaagcataacctttcaagcgcttacagtttataaagaacagtcacgcacattttctcttttcagtctcacaatgacactatgttatatgaaaagattattaattcctatcagaaattaagattgagagaggttaagtgactcactcaaggtgatatatttagggagtggaataattacaactcaagaacatggtggcacgttcctgtaatcccagctactcgggaggctgaggcaggagaatcgcttgaactcgggaggcggaggttgcattgcactgaaatcacgccactgcactccagcctgggcaacagagcgagattctgtcaaaaaaaaaaaagttatttttgctccaaggacaaggtactttgcactctacattttgctgactctttggcatgccctataaaattgggcatggtaaacatgcattacgactcttttggaaaatttgttcctggggcaatcacgtgaattgggatgtggttgggagcatcattaattgagtctgtggtcagaacagagactagtataaagaaatacccagtgtaagtggcatcagtcagatattcagtgtaaatgaattgggaatgatagacacagtgaacggtccaagactgaaatgaaatctatcatctcatgagtattcaggggactggaactatattttaggaaggacgataggtgagaaggcctagatacaatcaagaaggaaacagcctcaaaaaataataaacctgcttaagataccctcttctgaatggatggagtttgatgatctgttggccctgttggtcagggaagggtgaaatgggctgaggaaactggaattctgtaacactaagatccaaggacacttccagaaatggcatttacaaggtgcaagtgttccctgtaaatcttctggcaaagggctttgaaatttaacttatattggaagaaccttaaaaagttagtagagccattcatatttctgtttggtttaagctgtgcctgctaataacattgcactgaaatgcaggcgtgaattcctataatgttaaaatcaaattgtttacctcagtttgaaaatttgctcaaatgagagtgattggctattgttagctctcaatttgactttcaagacaccttgaaatagcttcaggaaaaaaacgtgatttctagttaagctgttcagttaagcactttgtgatacaaagtatgttaaggtaaaaccttttatttaaatcaactttaagaaaacctctttagaaagttgcagagtataaatgaggaaacctttaaaaaaatacagctttatttcttttacgtatctattgggaattgagctaggtagtcgaggcaccagcatgaggttcttaagaaatctgctttaatgaacaaatcagagtgatttgtacttaatacttgattttgtttcaaaggccacataggcatttgaaaaataagtttttgcctgaatcctgtaatttcagctttcttagcaatttctcttttctgaaacagtgaaaatgtaaactttagggtagcctctgttcaaataatcacaatatgtgaattgaagtttgaggagttcatagagtgttactgaatttgtctgttttctaaaggaaattgattcatttttttcaaattattttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcaggtaggagaaacactcacactctccttccctatccctgcttattcctacccgtataatgttttattaataatctgatttgcaaaaatttatcagaaagattgtttaagtctgggtgtggtgactcattcctgtaatcccagcactttgggaggctgaggcaggtggatcacttgaggccaggagttcgaggccagcttgggaaacatggtgaaaccctgtatttctaaaaaacatgaaagttagccagatgtggtggcgagcacgtgtagtcccagctacccaggaggctgacatgggaggattacttgagcctgggaggtcaatgatgcagtgtgctgtgattgtaccagtgcactccagtctgggcaacaacagaacaagaccctgtctcaaaataaaaagaaagaaagatgtgtaaacctgtgtaccattgaactaagttcagtattgtctgtgataaaacagatatattttatgtttctaactgtgaatgctatgttaagtttggactgaactaagatgtagcaaaatgctgtatattaaatatccttagtacaaaactgaatcaatatatggaaatgtgcatctgaaacaatgggaaccaagtagaatatacaatatatgtgtgtaatacataaaaaatttatacaaacatacacatactaattaccagtgtatatataacatatttgcatatatgatcatgaaagaatttgaagtgatataaaacaagcataatgtctattaggttactttttagttttaaattaggtataatgacaacaataataaattactccccacaagaacaagtaaaactaaacaaaaaaaattggcactcaaactggttgaaaaatatttaaccttgtcttagaaatgtggtttaattgaaagaacatgggttcttgatcaaatctatccctgtgcgatcttgaacaaattatttcaggtctctgatcatcaatattctccatataaggtaagaaaaatagttacacttatcgcaaaattattattagagtaaaattagggtatatggaaattgactagcctgaacatttagaaattcaatattaagttttctttccttcattaatgcttataatctgagacagtggtaaacttaaaaaaaattacttaatatacttattaggctagtgttattgagatgcaaacaataacagatattcaccgagtacctgcaatgtgcaaagtggatattattcaattcactttatttctttagctgatgtgtttataataatcctcaccaaaaatccctgttttcaagatagataataaatttgaaaatgttaatgcatttcctaagtattgcaagttaacagatagcaatgttagcctttaaatccaggactgccagtatttaatagaacaacagggtgactatagttaataataactgtacattttagagtaacttaaagagtctaattggattgtttgcaactcaatggataaatgcttgaggtgatgcataccccattcttcatgatgtgcttatttcatattgcatgcctgtatcaagacttttcatgtaccttataaatatatatacctactatgtacctgcaaaagttaaaaattaaagaaaataaatccaggattgcctaataccaaaatccatttccattatcattcatgtgcagaaccacaaacccacggcacagttaaatacttgtggtaggttgtcttagccaccatttaaaaaatagagtcccaatatcagcatattctatgtaactttttctgacataattctagtactattataaatccctatgttagattagttataaaccatttctgcacttaactttatagattagactttacatattttatataatcttgaaatatgtactttgcatattttatattatgtatttaaaatacatagaagtgttatagataaagtgtatccaggtagcgttgatagttcatattatcttaacataaagtctttggggttaaggattatttggagtctaatcagaagaaaaatgaaggtgatcattgtcatgaaattcatgagacacctaataagttaggtactgttcactgtgggtgaaatgtaaaatagtcataatttctatttcaaatgaattttttgaaaagactgtaacatggacaaatgtagctctacatgaaatgtgctttcagtgtgtgtgtctgtcaggtgcctttctgatgaagtgacaaaggaatgccattgattagtcagatggagggtggtgagcagtagcatcctgctaccttgaggaaaaaagcccaagtgaaatgcactccagtgtacaacccctgccattctgttttcctgatcaccatgatacaaatcaaacatgacattcatgatcagccagtacttagttgtgtgactatcccagtggtctgctttgaaaagcactgcatagccttgtgtcccactctgctttgctttcatgggttgtttgtggtgattgctaaaaattgagcaagatgaagtatagttatgaattagccctctattatcttttaaaaatgaatgtacttttctgtaaacctgggagtgctggcggtgatgtgtcaggtggtcagaagtgtgattccatgttttcttcctcacagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctggtaggaaattgcgactccatatttttttacgtgtgtgtgtgtgtgaaatcacaaatagcagggactcctctgtggaactccaatgaataacacagggtgactacctttgaaacatggattggaggtagcatgcagagccggcccattcagcttctgctaagtctcagtggaaaactctgagaaaatgacttgaacctggagctgcacaggttataagtggaaaactctgctttagcaaggaatgaattattaaaaaaccctcaaaaatatgtacactcatcatctaaatgactttagagtgcaatataaccatttaattatatacctatgggaagtaaacatgtctcagtgctgccttatgatggttgagacaaaatttatatagaatctatatttttcagctaattcctagaatgtaccccttatcctcatggtccaaaatgggtgctgagctccagccataatatctgcattccaaccatcaggagtgatgaaaagatgtaagacatagcttcttcctttaaggacgtttctctggaatagaatagatcatgtttgcttttatttcatcagcctggagttgacatatagccacacttagttgcaaaggagaatggaaaatatcatttcaaggggctatatgctaaatgttgtctcttctgttactaggaaataaggggagaatggatattaagggacaaccaatagtctgctacagaggtgaataggcaattcacttaccccccacccaataacaatgaaaaattaaaaacatttaactttaaaataagtttttaattagaaattaagaaaatatagtaagatattcccctcaccattaaattgacatgttttttctctttaaaaatagtacctctgatcaagaatttaagcaaatggatactctcattcatctacttctagtggaaaaataaattgatatagtatttcttggagaaacaattggcaatacaatttaaaatgcttatgagtttgatctatagagttccttttcttggatttattctaagccagtagagagaagcataaacatttatgttaataattcaacatagaaagattagctaagtgaaatataataatctatattatagattcctttgaagatattaaaatcatgtgttagaagaatatgtaatggtatggagaagtccttacaatgttttgtagaaaatttgattacaataaaatgggagataggatttaaattacatttctatgaatatgcccctaagttgctagcaggttattaatagtgaatgtttttatataagagtgaattttattttcttatttatgcttttctgtattttttctatattcaccaaactctttataatgaacccaactaattttataattgcataaaataaaccttaaggaagaaaagatgaagattttgtcattaaaaaacaagtagaagaaagatattggagataaacattctacgaatgaaaaagaaaaatttccacagggcatgttctgcttatgaatgaccatacctgttataaaatgtacttcatggttgctagggggaaagtttacctattacctgtatctcatttttcatgaaatcaactttttcatcataaaaatggggactgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattgccatttcacacccccgagtgtctgacagtgtcttattttttgttttatctgctgaagccaagactgaaatattagccttttctcatctgtattattaaaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggggatggggtgggtagggacagatacatgtaatgatgatattggccttgaaattaaaacaccatttttactttctaggatttgcattgtattggttggcatctttaatgctcttagtgtattactgtgtgttaattttaaataggtcttctaagatctcttcagatctggagtgaacatttaaaaacatagatcaaggggctggattacacttgcaatcccaggactttaggaggccgaggcgggtggatcacctgaagtcaggagtttgagaccagcctggccaacatagtgaaaccccgtctctactaaaaatacaaaaattagccgggcatggtggcacccgcctgtaatcccagctacttgggaggctgaggcaggagaatcgcttgaacctgggaggcggaggttgcagtgagccgagactgcgccatcgcactccagcctgggtgacagagcaagatgcaatctcaaataaaaaataaaataaaataaaataaaataaaataaaataaaataaaataaaataaaataaaataaaataaaataaaataaaaacatagatcaaatcaagtcactttcctgcttaaaatcctccaatgggttccattaaaataaaacggaaactcctgactgtggctttacaaggtcatttatgatttgcccctgcttgtctacctcacctgcctctccatccttgcccaatctcactacatctcccaacctcatccgcctctcacaacctcacccgtctctccagcctcactgcctctcccaacctcacctgcctctccagcctcccctgcctctttagttttacctgccgctcccaactgcacctgcatctccagcctcacctgcttctcccaacctcacctgcctctttagttttactgcctctcccaacctcacctgccagtccagcctcacttgcctctctcacctgcttccccagccccatttgcctctcccaacctcaccagcttgtcccagtctcacctgcatctccagtctcatctgccttttctagcctacctgcctctccagcttcacctgccttccccaacctcacctgcctctccagtctcatctgcttctccagcctcattctcacaccctctattttgctcactctcttccagccacactggctttctttgcacatatttatggggtatggtgtgatatttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaaatccccttgattttacctctctgacaccacccttgctgaattgttccctatcttatatttggctaaaaaacttacagagtaaggcaaaactatggagacagtaaaaagattattatttgccagggcctttgagtgggtcagggagggatgaactggtggagcacaaaggatttttaaggcagtggaactattctgtatgaaactgtaatggcagatacatgtcattatacactagtcaacaacctatagaatgtacaacacaaagagtcaaccctaatgtcaactatggactttagctaataagaatgtatcaatagtggcttgtcaattgtagtaaatataccacactaatgcaaaatgtaaacagtagggaaaactgggaggtgggggtagagttagagggtgaggactctgtactttccatttactttttatgcaaacttgaaacttctcgtaaaaatacagtctaaccacccccccaacctaccacagactattaataaaaactgatttggatgaataagggaaaaaagcaaatccaagatttattgcctagtggtgtggttggtgtggggagaaggtattccaaaatgaacagcttgggttcaatttagacttaagttgcttaaatttttggatttcttgaaaatggtaatgaactgtgtagatgccatccaagaggaaaaattgttaccactaaaaaatgcagaatatgtttagaataaaaacaacctgaaatctttcctgaacagatacaaatgttttcttttttcagtatggaaagaaagaaatcaggcaacttggtagcctacatttgttgaaagcaaacttgagtgcatcaaattatactattatcaagggaaaataaaataaaatattctagaaaacactgaccctgagttcatctgcacagattttttcccctaaatttagctttccatatttattacccactataaataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatcagaagaccatttctaagtgactcttccatttattttactgcgattcttcttcttttttggctcaggtctctgaaagagcaagcatcacttccccactctggatttttactttctctggaaaaatatcccactgaagtaggtagtatagtcacagagtcatcgtcttttaaggctgataatgtcatataattatattttgcaaataaaagtaatatgactttttttcatttaggattcatcttaaattgggtgttgttaagagtaaaaattggttacagaaagagttacttagtgttatagccagaaaatggagatgtttaatttgataaacattttctgaactccttttaatgtgcaagccactgcgttaaatgttgtggaaggttcagcagatcttgtgcttcagcagcttaccagcaggagatgtaacctggtgaggtactacccagccctaggagtctactattggggatgtgaatatgttactcatcatttaacatggagttgtaatagcaggggattacactggaaaacattttgtaattttagtagggcactatcaaaactagtttgtttgaattggtttgacttttttcattctgcaatcgtgtttttatgcatgtagacttagctccagccctaatgttttactctagtcacatttctacgttttattctgtgtaaccaaagatgaataagcagagacggaatcagcacagatagtcatgatagaacgaatgacagttctgtaactcaagagaaataggaaaatgtgtaggaacacatatatttgccacttgtaaaataacattttctcatttgatatgccattttgtatatgtctttaggcttttaattattcaactaaacaagaatattttggatgcctactatgtgcaaggcagtgtgcaaggtgctagagaaagaaatagtatgaagcaaaacttctgtccttgaggaatgggcaaccctgatgggaaaggaggacttacacctaaaaagggaagtagtcacacgcagtgttcagagagttgaccacatggtattttatgtccttagctggagtcttagatcatttagtcctatgatagacttttcacagtgacttataacacacttcttctaccacctctgccacctggtactcagcagaattttatttccaaatacatttgaaagaaaaatattatctgactttatatactttcttctttagatggccgagcttttccttttcagtgttctcacctttctaatttttcatgcagtcaagaagtattttcctaatatatttgatcatttccattattttaagttgttatgaaaaatatttgggtaatatcttaaatatatcattctgaagtggaatagctacaggaggttgcaactgtaagaaataagcccaaagcattctccaaggtgacttctgtgctaccttatttaacattaacataaaagttaaaactttactatggtaagaacaattttttttaaatttgttgttaaaaaaaggaaatcaaaacaatctagagaacataagtcaagggttatttaatcttttactaagtcagttgggggtgatttggagagcagttgatagtgctagagtgagcaggaatctagcaaaaaagagctaattgctgtctaatcacgcttgcaatggaatgaatacactagtaagtattacagttaagccaggcataatggttggcttaaatacattctgttatatcagtgttataaccagtatatattcagcctcaggatgggaaagagttgtagttatgtctatagttccccgatttagttttgcttattgaaatccatttaaattaaaattggattcagtcaaagatagtctcattccatcactgtctcttattgtgaagtttgtgtggaactctattagtttgcatttcaagaagtatctttgcttgtatagtaatagaacctaaaaaaagaactgtctgctggcatgtgcccaaacagagctcggtgtttaaaaacaagatgctgtattcttggggtatggaaacttccttcacatgtgggtacagcaatgtctttggacacattttctgtgtaaggggaaaattatcagcatcttgaggagtggcaaaatttctacttggtaccaggatctctaggaccatggatatcagagatacatatccataagcaagtatttcaggttggcttttttttgtggaattttgtccatgcatactcaaagctggctttgcattcttgaatcctcaggctttgtaacacttttggttaaaggtagtaaggtagtcaaattggcctgaaaattctggagaaggtttactaaggctactcatctggatattttatgaaggagttaaatcgtaatgacagctggataaaaacaaatatttctaatgactactcaaggtatagctgacaactgtttggggaacaaaacaacaagagaaaaaaaatgatctgtttatgccaaaagggccccctgaagtagattttgtcaccattgtgaatgtggagacaaacgtcctctgacttgctgtgtgcaagttcacttgtcctgcgccattacaaatcaggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataaaagtcatcttgttttaaatgatctgaaaagatgagccactgcagaaccatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattagacttggagggaaaagcagtcatggcaaaatttattttcatgatgcttaatttgatgaatgttactttattgtttattaccaacttgcacttgcaataggaattctacactttaatatggtctgctcctcaagaatgcctagattctagtctaaattgtttcactagctagttgtgtggctttaagcaagctaagttttagctcagggttttcaactataaaatgtggttgtccatgatagactgtctttaagataacttctaagtagaaagattgtggttctaggaatttaggtctaattcaggataaaatgggaatctatgcaagatttttgagtcctaatatgacgaaagtgcatcttttcagtattattaaataattacattgactttgcaatgattctgggcaattagttaaacttcttactggtaagagctggaaggatagtttcttcacaaaagctggacaatttaatccatctttgagtaacagtatcactgcccccttcagtaaagttttctttttaaagacataattttactcttaactggtaactttacacacccctgctctggatacatctaatgcataaagtaatgtcaacctttatctgggcaagtcctctattcttttagagacaaagccctgacaaggaaataagatccattaggagatattcatgtgacagaaccagagaaaagctctttgtattactacaacaggcaaaggcaactagcagctcaggctgagacatcagatatgtaaatcaggccactgccagattctatcgactgaatcaacccagccgtcatggctgagtcgtgctgacttcccggctcagggattatctgaggacatcttctcaccttctctgcttggcttttgcgctttgtattttatttccatcagtatcatttagagatcttggaaggaggtgaaactcaaatcgaccattttttctccctgacaacttagataaattacttagttgagaggaaaatttgaaatttttgacttaaattgtggtttggattattggtacattttagctattcatctcatttgttttttctatagctactaataattgaaagctgactgcagaaaatagaataaatttataattctcaatacaatagaagctgttgacagagagaaaaatcaaatccccttatgaaacaatttcatatgagcaatgattttatgttctgagaatattaatgataagatatgtgaggacacaatttgagacttttattactaaaagatttctggttatttctgaggaatctcaaacagaagcttgttttgaggtaaaattatactcgattatctctttatgacgtttattagacaatgggaaaaacagaaacaacttataccatggggttaacaaatatttacttgggggcttttgagaagaacttgaactataaggttttggagtatgttttgatcctaaatttattttacctcaaataagcatgtaataaagttttaacatttgttttactttctgatgtttgagtattatatttctacaggggtaatcctattaaaagctttatgcttatttttcagtacttaatttgaaagagaattaagagcatacaaaattacagaaaaatgaggaagcctaggaaaaataagagtggagaaatctagagacaaaaagagagatgggagttcaaaaagataattacaagtttgagaagtggtcagtaataaataaaatgttttattgcacacacatatgtgggtagcagacagagagaagaaataagtatcacaaaagcaaaacggggaaaaaagtgattatgtaaatggatggatgcatctgggaatacaaagctgaataagattgagtccctgctctactggaattacaatttactggagaagtaacaagatggaaataatataggtaaagaataaatcataagatagaaaataaaaaaattccatgaacagatttaaaaaaatagaatgttttgggaatatggggagtgagaaggagacagaaggggaaatcaggaaactaatagaggagagggcactgaagtgagctttgaggcctggcaggattttgatcagggcagatggcttaagaaagtttccctaatagaaagaaatgtgtgggaggaggaacaagtagggtgtgtttagagaagcgtgattcatccatgtcaactgagacttaggggaactggaacaccatagttctaggttagaaaaattttacttcattcagtaagcaagggagaaaatgacaaagccaggaattagtactgtagttttggatgatgattctggaagtggtacttaggaaggagtgagatcagaaggaccagaacctactggtagctgagtgggacttcaagcccacctttgagtgctgcttgagagaattcggagaagataggagatacttcatttttttggtgggagtggggtgggggagagacagggaggataaaatggagcagataatatttttaaaggtgactttgctgcctctggaaggataaaaaaccctattctggttctcattgctattatgttccaataccacttgccttgatattgcagtaatctttgatgttaagggagtggaattaggtatttatgaatatgacctgggacataaggaatgtatatacatttatttgacagctacttatttggtgcccactgtgtgccaagcatgttacacaagagagtaatcataaggaaggtgacactagcctcagtgttaggatggatgggggttggaacagagcttatccttctccctcccatctgttgtggtgagactatggcttacttttactggaggtatcatgtgggtctctctgtatgtcgtcttcccaatgagccagttcaaggattctgacaaccacctttttgatgtttattttgtaacagatgattcaagagagccggtttctcatagaaatggcggacacagtccaggaaaagattgtacagtgtcagaaagcaggtaattgtttttaatttttttttctgttttttttttctattttgtttggaaactataataattcttggtagatttttttttcagaaactttctgcttctcttaaaatgcagttattttatagcaatgcttaactatactttaagttacactttagtctttgtttagtacagacgaaatccaagtgataataggtgggttgtatgtgagcgtacagggttggggtggtgtctgaagaagtctagagggatgagggtttctgaatctagttttgtggtttggaaccccatcaaaaccttctactgctggtattgaagctatggttccatacagtcccttaaaacccacttcaattttacaattggaaccaaaatcctattaatcttccaggcttttgccccattactagtcttcactttagatttagatttgttctttctttttaagtatgggatgagtcacatatctgtgagagtgtacttgtttatttctgttcaccttcatccacacccttgtgctttcatctcctggatccacaaccttctctatccacatacccgataatgattatgacgaggaagatgacaatagtagcaactgcttgatacattgcatatgctataccaagcacacacactatcttactcatgacaactctgcaaagtaatcatcattatatccgatttatagatgaggcatctgagattctgagagactgagtgacttaccctaggtgccatatcaacacgcggtggagctgccctttgaatccagaccaaacttttaaaatggtgcttttcactggctgaccagcaggcttagatatttctgttgacaggaagcacaaaaataataatacctgatacttacatgatgccaggcactgctctgagatctttatatgtactgattgacttaagctttacctctgtcccatgaggtaaacccacttgttaaccacatgtcacccgtgaggaaactgaagaccagagatgtcagggtctttccgagactcacatagctagtaagtggtagagctgggctccacactcatgttctttactatgtgctatgtttgtgatgttagcaccaggaaagttaacgtggtcttaggctgcattaataaaaatataaaaactagaacaaggagaatggtggtagatccctgacctcatgtaggcttctccaagcccattttgagtacagcgttcactcctggaggcaagttcccacagagctcagctccaggaaactgggcaatgcagtggccttgcctggatgccatctttaaagaagagtttcattggcaagctgaatatgtttgaatggttaactgagagaagacttgaagggattttacccaatatctttcttcaaatatctaaaagcttgcactgtagaaaagagtttagacctttttggtctgtgtccagctagcaccaaggagtagaagttccaaggaaggagatttttggcttgatgtcagtcatagctttctgaagatggaatgagctgttcataagagaatatgatttccatctttaaggtgctaagacaaaggctgaagaaatgtgatggtgatggttttcataatcttcaagctcgagcagatggttgagctaaaaatactttaaggtcattcccaaatctgaaatacttgggtgtttcccaaaatgctatttttaaaaaagcctttttatttttagccaacattactgattactcattgttatctatgtgggttccaggacctactattaagcgacagggatggttcataaagaaaaataagacatatgcattcctcacatatggttgccattgacacatcagaccatttcatgcataaaccaggaagaggacaaacaaggtccatgtaacctgttggaataatttgcttcttacttatttacttattaaaattttttttaatttttaatttttgtgggtacataggaggtgtatatatttttggggtacatgagatgttctgatacaagcatgtaatgtgtaacaattatatcatgaaaaatggggtatccatcccctcaagcatttctcttttgtgttacaaacaatccaattatactgttttagttacttttaaatgtacaattaacttattattgattatagtcatcttgttgtgttatcaattactaggtcttattcattcttcctatttttttgtacccatagaatttacttttttccttctcatgtcattttctatggctcctggctgttttaaatacaatttagcctaatgcattgactgttgtcaatttgtgcataaggacagctacttggtgggatgaacagaatgaaaaggataattcaatttagggatttggaaattatgagaagacaggaatgtgaaattatattttactgataatattttcattataagatgcccatttttctgagatatatactcagatttcttatgcattctttcttcaaagggatggagttccatgaagaacttcataatttgggggcaaaagaaggcttgaagggaagaaaactcaacaaagcaactgagagctttgcttggaacattacagtattgaaggtagatgaaacactcagatgtcccctgtgcctttacttttcttctcctcatctctccaatgtgtagagaaatgtaaaggattaaatatgatggtttggatttttaaaccttcactttagattcagggttacatgtgcaggtttgttatataggtaaactgtgtgtcgcggggggctggagtgcagattattttgtcacccaagtaataagcacctagtatgcaataggtagttttttgaccctctctctcctcccaccctccatcctcatgtagtccctggtgtctgctgttcctctctttgtgtccatgtggtctcattgtttagttcccacttataagtgagaatatatagtatttggttttctgtttctgcattagtttgcttaggataaagccctccagctccatccatgttgctgcaaaggacatgatcttattcttttttatggctgtgtagtattctgtggtgtatatgtaccacattatctttatccagtccactattgacggacatgtaggttgattccatgctttgctattgtgaatagtgctgtgacaaacagacatgtccatgtgtctttatggtagaaggaattatattcctttgtgtatatacccactaatgggattgctggggtcaaatggtaattctgttttaagttctttgagaaattgtcacactgctttccacatggctgaatgaatttacattcccaccagcattgtataaacattcgcttttctccacaaccttgccagcatgtgttattttctgacttttagctattctgactgtgagatggtatctcactgtggttttgatttggatttctctaaggattagtgatgttgaacacctttttatatgcttgttggccgcgtatatgtcttcttttgaaaagtgtctgttcacgtcctttgtctgctttctaatggggtgtttatttttttgcttgttaagttccttataaattctgaatgttagaccttcgttggatgcatagtttgcaaatatcttctcccattctgtaggttgtctgtttgctgtcttgatagtttcttttgctgtgcagaagttctttaattagatcccactgtcaatttttgtttttattgtaattgcttttggtgtctttgtcatgaaatctttattaggtcctatgtccagaatggtatttcctaggttaacttccagagattttatagttttaggttttacatttaagtctttaatccatgttgagtgatttttgtatatggtacaaggaagaggtccaatttcaatcttctgcacatgactagctagttattccagcaccacttattgaatagggagtcctttctctattgcttgttgttgttgactttattgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaatatgccactttttatattttcttacatgaaaaaagaaatgatttaggcagacaatatattcttgacagctaaatgggagaaaaatagctacaaacaaaattaataattgctgacatttaaagaacactcattttgtgctaggtactgttttatgaggtttatatgaattaacaatttaatactcacaccaactcagtatcgttattaatctcattttacaggtgagaaaacggaggcattggaagtctgtgtatatttcctgagggcgctcagctagtaaatggtgtaactaaattttaagctcaggcagtctggctccagaccctgtgtctttaacctgtgctgcagagatgctgcacatgtttatgtgaaagtgttaggttagctgtaagacatattacaaatgtctattaaaaattcagtccacaagtgataagcccctactatgcattgggctctgtgctaggcactgggaatacgtggagaacatgagatacagaccctgacctcatgaagttagcagtctgagtccagtggaggagggggatggataaggcatcatttgcttaaggagcagggatgacctagagctgtagtgttaaagaggtgcttattataaccctagattataatgtggcagtgtgtaccctgatataaacattttatgttcagaagattttatatgggcttgttaatgtgcctgtcacagaaaggtgctagggatacaaatatcaggaggattacctgggtctccaagactagtctataaggagagacagacatgtaactaataatggccatcaattgttcagcacttattttgtgatcagcactcaaggctaggtactttatgtacatttcccctttcttccttgccacaacagtgcaatcttgcaacatgacatgctgactctgataggactctctccatctcacaaatgaggaaattgaggcttgtgggggttgaaatttcttgcctggagtcacacagctagtaaatagccagcctgcaatttttaactcacgcccatggttctatccactacactgttctgcctcctctaaaactccatccatgtggctgagtccctgtattagtcttttctcacgctgctaataaagacgtacccgagagtgggtaattaatttataagagaaagaggtttaattgtctcacaattcagcatggctgggagggccacaggaaacttacagtcatggtgcaagaggaagcaaacatgtcctttttcatatggcagcagcaaggagaagtgctgagcaaaaggtggaaaagccctttataaaaccatcagatcttgtgagaactcactcactattatgaaaacagcatgaggataacctcccttatgatttgattacctcccaccaggtccctcctacaacacgtggggattgtgggaacaacaattcaagatgacatttgggtccaaaccatatcagtcccattgggtccaggcagcctagtgcaggaataagaatgcaggccctgtgtgattacctgatagtggtgagactagccaagttatataatctccctcagggtggtaataatacctacatctcagattttgtgagaattaaatgagataatacatacaaaagatgtaagtcacagtgcacaaaactagacagcatatatgttagctgttatttgtttgtttgccaggtgaggataaacatggagaaatgaggtttttgttatttttatttctttgttaacttctgacttaagcccacttagtgttgtcagagatttcttaatgtttttgtttggtttagtaacagaagctgattgttagatgtgattgagcaaatgctgttcaaattattccaagagagagcttttcagacagaattgattttctattattataactcacatactagctgctggtatttcagcttgagcactagagtagtggactactactaaacaagagtagagaacatttccacacttccaatagctcctttttctcctccattgagtttggggcctgttaatctggtgtcctttccccaagagctggacaaatgacctcctttgaatttgaattattagctgagagaaaaagagcctgggctctgttggagactttttattccagtggtgctgctctaagaagatatctttttctatacgattcttcctttagttcttatgcattagatctgaaacacttgattcccaattaattctccagacttgctattgattttcagagctcctctaagtattttaataaatgctctttgtttataagtttagtagattcaatttaccttgcttccagttggttgaatgattaataaccatcctggaaagacataatcactgaattaggaggctgtggtacaattctgcgttgcctactgaaaaagtttccttatacatgatttagactagtattccctactatctagagagagggagtgggaattaaccaattctggttaaatgtgttggtttgtatttctaaaaatatttaattccagtgtaatttccaataagtaaggaaggagctggaaaaaaatgagaaatgtgccctcagcaagttgggggattgacagcatggagtggtgcaaaggggcattggctttagagtaaattgagctgagactgaaaaataaattgtttagtgttttctgcagttcaatattacatttatctgatattaaaagctggagaaaaaaattgcagaaagaaaaatgactaacgacaatataatgaataagaattataattacagtgtccaaattgttgcagagaccaggacttagtatttagcaaggaaactgaaatcaaggtgcttctggaagatcccacacttgtgtttttctttaattcatattctagcacctacgtgggtccagtatagggacttgtttagcgtatcttttgcatttttccatacttttgccatatgtctatatccaactgtagcagtcaatttgctcttcctttctttctttttcactattgtacatgaaattggtctccttacatagccattgtgtttatttaggatgataggatgattcagtcctcactaccttttcaagacaatcactggatcaaaataactccattccattccaccctcacatgttaaaagacctttccctctgtttcttctccatgatgtccttcttgtgctgatataataaaatacctgagactgggtaatttataaacaacagaaatttatttctcacagttcttggggctgagaaatccaagatcaaggcaggagtggatttagtgtctggtgagagcacagtctcttcttccaagatggtgacttcttgcttcgtctttcagaggggaggaacggtgtctcctcaaatggctgaagggaaagaaaggcaaaagaaggtaaaagggcctagctagttccctccagcccttttacagggcactaatcacctcctaaaggccttacctcttgatattattgcattggggattaagttccaacatgaattttggaagggacacaaacattcaaactatagacatttggttgttaacataatattaaaatctcaaaatggaaatttttcctgttttttaaggctttcagaaagggatactacaacttcacttacgtagccaacatattctagtacattgttagtaattttggaagtgtttcactcatgagagttctgaagatctcttgggagcaagatgtggaattacactatatcactgataaaatgctatttgcaatgaagtggaattcatctaaagtcttgaactctatccagagtgatttgactttttaagtacaaaaagaactgcattgtaaaggtgatcacatctataaaactgaaattagaaagaacccaaggggagcattttagtgagctttcccaatatatatttttctaacttgtcctgttggctattttaagaaactaaattttattactttgtgtttttaaaagttttatgtaaaaatcaattttagcaggctggagaagtatcaagtagagatatataaaaataatattaaagaaatataattaataaatattttattacaaaggaaaaactatgaagtaggtaatcactagagcttaaagagaaataaaagggttaagaagtagctgcccttcttatttattcatgactttcattgattacttgttgaataacaggcaataaataaaaaatgaatataactattacctcttcaatggtcattcctattaaatatgtatttacacttttcctggatagatttccaacttataatttaatgcattccaatgtgtgccatgattctgggctgcttttataaatttatgtttagtatatgtgactattacttttccccataacgcttttgctttttatcactacttaagcctttgctccttctgcttttatctaaaacattttcaatttccgtgggaagagcagagattgaagcttctcacttctccgtgtgtagttatgtttctaacccaggcagattccctcactgaattcccgaatttcaggaccttacagttctggggaatcttgctacaacagaggaaattacatggatgtcagtgtagaaatacgctttcaattagagcctgaaaacacatttgaagtctctgttcattgttgagagacaaaagaaaggaaacagatgatgggctaatgggaaaagaagtatgaggagaggcatccatctctgaaagctgagtgagagtgagaagtgggctacccttcacttactggccatagatatttaaaatcattctatgagatactgtggagagggggctgttagtgtgaatgttcaaaccaggctcttccaacagacatagtgaccatgcctttgggggctgcctgagggtatataaagaaggaacatgcccagtatcatccacattgtctattgagaacttttccagtggtgtctctggcatctgccagctgttgttgctgtagaatctagagaaaggctaggattccttttgagtattcagaaaaaaaagtatatttacaaagtgtagaaacagacctccaaacaacaacaataatgcattaataataaaccatccttaatattgatattattatactatcaattattgagaaacagcaggcaaagtgattaagtgtacagacgctgcagccagacacttcctagctctgtgtctttgggaaaattttgttttgtctctatgctcttgtatcagttggggtatgctgggttgtgctatagtaacaaaaatctgaaaatctactacaatataacacaatggcttatttcttgcttgtactacatgtccatcacaggtaagtaatggtcactcaggaacacaggctaatggggactccatcccagcaaatacttctacaatcccagaggtagggatgcaaaaatggtctttaaaagcttctgcccagtagagtcacatgtcccttccactcacatttgactggtcaaagcaagccacagtcaagtctgatttcatggagtaggacaaatgtaaaccttctcagggaagaggagcagatattggtaaatacaatctaccagtgacaagttcttcaactaccccttataatgtggactaaatgagtaaatatatataaagcagtatctggcacatgctatatgagtgtttgttatttttattattaaaaatgaacattcagtgcttacaataatcaagtgatttttacacaacattttaattacttttaaggataaccctgtaaatttactcttattatacccattttacagataggggaaatgaggctcaggaggttaagaaccttcccattggcatacaggaagtgagtgatggagcaaggatttaactctaaaggccatgttgtcatcccactatgctatattgtcaaaatactgacagcaccataatagtaatggtttgtattaactgagcactttctatgtatcaagtatcctaccaagtgttttatatttattattttacttatctaagggagtgagtgtcctgcccatctagcatgaatatttcaatcaccttgacagaatatgcctactgtcagtagtcagtggttagtgcagaaagctacagcgagagagtgtatcttgagaataatttatttacaacactatatttacaaaacaactctcttttctcaatctggtttcccaggtacacttttctagtggaaaatagaatgaattgaccaagtggtataactagttccatctgcccagtagtcacatttctctttgtaagtaaatcagttaacttccttttttatttgtccatctcctatgagcttggttagcatgaatcagcttcccagggcctgatcacccctgagcgaatggatacagttgagtccttggacaggtacgattgggaatcacggaagcaaagcaaaacaacaacaacaataccaaagcagaagaccagacccaggacccctgagagcccagccagcctcctcttgtttctcttggacagctttgctattcattggcttttagtctggacattgctagctgccatttcttgatgggacagaggaagttcaagagccatgcctctagcaaaaactttacaaaggctatactcctttcatattccttcctcatgccccctcctccacagccacagttctactgttcagacctacaatctgtcctttatcaactgaggagttacagcagaatctattctgtgtctcctctaggcaacatttacttcttcaattttcattttgttgtaaagtttatttcaatttttttgtctattaaacgtttaaaaataatgttggaattttggcaaacagttacggttaacagtcatgccagaaacatttggtgaacgcaactgggaggggcaaaatagggatgaagccaaaattgagggtcttattccagtggcagccagtttagtctcgctcaacctagtaagccctcaactcacttggaatcttagccagctgctttacaatggatatcattgattaccaggaagaaggtgggtggcagaagggagagaatggatggatcacttctagaaaaacagcttgaatctcatatgtcagtaccattatttttatacacaaaagaaaatattattaagccttataaagtgtagagtatacatttagaaggcatagcatctatctgggggttataaactaagtttgatatatttatccgtggacgaggtatctgaaaagatactcctagacacatttgtagaatcttgttattgtttggctaattagtgcaaaataaagacccttctctcccacctcaagaaggtgatgttatttccacactgacatttataaataaggaagtgcaatgcataaatgaggcttataatccataaattagcaaacaataatttaacaaatttttatttcattttatttttggtgaaaccaaatttattaattcaacaaatgtatctgttacgtctttactaggtgacaggctttgtgcttgggaatgtactggtgaataaaaatgtggccttctggtctcagagctgacagtctagtgggggaagctgtcatttaacaagcacatgatgtgtgttaaatttgtccttatgatgggtgccttaaaaaagtgcatgacactatgagagtgtgcaatgggatttgacctaatgggagaggccagggaagtattccacgaggaaataccagtacagtggtgagtaaatattccagcctttcatggattccaaaaccctgccttgtatcttgatacttgagtgtggttgccaaaacaatttgaaaataatggtgaaaagaaaacacatcaaaataaagatgtgccggacctcttcaacatggtctggggagttctaaaatttctgccttgctcatttaattaccactcattagcattatggctaatttgttattatatcaaatctggccatattaattacaaattaatttaatcatccaccttctaaaatataatctgcagcgaagttttataaccatgtgtatccataaaattcatttaatagcttatagttgcagaggaggatgttataaggttggtttctgagaaatttctacaatttaaagctgaaaagatgcagagagagagagagagttatataatatagaatattagtattagtgttagatatatgggtaaattttttgaagtataattgatgcatctataatttaaaaaaagccacaagtttaaaacattatttcaaacagctcttatccaacaatataggacagtttaaatagaatgttaatgcttcttagcaataggcagactggttacatggtgtccagatttctgccttgggtggctgcatcccagctgtgctgcccaggagtttagtagagataaaagccgggctgttgacatgattatggaagcacacaccactttatctccagtagaactaaatttagcatctcttggaggtacacttttttttttcagatgaaagctgcattttataatgaatctgaataattcaaaagtggcaggatcctaatgaatagatgcatcatagaccagaggacttggctccaacttgtgaagttattgaaggtcttacttttctttcaggaaaattttccttagagaaaatttgtttcttacacacagagttttagcctaaggtgagttgtagcttaagtgagtttgatgtcttaactctgcattaagtatttcttacagtgatataagtggaaagaaaacattgataaccaaattgtttcattctggttccttacagctcttgtaggttttatactcacaagctccttttctgatattgttactcaaggaagacaaaaatgggctacatctatctaatttccttattgttaatccaaatcagagcaaaatgagttcacttctctgaatgtgtgtgtgtgtgtgtgtgcatatatatatctatatatacatatacatatatacacacatatatggtatgcacacagacattgtcaaataaagtcaaatctgaatttagatagagaatctgttcaaaagaattatcacaataaggagaggggactactgtgataggggaactattgtaatggggagaatgctcctaccttaagatctgtaagcatttgaaaggccaggcagaaaggatttttcttttatagggaagggcacagaaggtcagaaagaagcacatatgagggagtgggtagcgtgatcccacagttgatcctacagtgaggaaacatctttcctgtggtcagtcctttcttggtaagaggcgattaaggagaggctgtgtgctgtctcaggatgagagtgggtcaaagttccagggcctaaggggaagagagaagcctaattaaagtttggccaagtccaggtagtaggtatcaatattttctccagattggttagtggacacaaacagacaaacagttcagctagtcatttatgaggcaagaaagggaatttgaaaggtctgtgtctggccatgtcacagataaacaagggagattccatgagtcttagccaagtcctatggggaagaggggttctttgcagtaagtaaggtcttttgaggaacacaaaaggatgaggggatttcttaaccatccctgatttcctggaacacagggctcagataaagttgagcattgtcaacatatgcatttatatattgtattatgctgctaataaagatatacctgagactggttactttataaaagaaagaggtttaatggactcacagttccacatggctggggtagcctcacaatcatggcagaagacggaagaagagcaaaggaatgtgttacatggtggcaggcaagagagcttgtgcagtggaactccatttataaaaccatcaggtctcgtgagacttattcactaccactagaacagtatgggggaaaccacccccatgattcaattatttctgtttggccccgcccttgacacgtggggattattacaattcaaggtgagatttgagcgaggacacagccaagccatatctcatatataaaaaatttttatgaaatataaaattattaaatatataaaatatatacatataatatataaaaatatacttattaaatatataaaaatagatacatataaatatataaatatacatgtatatataaaatgttatgtgtgtatatatgtatatgtgtacatacaaatatgtaaatgtaaaaatctaaagaataatttaggttaagcataatgaaattagatgctacttttttaaagtcatattgaaaagatcgtgattatggagcagcaaaaaagttaccctggagtcataagtggttattttccagtttaattaaacatttcttatttcaagtagatacaatgtgctcaaagatacatcaaatatgagattacatactcatagtaataggccaggaggataaatctttttttctccttatttcccactttttgtaaaatgattttgtactattaattactctccatacattattgatacttttagtatttgtggtaagtgaagatacctatctatgaatgcaggataattaataactgaattttccctttaaggaaaaactcatggccttatgagattaattatagattctttgaaaaacgtatgcccttggagttttaaaaatatgcttaaattcataaaaatttacacataactcttcagataactacttgaataagacaagaaatacggatcattataataattttattaatgctttgaaaaaaggtaacttccagaaagaaaagactctcacagaaccatgacttagaattaagtattagacttttgcatcattgcataatattatggaaaggttaacaagtcgttatgtagaagctccagggtttcagagacaaagaagagaatccttccctatgcagtgaaatacactaacccctcatgatgggatttgtaaatctgccaggacgaagctatgtgttctaaaaatagctaaagtctttgagtgtttatttaaaagataactattctcaatggatttttgagtcagttatactgagggatggaaagttcttaaattgctttacaatgtattccagggaaaaaatattgcaattcaaatctctcagagggattccttaatcaactagaatattctggatctcccagttgtcagctactcagcagctggccttatgaaaaaaactagaataaaactggttcatgaatgtgttgcctgggaattttccttttcttgggtcaaaaaacattcctgatcaattacaaataaatctagtctcagaaagttgagctccttttcttaagcatgtgttaagagacatatttttcatatacatttaaaatatactggatgccctgaaaatatgacttgggtttcagcaacaaattctgatttccttgggtcagaaatatgggtctctatcagtcattttctgttttttttttctttttttttttcagattcaattgggcttcacttttttgtaagcaaagatatatagaaagggaaggttgaatgtgttagaattactcatgttctctggtggtacattattgtaacagaagtttattcctccaaactgcttggatgggcacaatttgaacatatgctgaaacagtcctatagacacttgagagttccatacagtttatttgctggtgaaatcatggatggttacacaccgcttcctcattcccttaccttccagatggctctccacacttaccacacatgttgcaggaaacaggttcttgtttatcgtgggtttgctatcaaccaagaaactgatatctaagactgctaaaaaacaaagctagcgtataaagtcttgtataggaaaagtatgttttagaggtaactatgtcctagtattaaatctgagtaggtgagactgaagcttcttaacaatgtatattgtgtatcctctgagtcagcccatagagtctttacatgtactctgaaactagagagggaaaaagccagcaacttccttcctgttctcctttatcaatagtacattttagcctgggagaggaagaataccatcaaaaggaacaattatatgtatgcatagtgtgtgcttgtatatgtgttatatcataggctcgtttcttatattaaacaactcacttattaaaccctgcttattgtaagctctgtaataatacatgtagatatgataataacaataatagaggaatgaaattttccttggaggctttggttaactaaatgtattctcagctgttcttatgaaaaacataaaaatgtgtaagcaatataataattacaaatgccatcaagatggaaattacaattttaaattctgaaaaatatagtctttgctactgaatcacagttttatcaaccatactaaatcattcggtcatcctctacttaataaccaccaccttaaaaattgctgggttcatctcaggaagcataattttgttctagagattcttctctggtcagaaagagagagagggagaggagagagagaaaggagcaaataataaagtgactactactgtccttcctctttaaataacagctcctgggaaggtcagatcctttggctgttttgtcaaagatactcaggaaaagttttcatagagatctctgaactacaggagacttgaaaattaattacatgaaactttatgaattttcattgaagttaaacatcagcacaaccagtattattttcctggagcttttgattagacatttctataccagtttgtctgtcatttcttttttgcagcataaggtttaacagtctaatccctgaattggccagagctgctgcatactcctatgtcaattgtgcactgcacaaccgtagggggtgccattcccactgaatgcatgtgagtagtgtcctctggatttgtcatgtagttaccatgaagttgtcagtctaagcatttttctgtctctaaccttttgttctccatgaagttttgagtgcctttaactattattacattaattataattattgtctaatgtagtgattttccctactaaggtttacatttaggataaatcttcagtcatttcaaaaggattcatatacagtagtgtgtcttcatgtgaaactattgttatttgtgtattgaagcacagtagagaagcccaagaatccagagtattacatacatcagatgaggaaaatgtcaattgtaactcagctagatcttaactttgattggttttgacaaccaaacatagttgattcagtttgtaacttgacaacagaaactgtaggcatttggaaaataatatcaagtcctcttttcaaatctaatacatccttcttgtgtaagaaaatttaattaaattcatttaatcttctgaaaaaaatgctctaaattcatttaagagagttaaaaataaataaatcttttaaaaagcctaagacttgagtgagagaaatgatttgatgttagtctgttagcttcaagaaaaaatgccaagttcttgacctggatagaaggtcctctgtgatgggggctttgcttacctccgtgtcttcacattttatattctccaggccctcagttctgtttcttggaaatatcaggcagttttgggattccatgccttcgcactgctgttcctgccaactgtgatgttctttccctcctcagtcacccaccagctcctcttcatcactcacatccagcactagtgttatccattgcctttccagggaagccttccctgctcttgtccctccatacccctcaccctccaattctcatcaaaaccaaattatctcctgtatagtgccagatctgtagcttatacacaattttattcccatgctcaccaccctgactcactaaatgttaatgatgtgtccctatgtctttttctcatacaaaatcctgctccttcagggtggggactgtgttttagtacagtgctgagatttaggagaaagcagaggattacagaagctctgcaagttgttcaagatgatgcgactaactagtaagccgtggggatggatgcacaccttgatctatgtgacaccaaaacctgtccttaatatccacagtcatgatgtccaaggtcactgtagatgcctgtgtaccaaagcttgttcttcatattgggcgttgtgtccaacgtcaccattggatgcctatgtgtcatttgggaagatgggcgtttctgcagttcttggcagctccgttttctcatggggttgaaattttgtcctgtttttcttacttcaacctctggggagtttcatttttcctggtctactcttaaaaaaaataatttttgtgggtacataggtgtatatatttgtggggtacataagatgttttggtacagacatgcaatgcataataatcacatcatggaaaattggttatccatcccctcaaggatctatcctttgtgttttaaataaaccaattatactcttttagttatttttaaatatacaattaaattattattgactatagtcactctgttgtgctatcaaatgcttggtcttattcattctaacttctttttgtacccattaaccatcctcatctcccctcattccccactacccttcccagcctctagtaaccatccttctactctctatgtccatgagttcaattattttaatttttagctcccacaaataacttagaacatgtaaagtttgtttttctgtgcctggcttatttaagttaacacaatgacctccagttccatccatgttgttgcaaatgacaggatctcaatcttttttatggctgaatagtactccatatgtactatcacattttctttatccattcatctgctgatggacacttaggttgcttccaaatcttggctattatgaatagtgctgcaataaacctgagagtgcaggtaactctttgatatactgatttcctttcttttgaatatatacccagaagtgggattgctggattgtatggtagctctattttcagttttttgaggaagctccaaattgttctccatagtggctgtactaatttacattcctgccaacagtgtatgagggttcccttttctccatatcttagccagcattttttattgcctgtcttttggatataagtcattttaactggggtgagatgatatctcattgtagttttgttttgcatttctctgatgatcagtgttgttgaatacctttccatatgcctgtttgccatttgtcttcttttgagaaatgtcttttcagatcttttgcccagtttttaatcagattattagagtttttcctacagaattgtttgagctccttatgtattccgattattaatcccttgtcagataggtagtttgcaaatattttcttccattctatagtttgtctcttcacttttgggttgttgcctttgctgtgcagaaactttttaacttgatgtgatttcagttgtccagttttgctttggtttcttgtgcttgtggggtattacttaagacacatttccccagacaaatgttctggagagtttccccaatgttttcttgtagtagtttcatagtttgagggcttatatttaattcattttgatttgatttttgtaaatggtgagagatagggatctagtttcattcttttgaatatggacatccagttttcccagcaccattattgaagagactgtctcttccccattgtatgttcgtggcacctttgtcgaaaatgagtttactgtaggtgtgtagatttgtttctgggttctctattctgttccattggtcgatatgtctgtttttatgccagcaccatccagttttggttattacagctctgtcttataatttgaagaacctggcctactcttttactcagtttcatcttttcctaccagagtattccatcttttcagaatacaggcaggctcccatatgcactggactggcaatttgcttttggctttttctctcaataggaccagtgcccatctttatttttctcctccttctggtggccatcttttgactatcaggcaactggtgactgttctcagggttatttgatataattgcacaggtttctagatcagtgcttcagctccttcaagccatttccctcaattcatgctgtgtacaggcatccatatacatatgtacacagatatcctgagtatacattatatacaatttttagtggccctattctacattctactcttctagtgcccatgtttgattttttgttgttactctagaagaagcacacaaaatgtgctcaagatgtgaactgaattatatgaatttaaatctgtgaaaatattaacaattatcccagtgcaagaagacattggtcactattgcctttggttgctcataagaggataaaaaaaaagacactttaactccctttaggtttattgtctttttctagcatggttcagatattaacaatcaaagtgactgaactttagattttttatatgatcttttcttaaaatctgggtaacttttatctttgagtttcttccttcctttgtgaatcatcaccatcttcatcactgccaatctttaagtatttaccaagaactcatcatatatctagtgccataaatatatgaaaatgcttttagaaaatgctctcctccccggtattcacttatgctccaaattggcaaaccctttggtctcagttacacttttggaataatcctctcatcttgagatcatcattatttctattcaataaactagagaattattgtaaaacaaattgggtataccagaaagaagtgggacattttagagaaaatcagaatattcaccataaagctggaattaagcatatgactgattggaactgaatttgttccagttttaaaatatatttttaaaatgtaaaatacacttaacaacaaataatcacttatagttataaaatatgtattctctctagacagtgttctaagtgttttgtacttattaaatcagtaaattctaatagcaattatgtgatatatgtacacactattatgatatccattttctacaggagaaaaccaagggacagaaaggttagctaatagctaatgagtggcagtgccatgattgaaacccaggcagtgtggacccgcagtccttgtccacagtctgacaagactgccccacctggtccatagctgtttcatatacaatgaatgaaaaagctcaataacaatggtaaatccacacttcataataacaattaaactcctgaacttgtaaatatataaaagcagagagatagatgctcatcttcagtggggagggaagggtttgttattcatgttacaataggcaaactatccctcaattttaaatacagaggattctagtgtggttggctgtagataacaagtccacttgcaacagagattggaacattaggaggggttgactgttatggacttgatggtgtccccttcacaaatttctatgttgaaatcctaaacccccagtatctcaggatatggctgtatttggagatagggcctttaaagaggtaactaaattaaaatgaggtaattggtggggcgggggataatccaatatgatgggtgtcattataagaagacaaaatttagacttagacaggtacagaaggaagaccatgtgaagacatagggaaaagatggccatctatataagccaagcagtgaggtctcagaagaaaccaaccctgccaacaccttgatatgggacttttagcttctagaattgtcagaaataaatttctgttgcttaagctacagagcaaacctcgctccgtaacctgttaggaaccagaccatgcagcaatgagcattgctgcctgagccccgcctcctgtcagatcagcagcagcattagattctcataggaatgggaaaccaattgtgaactgtgcatgtgaggaatctaggttgtttgctccttatgagaacctaactaatgcctgaggatctgaggtggaacagtttcatcctgaaactatgcacccctctccagccccccagtccatggaaaaattgtattccatgaaaccagtacctggtgccaaaaaggttggggaccctggcttaagccaccctgtctgtggtgctttgtcatggcagccctagcagactaatacagggacctaggaggagaaagctaacgtttgagtttcctagtgcaaaactcatcaggacacaaacttaaaactccacaattttctcttgatctttggcagaaaaatgtaatttaattaggatgcatttttatgtaaagtggggtgcccttggccacatgacttgttctttatgtgggcagataggacagtctccttaaccagcgtgattagaatttcactagcttatcgctcaacaaatacacacattgttactccactggcttctgcctttcccagatatacctgtcataatataatgtaattaaaataattataattgtctgaccttgaaattactaattagcatgatggtcagtcctttgataattttctccagaaaagtcttgttaaaatgggcctgcataaaaagctgggggcaatgaactagttataaaaggataggctaatttttggttaagttgactattccttgccagaattaagaagttggaagatgaggtttcttgggggtggttagtcatagtcctgggaaattgggacctaggctgaggggagtaggaattcagtggcactcaattaattttttcattcaaaaaacacaaacaaagcctttgattcaacaaacacaaacaaaatcttgctttggccgggccctgtgctaactcctgggatgcctctatgaacatgatagaagcagctactgcattcagagtttatgttcttatgggagatacagatgttacaaagtacaagccataattagttattttggcttgtactttgtagagaatgaaaaataattttatttaattcattatcttgctgaaggttggcactttttagcccgtgctgtccaatgcagaaagcactagccataggtgtgctattttaagtaatacaaaataattacaattgaataaaattagatattccattcctcaggggcattcgtcacatttcaagtgctcagtagccacatgtggctagtgactaccataatggacaacagagatacagaatgtttctgcactgctgaaagtttcaccagagaatgctatctgggctctagagttgtgccagacctgcaaagtcaagaaagagggcccttagcttaattccttagagaacagaagatatatatatttatatctaccaaaatagtccacttttggctgcaggccatagtataaatctcatcttagtctggccttcaaaatgaagaatgggctggttttaaaccaaggacagatttcctttcctcttagtcttatgagtattggggttttgcattttgtgagtgctcatttttgtatgtatgagcaatttgtccataggaactaggggatttttatattttttccttttatttaaaatatatgactacataaaataaacaacatgtggtttacagatatgaggagtattggaatctgttactttaaaatagtatagcaatgtttggacttttcacagctgaaagaattaaattcagcttcagtaccaccaattcccattttttttcaagtacaagagaaaaaagaagaaaagaatatgtgggtggagaataaggaaatcagctgtgttggtttaatacccttgaaggtgacattagtagaagactttattaaaacatgcaacctgaagctgaggattataaaatataatatgtcatggtgggagatatgctttggctgccacacctaaaggtcactctttgaagggagctgagacagctgccaggatccattgatttctttctagtactaaaacatcctctggcaggtgtcagcctgggtgtgtgaacaaaaaaatatggaaaattaaagagtaagcaaaaatgggccatgggatcctcctagtagaccgagcagaatgctccagtgtttgttctgaacagacgtgtaaatttttgctttagcgacacaacagatacatgaagtgttcaaatattagtcaacatatattttctttagtggaatatagcttctcaagtctctaggataacaaagttttaaaatcctgtctaggtgtatataattctttaatttgtttctagtggggctactccctcaggttaagtaggacactttccctacaatagatttcatttttctttgattagtttccacttactccttctgctcctaacatggccatccctctgcagttctccaaatatcccatgtgtgtgcttgcctctatgtctctgcatacaccatttctcttctgtgcttaccccccaactcctctacaatctagaagactcagccttgagatctttttgaacaagaattgcatttatgatgataaatctgtgcctgtcctacaaaaaaagcccttgtctccttctgaggtgattttgcttagtggctaatcttttcaactttttgtctttaggttttgcagaaaatgagaaaagatggaaagagtgagaggtcacatgatttgctgcctgggctgtggggaccacccaggggctgtgtggagggaaccatccctacgttagcgctgagctcataaccatgacctcaacctagattccaaatctaggtgctcacattcatttcacaccattagcaagttaaaaatgatagagccaggccaagcgcggtggctcattcctgtaatcccagcactttgggaggttgaagtgggcagatcccttgagctcaggagttccagtccagcctgggtaacctggtgagaccccagctctacaaaaaatacaaaaattagctgggcatggtggcacatatctatagtctcagcttcttgggaggctgaggagagagtcgcttgagtcttggagggtgaggctgcagtgagacatgattgcacctctgcacatcggcctgtgtgacagagtgagaccctgtctcaaacaacaacaacaagatagagccatttactaagcagattggcaggtgagggacgctggttttagctagtacagtgaatgagtgtgtgagtgtgtgtgtgtgtgtgtgtgtggggggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacctgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatgctttctccctttgaagaggcatgacagtttcaggttttgctaagaaagatagtttccatctgaaaatgtgtgtacatagtgtttacttctaatttaaatgcctatttacacaggttggggatacaccaatgttttttgatgatgtggtaagttttcaaaatctatttgaggtcatttttatatgcttagaatgacttaggtgcaaatctacatggaagcagaggaataaaccacatggttttagaagccatttctgatcattggagcacaagctttttgtggacagcaggcactccctacctaagtccaaagcaggggagccacctgctggacagtgtgaaaaatcttcattttctggaggtagtcatccctgcttttttacttttaagtttaggtagatttacttacatataaatttatgtactttttattttgctgagtaaatttctcacttcacacaaataaagcggctctaaaataaggagaaaaaaattaggatgctatgaaacacaaatttgaacaacgatcagtactagaagtagaggcttttagtcattccattttgtattttgtctttttcctttcattcgtagttcagcctaactgcatttatattgtaaaccaaaaataaaattctaagccccttaaccgactgaatggacctgtcctatggggacaaggggattccaaaaaattccaaaaagctagttcaggccatgatgggaacctgatggtgtaaccacccagttgggttcacctttcatgctacctagaaagagctgattcatctagacaggggaatcgcaatagagaaagaataattcgcacagagccagctgtgcgggaatctggagttttattattgctccaatctgtctccccaggatcagagtttttaaagacaatttgtgggaggggaggggcagtgagtcagggactgctgattggctgggtcggagatgaaattatggagaggaaatcatggggcgttactgtcttcttgcgcttagtccgttcctgggtgggcatcacaggatcagatgggccaatttcttgatatggtggtgccagttgatccgtcaagtgcagggtctgcaaaacttctcaagtactgatcttaggagcagtttagggagggtcagaatcttgtagcctccagctgcatgactcctaaaccataatttctaatcttgtggctactgttagtagtcaagaaggaggtttattttaggaaagggatgttattgttcttgttttaaaccataaactataagttcttcccaaagttagttcagcctatgcccagcttggaggttagaggcaagatggagtcatttaagttggatctctttcactgtctcagtcataattttgcaaaggcagtttcaatggtaaaagggaattggatacgctgcattatactttcctccctttggaattcaggctgaactgatcggccttaaaattaaaacagagatcttaagacacagtaggctctttgtagcaataagataccaaattccaacctgactccagtatagcatcacatgacagatagcaggccctgagaaaaatcaagtattttaccccaaaatatatttctttgacatatttttaaatggccctgcaaagctatctcttgtgggggaaatttacctcctttagagaagccccttccctttccaggtctttttctgatcctgaagagtttagctgagagtctggtaccttttaaaggtatgaataggaagcatttgccatctattgcctctaaggatggccacctataagacttcatctacataataagaccgttggtctccaacaacaccccttatctttgcccagacactcctttctattgattccaggttttttagataataacttaaacccttcaaccaattgccaatcagaaaaatctttgaatccacctatgacctgtaagtctcctgcttcgagttgttctgcctttccctaccaaaccatgattgatgtcttatgtcctcctaaaatttaaaatatcaaactgtaacccaacctccttggccacatgttctcaggacctcctgaggctgtgtcacaggtcatggtcctcacatttggctcagaataaatctcttcaaatattttacagaatttggcttgcttttttcatcaacaatatgtatacaaacgggcttttctaaaggactttcagccctccttcagctcatctccttcctctttctatctcctcgcctacatagtcaaacttcttaacagggttgtttatacttgccgaatccacttccttacctcccactcacttcttagccaactttaatctttcttcttccccgacactccattaaatcattctcaccaaggtcaccaataaccaccttgtcacaaaatctcatggacacttttccagtttttatcttttttgactagttgggaacattctacgtggctaagcactccctactttttattttttttaatttttttgagacagggtcttgctctgtcacccaggctggactgtggtggcatgatcatggctcactgcagcctcaacctgctgggctcaagcaatcctcctgcttcagcctcccaagtagctgggactacatgcacatgccaccacaccctgctaattttatgttttgtagagatagaatattgtgatgtttcccaggctgactccccacttcttgcaacactgcttctcttgatttctgggacaccacccccttctctcttcttcctacatctctgactctttcttcccagaatcgtttgcaggttccctttcctctgctattctgttaaatgctggtatttcttagggttctagcttaggctatcttctcactccaccttctgtccctgggggacacagttcatgcaaagggttttgattatcttcaccatgctgtcaaatctcaagtgtgtatttttggcccaggtgtcactctctttatctcttgatgatccctgctcatcctcccatatagtttatatatcaaattacctcccaggcattgtacctgggaggtcactcagccacagcaaggtcggcatgtctccagctgtgcttatccctatccatatgtcctgcttatcctcagtgacacctctggaattcctgcttgaatgaataaatgacaactcagagttatccaaacctaaatcctgggggttatccttgatccttttcttaactctccacctctaattggttagcaagcaccgttgggtcaacctccttaatacctccctaggaaacttccattcccatagccgtcaccttagttatcttcatttatcacctgagttagtgaaaagtcatttctcctctatccttttcccactccatagcatagagctggagtgatctttttgaatgtaaagctggtcatggccattctcccttcctaaagcccttccagggcttcccacagctccttcttaacttctcttctgaaactcattgtggcctgtcttctcagctcccctccttcccctccagcttcgtctctcattgccttcttcttccatgcactactccagccacatggaactttctccacttcctcagtggcaccagggatgctttcatgctgagtagtcacatggactgtcccttcttccttgaaagtgtgtaaccctgcttgtacccctgctccctgggagcccccatcctgttgttttcacactgcatggggcactgttatctgtacttcaggtgtttgctcaggtacggagtcttcaggatgccttcatggacacctcaccttctcctgcctcccatcttcaacagagttaggtatccctgtacgtattcccacagaactctgctattccactatcatagcactttaattgcttttttatctttcacgagacagtctctattattgtaagcaattaggtgatgaattttaacatagcaattttaacctgagccccaattaataaacagtagacatttagcatatgaggtcaaatcaaagaacgtctcgtcaaatccccatgttttggagaaaaggaaactgctgcccacaggagttagggacatttccaaagtcacaaagtcaattcataacttattaatcattcttcccactgcagacatcagccataacccctattctttctatccttttgactgattctggttttctctgcaagaagcttgaaagccttagccaggacatggtttaaactctattttgccttggttatcaagcaatcaaatggtgtggttaaaattgtagcaagcctgtcatttctcatttaaaataaaacgggactcattcaggcttcttgaagtgagactgcatgtgacgatgcagggaacacatctcctagaaagaagaggagccactgaatgggcagcctcatggaatctcaggatagaagacccttcacatttgaagcaggctttagaggactgtgttatcttttccttttccatttcccctttccttgccttaagagcaagaattgtagattttcactctagtgctgtgggcttacaggggctcagctctgctggtcttttattcctctctatattttctagcacttcattctgttcacaaccaactaagactcttagaatttttcagtttcagtctcagaaagagttaatccaattggtttgtctaattgctgtcattactgcctggcatcaggacatctcataggtcactggtcagctactgattggccacacttgggctgtggtgaatccttggtccaaccagttttggctgtggtggttggttcttaccttttagagcagggccattccaactcaaggtcagcgtggggctgttttctttaccagaggtctgtggacatggacagcattgcataaggcctgacaaacttctggattctctacatggtgatagtttaaagtttctttaaaaatgtgtttttttgggggggggagtccacatattcaaagttctaagaaatctcaactactgacatattaaggaattgaatatgaatgtcctctcccactagatactgatagtttgattttcacagtaagatattctgggaagaaatctggataggaaggattagggaggccttatcatgacactcacaaagttgaatgggtttggtgaatgtatggtgaattttttccaggcatatatacttacaaagttgatttaaaaataagaatgtagattctggatattagccctttgtcagatgagtaggttgcgaaaattttctcccatgttgtaggttgcctgttcactctgatggtagtttcttttgctgtgcagaagctctttagtttaattagaccccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcagatttgtcaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacatgaaggggaataccacactctggggactgtggtggggtggggggaggggggagggatagcattaggagatatacctaaggctagatgacgagttagtgggtgcagcgcaccagcatggcacatgtatacatatgtaactaacctgcacaatgtgcacatgtaccctaaaacttaaagtataataaaaaaaaaaaacttccaagtaaaagaaatctaaaaaaaaaaaaaaaataagaatgtaagagtgatggtatttgacatttagaagaaatgttttgacaagtgcatgtgatgatttaatggtgcatattccataaagtcaacaggagtgaagctgtggaaatgtttgtctttctgagtgagtggtatttactgctgtgaatttgctgttccatttcccaatacactctccctcactcatgcttttactctaacttcacgtaactgagttgctattttcaatgatgctagtaattaatgtgtgtttggattctggatttttaaaaaagtaataagatgttttgggacaactggggaaatttaatatgtactgtatatcagatgcaattcctgagtgaatgttaatttctttggggttaataagagtattgtagttatacagaatgtcctcattttcatggtctgcacactgaggtatttagggtgaagtatacattgttggatagatggggataggtaagttgatcaagccaacacgacacaatctgaaaaattgggaaatatggatgctactcattcaacttttgtgtagggttgaaaaatctttaaataatataaaaagttggaggaaaaagtgtaactagtagtctgttggtgtagatggcttgagtctgagatctgaaattggagccagtctcagattagagaaaataggtcttgactttccttgcagtaacattaatctggtgtttaaatgaatgctttgctgaatctggggcaccgagagtgaatatctcattaatgaccaaatctccaaaccagtcattgtggaggaagctgagttggccacatccttgatttaactaagaagtagcatgttttattttatagctgccttagcctcattcattaaaacctgactcattgggcggagggtggaagaagttgcccctttagaaatatcttgctaataactctttggccacttcagctaacacagaacctggaactcatgccagcatagaagggtggctacaaggctatgggatgggccagccgtacacatgccatgattcactctcaaagaggacaatttcagcctctttaaaagcattatgatttagcagagaataaagaataaatgtccttggtaaaaggacatatctagaccagatgtagtacaactgtcattggctgtagggaatgccatgcacgtagaaggcagggtgaattgtgcccttggaattgtgtaacacgggacagatgtcatgaaaaacaatttacttgctgaaatccagcactgtggaggtggtgaagcagctgaagccatttttgtgatcagttcactctatggtatactgttgttattgtatttgcacttttgttctggcatgtttgcagaattactttttggacggatcaagtaaccaataatttgagcaacaatttaacagtaactttttagagtgaaaccttaccaaccaaataccagaatgtatttaaaaaatattttgctaatatttgtaactatcttgatagcctttgctctggggtttgggccatcctctgtctctcaagctgttataaatgatattttttgaaatgggaatagcatgagttggtcaggtagagatttctatagaagctccttctgtattcggcttatgacactcatggcggtagtatgaattcagatctcagggtcatttattatccatggaaagttaatttgagatgttggaacttttaaacagtgtttgtttattgtgctaatcacgatctgttactaaatttcatttgaaatgcaattaattaccttcatcaccttgctaaagattgacattaatattctgtcctatcctattagttctgttgacacagagggagatgatcacaataatgggaaggaaagagcagagagcaagggaataaacaagcagtgactgctattattttattgaatggttcttttgtcaaaatgactgcaagaaaattcttagaataccagtatcatcacacaaacctaaattcataaggcttcctgcagttgaatcatatttttaaagtttagcttggggttttctattattcagctcactggtgttgaagcaattttgttgacattttctgtaagtggattaggcttgcagtcatttgcccaaagcagacagatggcttcttaaacagagcacccccgtaggaacctatcttatggtatcttcagaaataaaacaggtctgtcacaaaagataatgtttggcattaatttcttttagtgacaaatgatttcagctcatttttactttctctgctggcttaaatgaaacagctgttttacattttttattccaatagtgagcaacgctttggtgtttgacactgaacaatgttgtagcctctaaattatgagtaagaaaataagcttttgagaggggaggatgatgccttttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttccatgtatggcaggcattgttctaaagaatttagaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaatgaggaatccttagaatcagatttattccttcatcactcctggggttccactcgtcagctagtgtgttctgccatcttgggcagccagcttatgtggaaggcttgtgggggctcatgggtgctgcaaggagaaatcagtacaggggccctgagaattgactgatgaggcctcacattagtagcatccttcaaaacgttcagtggatgcctgtcatgaatatgattcattaataatcttctttttggatctgagccatcagggcttatgacgatacctttgaagtgaaaaccagtccttttttccagcacttatcccactcatgaatcctctatcattgcttttgtatttcagttttccgaaaatctggctcagattaaaattattaaatgcttccaaaccctgtacccacactgaagacaaaagttagaaatcaaaatatcagcacaaggatagtatttatgtctgggacatttgtgaagttctatcaagaaattcttttataaaccaaagaagtcttaagctagtttttcttttctatttgatcaaatagatctatttgatgacatgtgcaccatatcatgtaatgtacctaaattaaataaaaaaacacaaaaaaacaaataaacaatatagagattaagaaaaacaactcttggcctgggaagccggcattattcatttccttcacacttatttctcgtgtgaacctgggcaatgtatttttttagctttcctgtgtccatttattcacctgaaggttataaaaggagtccttcgaatggctcgaaaatttgaaataattactaagaacggttatttagcagatctcagtgatactgtcactaaatgacactttattgttttccactttcagtgtttctttcagtataaatgtcaatgaaacaaaataaatcctaaatagagaaaacgtaaggaaaaatggaatgtattaggcaatttggtgctgtgccataaaggcggtaaccttccagaacactctcccataccatgtatatctgtatctgtaagactggaggaggattcttgcctctcctccaggcaagcataaaaaaatccttgtactgtgtttcactgatcataagatgccaagaaataaatgaagatgcctgctcatcttgcaaatcattgctttcttgttactttttatggggaggcttgtctaatctcctagtcctcacagcaatacattcttttccctcaagtacttagcataatttaaggttagatataactttatttttgtggttattttatatatacctgtatcccacactagacttaggttccgtaggggcagggatgatgtctgtgctcacttttgtaacccccagagtccagcctggtgattctcaatgggtgcagtactgccccctaggctgtgttctgggaagttgtagaggtgattgggaggattctcctggcatttagtggaaacagacaggaatatttgatgtcatgctctgggcagggcagtacaacatgatgaaaaatgtcctgtgtcctgcaagatttctgttaagtcctgcctgagtaaaccctctgtattagtcagttgtcatactgctataaagaactacgtgaaactgggtaatttataaagaaaagaggtttttttgttttgttttgttttgttttctcagtccttcacgctgtacaggaggcatggctggggaggcctcagtgaacttacagtcatggcataaggcaaaagggaagcaagcacatcttcacatggtggcaggaaagagaaacagctaaggggaagtgttacacactttcaaacaaccagatctcctgagaacttactatcacaagaacaacaaggaggaaatctgcccctttgatccattcacctcccaccaaatcccctcctgcaacaccagggtttacaattcaacatgagatttgggtggggacacagagccaaaccatatcaccctctaaaatacaaatcagaatactttagtatatgatattaattaattattattattttttacaagaagttgtttgaaggccagtacttgagtaaaaggtagttattgagaggtaagtctaaatgaaataaagacattgtttccaaattattgaataatttactcaccttgggtattttgtccacttgaccatataattgctacacagtaatattggaacaaattgggcagtcagataatggttttaacctgataccttattttttattattgataatccatggtgggcatccgcctgggccccacaaagtatcagctggtattatcaatcacaagaacaatgacctttggagtacttttaaagatttggcagttttgctgggcgtggtggctcacacctgtaatcccagaactttgggaggccaaggcaggtggatcacctgaggtcaggagtttgagaccagcctgactaacatggagaaactccatctctactaaaaatacaaaatcaactgggtctggtggcctgtacctgtaatcccagctactcaggaggctgaggcaggagaatcgcttgaacccaggatgtggaggttgctgtgagccaagatcgcaccattgcactccagcctgggcaacaagagcaaaactccgtctcaaaataaaaaaaaaaagatttggcagttttgatgtggtgtatggacattatttacttcctcatttatgggattatcagctttttctttccacagtgagggtttgtatttgtcttggcatgttatgccgaccttaattgaggttgtttctttccttcttttattctatgcaaatacaactagtctattgccattatttgttttcatactagtgtctgtctctacatttgcattatcattttccattaaatatgtattttttgagtggaatggcatctgatcttatttctctttcatatctaattgcattcatattaagtacaggcatctgcctacttcaggtttctggtgtgcctgcctgacattcacatatggcaatacatgttattttattttaaatgaccattccctttttctcctttatattacagctagggtattatatttattttaataatacatgaataggttatattatctatgaatttaagtttatgaaaataaagaaagccttacaaagtatttgtttcaaagggttggttttgatagattgagaacctcaggccaaagtctggtatacagtaattgtttaataaatatttgtttgctggataagtgaataaaatgaaaactaaggtgcaagtcctcattaatagctaagagaccaccattgtttccaaagcacagggaagagatgggtgtatctcagttcacatatacatagctttgaacaaggtataacagggacaataaatgagaatttgaaacattaaatttcatacttttttttttttccccgagatggagtcatgctctgtcacccaggctggagggcagtggtgcgatcttggctcaatgcagcctccacctcctgggttcaagcaattttcctgcctcagcctcctgagtagctgggattacaggtgcctaacaacacacccagctaatttttgttcttttagtagagacggagtttcaccatgttggccgcgcctggcccatacttcttttttaagctctggtcaacaagtgcatctcaatgcagtgggttttattgagtgatacagatgttttccaccagtaacaggacctattgtcagcattgttgccactggattattaatggttttttaaattatattattattagtgagtagtgtttaaataatgttgaaagacttcacttatatgtagaattctatatatacaagaacataaaattgtctccttatattaaaactattttaaaaaacatggctaatacaaaggttttctgcttaaaatgcagttaattactattttgaagtaactagggtccttcatttcttcaacattcaagttaaccaagacttcttgataaataaagctattgtaacaaagaaagcttgataggaaagctattgtaacaatgcaggtgttatttgagaaagaaatgtggtaaaagaagatctttcaaatttctttcaaatttaattttcattatgttgaattttaacagagtatgatttcaaaattttctgagcctttcatatggcttattaaacatgtcatctgctgcattttacaattttctgtggaccctttggcattaaattattcttaacatttctttaaagtgtcttctatactttataaattattttttcttgagaattagattctcaggaactaaaaagatttatttatattcagtttccatagttttcagaagtattcaattaatcagagtttgtgaccaatcctaaaatacatcctttatgtaactaattaaaaaattaactttatatacagttacaaaatctaatgtctcaggtgagcatgtccagtgtaattctcttcatgttcctgtacagattatttttattgcattatataataaagatttgaaaagcagagtttcatttgttttgggtttagagtttcagaagaataacagataaagcttcattcagccaagactgttagaacagaactactctacgactattcatccatatttcttgagtgttcatggagtaaaaatttaactttttaaatagcaagtagaatgcagttgaaatatttggttgctgaggtgttgcaaaacagtaaatctgagcattgataacttagtgcagtggacacttctatttttgtgcaaaattaagttatattatatgcaatttcctaatagctgcacctttgtgccttttaactcttgttaacatcttgtatataattcctacacagataggccttcattctagagagcaagaattccaggccatctttgaatagtttcacccagttttccaaacagcgtaacataccaagagtgtaacatcaaaaaaaaaaaaaaaaaagtctaacatgacatcaaaacatttttgatttgttgttttaatttctcaaatgaaggacattgtagcagttgttttacctcttcagagcaaaggattaaacttcttaaatgatagagtcccaacggatggtttttgaattagtaagatggcagttgtgcacagccctccacagtatggtccatcaatggaccaaataaataactactcatcccactatgatgtctgtgactggtttctactgcagcactgtccaagggtgattctactgtgggtatggactctcccatggataaaagaatatcagaaaacccagtctgctgatgagtgtgggctcaaaaatactcacacgagttgacttggagacagagctgcatttgtttatgtgtgtagttttgtatatgtgagggttttcctattcccagagtcccaattagctgctttaaatatttgtggtgtgctctgaaacaacccactcatttcctttacacttgatgagaacactagttatgatgttctcctgctcttttgtgtactaatatcacaagggatagtgcggttcatgggaaaagtgggtgtgaaggagcctgggatgtcttttgtgaataattctgccagactgtagtcaaaaccattttcattggtggggggaggactgcatttttttggtaaaaatggaagtaacagaaatcctaaatatcttttgatgggttataagatatattactaaaagataatttatatttagaattctaccctattttatggttaggatataatgagatgtatttgaactggtttacgtttagtatattaagtgttcagtaaatgttagctgctgtttagtgttgtgacaatatttcttgtcagtagtaaatttattagtagtaatcaaaattgtggtgatatatcaccacagcaatgcacggcagcccaatttgcaatctaaattgcatcagttatttcctgatttctagataatgtactttaattataatttaatgcagttggaaagatttaataaggaatgcttaatgtttgttttttaaatattcactaattatcactcatttttaaattcagaatttctataatgatctctgtggctttgcatgagtccatgttactttctaaatgtgttggacctgccagtggaaccttacattcagaagccaaatcactgtggaggctaaatggtggccattgctcttgggacttctattagtcttgttgtcccatcagcatcagtctacctgaggcgctctctattaccctcactttcctttgagttaaagcatccttctcttttttttttttcatgaaggatccccagtaccagaggatacttcaaatccccatgagattgctagtatagaaatgccggcagcagcttgacatttttttttcaagttgagtgttcagtggtcaacttgtacattaattctgcatttcatgccataacaatcctaaacttattttagtatacaagaggtgtttccatttctatatcaccaaataaaatgaattctcctggggttcctcctcttcccttaagacctctgtttagggagaataagattaaaacactttcttaagaatgacttgttaggttactctttaaatatatactatagacgaatacctttaaatggcttggctgacctgaataccatggtgggtgtcggggggtggtttttgggatgaaactggatcaacctcagatcaacaggcattagattctcataaggaatacacaacctagatcccttgcaggctcagttcacaatagggttcacactcctgagaatctaatgtcgctgctgatgtgacaggagtgggagctcaggcagtaatgctcactcacccactgctcacgtcctgctgtgcagcctggtttctcacaggtcacagggactggtatcagtccatggccccagggttggggacacctgctgtacctaatatattttggaggaaatgatacacaggacaaagacgtttagagggagatctggtataagctggctggttaagagaagtttgggggtgtttgtgacagagtagagagaaagagattgctagatgattagggaaaattgctgcatataaaatgggaaaaaagtcagcatgccaagggaaaatgccagggtggtggttgttaacaatcaaattcaccttctacaattttcaccagaatgtgtcttttctgattctggtgccttgattcggaagacccaaagaagagatgcaggttgtgattcctggaaccacagaacagaaagatgactgctattcctccttcataaaaaaagagaaaacagaagtttatatcatgtttcaatgtacactcttcacaacacagcctttcagttttgcttcttttattagttaatagtttacctatttttttttttcttgcctatatggtacagccagtgtgtgttgtctccagggttatcaggagatgatgtagttgtgttagttatgcactggtacaaactgtttcctcccattggccattgttttctacagagactgacttctatttaccagaaatggcacagtctggcatttggatgccacctcttagaaccaatgagatgacattctggattattaaaatatgtttcatgccatgctgtgggaaaaggggatgtgagaattttatgcgttagtaggataaaatgatgtttttgtacgtttcactgttctcttgcaattaggaaagttgccagttttgctactgctatgcttttaaaattcttgatgaaactttcaaaactaaatgaaaagggaacacttaaaagtaatactctgaaaatgaaggaggatatagtctcattactaatagattttttataaatggaaagattcctttaaaaatatagtagtacatatacattatacatatctctgtaaaacagactctggtagatgcattttaaatgttagtcaaatttttaataaaatatagatagtaccaagatacttattatatatagtagcagataatgttaaccactttctaaatcaccttatatcattgtgattcctatacttatgatcatttaaatcataaagagctcttcaacatattgtctttaatcttagaactgtaaggaaggctgaaggatattttcatcatttttgcagaagagaaaatggcccagataaaaattggttgaagatgctccaaccctcgtccctgctagtgtgttcttgctctgccctgtcttcctgattctggatgctatctctaaattgtgtcaggctgtgtcacatgggcaatgcttttctttttatctgcgttgcttccatgggtaacaatgaataggagtctctagggtgccctgcagagagtgcctgctttgctgttaaaagatgcctatcaggtagtggttaaaaccacagaccccggagccagctgctggattttaagctccagctctaccacttagcagctgtatgactttgggaagggtgactgtgctctgggcctcagtttttttaatcagtaaattgagaataatgaaagtacccatctcatagggatgttgtaatgaatgattgaatgaacatgtataaagcacaaagagtgaccacactgagcaagcacttcatatgttggtctgttattattattactgaagagttgcacttttcaaagtggatgtgacttcacttttttttttaaatttatgttctgggatacatgtgcagaatgtgcagttttgttgagcagactcattcgtgatgtctatagtgttaagaacagacttcccaaagtctgctggtgtagtaaatattttttctttagaaaatacatctctcactgacagagtctttaggctctaatctctagtctttagtctcagactagattgtaaacatggtgtggggaatagagcattgatgcaggaggccaaaggcctgaactttagtcccagctcagcgattaaccagctgtgaccttgggacagtcaattaacctcatcaggctcagcttcatttctcctcaggagaaggcaaaactgtccacctccaactcttcttccaaaatcccataccataattgatgtacttgagaagaagttcgctttaacacaaacatcaggcaaagcccaactatttaatcatcccatataattaaaagctgctattagaaggatttagctattttttacagaggatagaattggcaagtgcatatttaggttttgagaaataaaatattccaagcttttgtaaaatacaagtttcttcatacaccctaaggaaaaagcatttactggcctttcataaaataggtaaattatcctttctctgagcctctgctttgtagaataatgctccagcaatcgtcataaccccatatccacccatattgtcctttcaaggtcacactttcaggcactgccatgagaatggagaggagagggaagaagctacttcttcctctgtctatgggccatagacacctgtccctgcttccccacactcagtcattcagcccttgggccagtatcagtatacgcactttatcttcataacagtgaactaaaataagaaataaaaatagcaggaaaagatctctgttgggcactgatgtaaatgacagctaatgtgttcctgcaatcctcatttcctttttgttttgcctctggagactctttttctccatctgccaggtgggaacatcatcttcaggatgatggaaaaggcagaagtaatgtgggtgactgataatttaacaacaggcagattgcaaggatgacccagtatattaaaaaccagctcaccaagcataagggtatgtgacttactttacagaagacactttgctttgtaagctcttgtacagagggggagattttattttcacttctttaaggaagagcttctttccttgttttctcccaagactaggaatgctggatctgggcggggtaggtattgcagcagtgtgcagagtctcagaccatggtgatggaagagttgatgtcctcagcacataaagaggaggattcctcacaataggaatctcaacggactgccagcaattgcatagccagctggtcaggctcaggttgaggtacttggcttaacaagcaaagtcacttaataatgttagaaaagaaccttgggttaaaccctggaaaagtgagcttgcaggtctgggtctgtttccttattcagcaatgggcagtaagaacatagagtgatgtcactcagcacatgcctggcccataactgtcttctttgatgcctgtttttttctgtttgtagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactacatacaacagaaaagcaaaattacccactaataacactttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaatctagtccaaaaatgatgtgttttatttggccattgaacattttttaaaaaaatctttaagcaatagacagcttttgaaattcagaaaatgttacgtacaattcaatgtcctgcatgttttaaaatactggataatctaacaacacagaacacctcccactccccacctcacaaccaccacacatatactttcttgcttggcatcagttaattgaaactgccctctccaaaaggggcatatgctgtccaattttctagagagccttttcattcatttatgttacatctggaccttaaggacatgataggtggtgaaacttgatgaaaattatcatttattgagaggccaaaatgagagaattgcttgaggctgggaattgagactagcctgggaaacatagtaagaccttgtctttaaaaaataaaaaaaaattaatggtc

SEQ ID NO: 708 - DNA, 16923 bp, Human
ggggacaagccaattctcttagtagaggctttccagacagaattcttattattgagaattgagaattcacatgccacacataatttatcgttttaaagtgtacagatcagtggcttctagcataatcacaaggttgtgccaccgtcaccactatctacttgggaagattttcttcctttttttctttttttttttttttgaggcggagccttgctctgttgcccaggctggagtgcagtggcgcaatctcagctcactgcaagctccgcctcccgggttgaccccattctcctgcctcagccttctgagcagctgggactacaggtacccgccaccacgcccagctaagttttttgtatttttagtagagacggggtttcactgtgttagcaggatgctctcgatctcctgacctcgtgatctgcccacctcgacctcccaaagtgctgggattacaggcgtgagccaccgtgcccggaccctttttccttttttttttttttaaaggctagtcaagtgaaacagtgggagtgaagatgaaacaaaaacatctataactggttgtgatcaattagttgtaaacaccactgcactcagaccagcctaattgggaagattttgaggatatgctgtggtctgatgggttccaaggcagaggtgacagtaacctggaagagggagactgcttaggcagtggcatcctggtgggatagggtgaggagatcccagagcccacgtttactgcaaccctggggaaatgtcaccagagaaatgggggtggtgccagacaatagattgtgggagctatggtttccatggtagagtagaagcatccaccatgtgtgacattcagcagatggggcgctgtgggtggcttggagcactctggttgtaactgaggcaggcacagtgtttaggaagcctgtgcagtaatccagactgaagggaggggaaagcctagactaagactatggctgtgggattgaaatagcgttgaaggagctgactttgactcccggagatgaaggggaaagaggaaatcagaagggaccaaggatggtgaagttcttaagagaaactgaggaggaagagaggatgatgtggtgggagacgtgtagagagtccttgtagatctgtcacattgaaggggactatggtcccagaggtacagatgtcctaaaacaggctggaaaagggagtctggagagagcttggtgttgtaatgaaccatggggagccgcctcgttggccctgtgattacccaggaactgaatagagagggggccctgggagacctcagacacttagaggatataagggggtgaaaggggggacctggctttgagtcgaagggaggagaaggagattatatagctgaaacgtctaagagaatttgtgatctgagcgtttctactggggcaagtgcttctgaaaggcagaggcggctgagatctggaaacaggtctgcaaatctggtcactggtctcattgcagtaacgctgtgcgcggttgagggagtgtattggcagaaaaaccacgcgttgtctgtcccggaaggaacaagccagtgagagccggcctgatgggaggaccgccgaaaggggcttggtgaagcccgcgctccttgggggtgggaatgcggggatggggtggtcgcgatgcagggagggcgacagggtccaggtcgtgctcataagtttggagctgtactctcagctactcggggctggtccttgattttggctgcgctcgcgcacgctcccccttttctggccgccaggtcccgccttctaaatttccccaggtctccaggccgctagaattttctcttctgaacgtggccccgccctctccactcatgattggccaagttccgggcctcagttttcactggataagcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctggtgagtggggttcctggcggtccccggcggagcgggagcggcggggcgtttccgggggtccgggtgggttgccgcgagcgctgtgcggtcagggcggggctcaggtgtgctgtctggagtgcagggagctggacgccgcctgttcccgccacacctcagccctgctttcccatctcccgtctcttttttttttttttttttttttctttctgagacggagtctctgtcgcctaggctgtagtgcagtggcgcgatattggctcactgcaagctccgcctcccgggttcacgccattctcctgcctcagcctccctagtagctgggactacaggcgcccgccaccacgcccggctaattttttgtgtttttagtagagatggggtttcaccgtgttagtcaggatggtctcgatctcctgacctcgtgatccgcccgcctcggcctcccaaagtgctgggattacaggcgtgagccaccgcgcccgacctcccgtctcctttcagtcctcctcgggatcgcgcatcacccgcattttctggtctcctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatccatttctagggtgtcctctgccttcatcccccgcccccgccactgaaggtccctcctgcctcctttatgggcctttcctgcaagcagccttcactccgtgctgcccctatgcctccccattcccaaatgtccctgactctaactttctggtgctgccttttgtccgggggggtcttccctccatcccactcccctccagacccccaaggagagccctgatgctaatggcagttgggccttaggcagggcgcagggcagcgcagatgccccctcccctccagtgcaggtgcctgctctgggccctgcctcattgtggccccttccccactccttcatcctcagcctcaccctcttgaggaccccaccctccagcccacaggtgctggaccatccctccctggtccctccgcccctctccaccttgggaccttgtgctgctcctatctcttgcccagctgccttgggccctcagcaagttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccactccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttggctgtactcaccctgctgtgctatctactagatcttattcattctaactatatttttgtacccattaaccatccgcactcccccactccccactacccttctcagcctctggtaatcgtcattctattgtctctccccatgaggtccattgttttaatttttggctgccacaaataagtgagaacatgcgaagtttgtctctctgggcctggggcttatttcacttcacatgatgacctccagttctttgcaaatgacatgatggctgaatagtactccacatacacgtgtgcaccacattttctttctccattcgtctgttgatggacacttaggtcgcttgcagatcttggctattttgaatagtgctgcaataaacatggaaaagtagatagctctttaatataccgatttcctttcttttgggtatatgcctaacagtgggagtgctggagcatatgacagctctattatatttttagtttttggaagaacctccacattatttcccacagtggttatactagtttacgttcccaccaacagtgtacaagggttctcttttgctacatcctcgccaggattccttattgcctgtcttctggataaaagccagtttatctggggtgggatgatatctcgtaggagttttgatttgccttcatctgatgacgaatgatgttgagcaccttttgatatacctgtttgccatttgtatgtcttcttttgagaaatgactattcagatcttttgctcatttttaagttggattattagatatttttcctatagagttgtttgagatccttatatgttttggttactaatcctttgtcagatgaatagtttgaaaatattttctcccattcttggatggtctcttcactttgtttattgtttcctttgctgtgcagaagctttttaacttgatatgatcccatttatgcatttttactttggttgcctgtgcttgtggggtattacttaaaaaatctttgccagtccaatatcttagagagtttccccaatgttttcttttatagttttcatagtttgaggtcatagatttacatctttaatcctttttgattggatttttatatgtggtgagagatagggtccagtttcattcttctgcataaggatatctagtttccccagcaccatttattgaagagactctcctttgccctgtatgtgttcttggtaactttgttagaaataacttcactgtagatatatggatttgtttctgggttctctattctgtttcattggtccgtgtgtctgtttttatgccactaccgtgctgttttgattactctagctctgtagtataatttgaagtcagataatgtgattcctctagttttgttctttttgttcagggtagctttatctattctgggttttttgtgattccatatacattttaggattgtttttctatttctgtgaagaatgtcattggtgttttgatagcaattgcattgaatttgtagattgctttgggtaggatggatattttaacaaaattgattcttccggctgggcacggtggctcactcctgtaatcccagcactttgggaggccgagtcaggtggatcacttgagatcaggagttcaagaccagcctgatcaacatggagaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccatgaacatggaatgccttttccattttttgtgtcctcttcaatgttttgcatcagtgctttatagtttttattggagagatctttcacttcttcagttaagtctattcctaggtattttattttatttgtagctaatgaaaatgggattcgtttcttgatttctttttcagattatttgctgttagcacatagaaatgctattgatttttgcatgttgattttgtatcctgcaactttactgaatttgttcttcagttctaatagttttttggtggagtctttaggttttccaaatatcagaccacatgatgtgcaaacaaggataatttgacttcttcttttccaattttgatgccctttatttccttctcctgtcagattgctctagctaggacttgcagtattgtgttgcataactgtagtgaaagtagtcatccttgtcttgttccagatcttaaagaaaaggctttcagttttcccccattcagtatgttactagctgtgagttgtcatatatggcttttattatattgaggtctgttccttgtatactcagtttttttagagtttttatcatgaagggatgttaaacttatcaaatgctttttcagtatcaattgaaatggtgatatggcttttgtcctttattctgttgatacgatgtattacattgattgatttgtgtatgcatacctggaatacattccacttggtcatgaagaatgatctttttaatatactgttgaatgtggtttgctagtatttcattgatgatatttgcctcaatgttcatcagggatataggcctgtagttttctttttttgatgtgtctttgcctgattttgatatcaggatattcctggctttgtaaaatgagtttggaagtattccctcctcctctgtttttcagaacaatttgaataggactgatatttcttgttctttaaacgtttaattgtggtaaattatacattacatacattttactgttttaaccgcttttaagtgtatactcggtggcattagatacattcacatttttgtgcaacccaaaactctgtacccattaatcggtaactccccattcctccctacctctggcccctggtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacaccttggttatccattcctcagacaatggacacttgggttacttctaccttttggatattggcaaatatttcatttctcttgggtatatatttatttcttttgagtatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtgtgtgtgtgtgtgtgtgtgtgtgtgtgtgtgtgtgtgtgtgataatagccaccctgattggtttgaagtggtatctcattgtggtttggatttgcattttcctaatgagtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgattcattttgagttaatttttgtatatagtacaaattaagggtccaattttatattatttgaacatccagttcccccagcactatttgctgaaaagatggacttactctttgataccctgtcacctgcccaccccagtggacactagctggtccatccaattgctgtcctggggccttgtcatgccactcttccactttgaacccaagcccacatcattgctcccctctgggatactgaccccactataaacttctctagggctacaaccttcctaccccttgtgcctcatgaccaccccctcccttgtccccaccatgcccatgatgagtcttttctcaaggcagctcgccttgcctccatctcaccctcacctgtgcaccacagccacactggacatgggtccctctgagcctgagtcccttcccattcccactgtcccctctggcaagaccttccttccaacactgccttcatgctcctcccttgcccctgcagggcagcctctccccttggcccctattcccttagggggcttgtggccacccagtcctggcacctgacctacaagtttgccatcttcattcccccttcttctgttcatcagccccctcctctatcctcccaccctcacagttttccttgtatatgaaatcttcgttcttgtccttttgcccatgtgcatttcctgcctcctcagggaggtcgggacagcagacctgtgtgttaaacatcaatgtgaagttatttccaggaagaagtttcacctgtgatttcctcttccccagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggtgagagtcggcaggggcaagagtaatgggaggccttctccaggaaagttggagacagagagcagggacctgtctcttcccgctggatctggctgggggtggggatgaggaatagggtcagggaggctcagcagggtggtgagccggaactcagcccacacagggaggcatggaggagggccagggaggggtcgccgctgggctgagttcctcacttgggtggaaaggtgatgggttcgggaatggagaagtcactgctgggtgggggcaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacaggtaccgaccctggccaggggctctactgttcccgcaattctgctagagttgcctcgcctcccagctctgtccggggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggggtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccgggatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctggtgagcctggggtgaccctggagagggtcaggccagggtaggaacagcagggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggaacaggggatggaagctggggtatttgggaggggaatgggagctgcatctccatctacacccataagtgcttctcaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcggtgcccacccgtgtgcctcctccaggaggcactttccaggttcccaccacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacggtcagaagcatttcccccacagtcaggttgtttgatgggggatgaaaagagacagcagaagttttgtgtttctgcaaaaacagaggcagtgcaggggacagtgagaggctggggtgtccaggagacctgagtctggcggtaggggcgctggtttctcatccttgaacctaattgcactgtcagtcggcccctcatgcctgagcagatgggaaggttcgtcccctgccctgcagcaagagggccctgtccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttatcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcgcagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcatgtcaggtgcagatcctgtggcagccatgtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagaggagggcctggggactgagagcaagggtcagggcctctctttggggaggcctctcactgtaacaggactggtcaggcctgagaggagggcactgggttccctcttgggtcttgtccttttgtcttggggccctttcactccctgcacggtgagtggtgggcacaggacaggggctgatgttgatggagtgatgggagagaactgacaggggctgggaaaagcaaggagggaggaagaaaaaagtgggggcctcatcttctctcagagaaagggtgaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagacatttctggtctgtgttttatttcatgcgtctgggagcggataaagtgtgaggttcagggagaaggagaggtctgtctcaatgccttgacccagcatcaaagcaatctcccctccttgttccctttccctgctagttcccaatgactgacagattcacagcagaacagaaaggactgggaagggatggaggtgggacatctggcgccaatattcaggggctgaccctgtgagggaacatctgccctgaagagttggagccttcatgtgatgacacagagatctctgtcactgtattcagggaaaggatcaagcctcactccccatgcagggaggaggttctggctgtgatccggcctgtgggagaagtgaggacccgctccctctacagtgacagccaagaacctgcaggtgacagagaaggcttcccctcaactgtctcctatcaggttcttccaggcatcaaggaatagacctgggacattgcctccagtgacatgaacacacccagaagtgaggtggccctgccagggggtcctggtgctgccacttgttttgggagctcagtgtctggagaggggtgtggagagtaggctttctgcaaaacagtaatcatgacctataaattattttattcttcattagctttttgccataaaataaaacaggtacccaaaaagaaaaactgtctgaaaatgttgccctttaataataataataaataataataataaaagataaacaccctttaaccaccagagatatagaagtttgtcagccagcccagaaaccatcatttgccccagctcagtgataaaggcttcccttccccacataaaatcacagcctgacctttatgatgattgcttctttgttctattttatattttcatcctctgaaattgtagtttagttttaccttgggatgtataatttttgttctcttttttctttttttttttttaagacggagtctcactctgtcacccaggctggagtgcagtggcatgatctcggctcactgcaagctccgcctcacgggttcatgcgattctcctgcctcagcctcccgagtagctgggactacaggcgtctgccaccacgcccggctaatttttttgtatttttagtagagacagggtttcaccatgttagccaggatggtctcaatctcctgacctcatgatctgcctgcctcggcctcccaaagtgctgggattacaggcgtgagccactgcacctggcctgttctctttttttctctatgctcctccttgaaattttattgtctggctgagttttccatagtttgcattttgctggctccaccccaaggcatagtttaatatggacctgttttatctgtactttctacaaattggtagttggctacagagatttgcttatagactgacttgattttcttcttgaatacttcatttatggcactccattgtattcttccatcaggaggaagaacttagtactggttatttacttctactctacttttaattgccattgcttttcaatggctaaatctgttaattcgttatgggttgcaaaagaattatagtctcagtctctcattccttccccattcactagctgaataatttctaaaataagagatttacccttggctggatgcggtgacttacgcctgtaatcccagcactttgggaggccgaggctggtggatcacctgaggtcgggagttcaagaccatcctgaccaacatgaagaaactgtgtctctactaaaaacacaaaattagccgggagtggtggcgcatgcctgtaatcccagctactcgggaggcggaagtaggagaattgcttgaaccaggaaggcggaggttgcagtgagccgagatggcgccattgcactccagcctgggcatcaagagtgaaactccgtctcaaaataaataaataaataaagtggagcacttgacggccatgggagagaatcggttatgaccacacacagcaagatga

SEQ ID NO: 709 - DNA, 81335 bp, Human
tatcagtcctgccttactcttggtggaatcctgtggtcctagtcaagtgcctgctccatgaatgtgctgaataaatgaataagcattttaattgtgtatctgtcattagtgtcagatgtgttatttattccagcatggttttagcacacagacacactctttgatgcagacttttcttttctttttacatatagcaacaataaaaaactagactttcatctcctgaaaatatcagtctaataatcacctatggctgtctctctggttgctgaaggaaaaaaaaaaaaaaggcagggcacacctggattgcattagaatgagactcactacccagttcaggtgtgttgcgttgtgggtctccggcacatttcagaggctcattaggaccctgaccccacactggggtttacacccctaaaagcaggtgtgtcccgtggcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtggaccccaccatagggcaagtcctggaaagattcacgttgcctgttacttctggtttaaagagcataaagttttcagtttcaactccatctcatcttgcctccttaatataaaagggattccctttctgttaatatcgttctcccttttccttatggcaatgattgcagtactctgacaactatgctagagaaatttcttatgataccttctcttcatctctccccgtctctccgtgtgtaaagcacattttagactctctcagcgtattaaggacaggatccagctaagccaagacttgagaattttatttccatctttgacctatcaaccctcttaaagaacaggctaaggagcatatcaggaatagcaattggaattgatcccatatcccgtcgtttaacctaaaggcctaaaaaaaaaagtgatagttttacttacaatatacaatctaaaagaaaaggaaaattggcatcttcatcgttaatgtagtataattttccattcccaaaaccgtcatccaaaactcatgttatatgggtccatctttttgcagtcatttctcaatgtctcagatttgtgacaagttgaaaaatgtgtactgatagaggggagaagtttcatgtttcaaagccaaagacaagtttgttgcacacaggcaagtggggaaagaggaaggaatattaaataacaagacctatcttgttccaaagtgttactgctatatatattgcttaacttttttccccttaaagcaaccctgggtcatggttgacattgttcctagtttatgtatgaggactgtggctcagagttgcaaatacctttttaaaagttacttagctagtgactgataggtgggaactaaagtcaaactagggtctgaatgcgtccaaagtctaagccattttcttccatgtatgtatcttcaatgcaaataaaattaagtgaatggtttaatatgttgtctgctgagctgatgggtcatctgtaaacggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttacttttaactcagagcacctataaaagtctacgagttgtctgtagcatgtagaataagccctagcctcttgttaagcatcctcaataccagaaatcacagtaggaatgcataaaacattcacagacccatacattttggaatgattttgcaaagcataattttcattgcatgagagagttgtgggtgaagaattagggagtggagccgacaactttggtctgccagaggatcttggcaaggtctcaggagggagcaattttatttctgttgtcctgtcatagtttcctgatccatgacattataactactgatatttagtgcctacttcctgtctggatggacactgaatctatttctggatgtctgtgtttaactggataaatcatgacataatactgtattaaatttaagataatgcctgtcaatggaaggaaaaaattgtttgggcatgtgtagcatgggagttgactgttctcagagaaatgtaaacatagtagatatgtcatagatatgaattaaatgaagatcttttggatggatgaatgaataaaagtggagtgaaaatttatcaacctgactgatgagtaagataattgattagaaatgatgagccaaactgatttttaactttcaaaattttggccaatctacaaggtatttactgggatgaaaggaaaaaaggcaagattcctagtcagtcaatgagttaaaacattaatagtgatagtaatgccttgagtatttgccgaagagttgactgaagttatttctcatgtaacattctaaagaatacagatatcttttattcctcatgtaaagaaactgcctctctattcagaataaattcagtggtagcttgaagctataaaatagggattgaggctacagtctagaaataaaacactaaaaacaatacattggtaataaagataatttaggattcttaggtttgtgggctatgcactattttgtatgaagaagtttcaagagtgtgtgtaaatatatataagccatcttctgtagaagaatgtgtgtgtgtgtgtgtgtgtgtgtgtgtgtgtgtgtgaatcttctgtataaaatagcttcagttgtcctgtttcaaatgtgggtgactctaatgtttcaaaaatgcttagctcagtactgacacataatacattcaaaaaatagtggttcttctttattgtttacttaaatctattatctgtatgttatctgtaacaagcaggctgaggttaatagggacaattgataaactgaaccaaaagtttaaaaattaaaaggtaatacattaaaaggtagaagttgaaatgaaacacaatgagaaatttttgttggctgaagaaaaaaatgttataatgattaaagatcgatctgtgattgccatgtcagtaaggtatcttctttcctttggaatagctttacttgctatcaagaacctgaaggtgtagggtcttcaaatggtgcccatctcccacacaattaaaaatatccacatggactagtctttgagtctctgtagaatttcagatcagtggttgattcagatagactcctcccctcaaaagagaaggtccatatctcgcctaccctaccctctgtggacaaggtgtcccatatggtatattcatgccataagcagaagtgagcctgcctgtttatctagaatgcccagggtgagagacgttaggcatgagataccccttttagtcaagcaagttgactgcagagccagcaccaagagagttgcctggatagtaccgcaaggtgcttttcttcctgcatatatattgttggcctccttttacctccctgactccccaagagacatctcttctctcacttcttttgtaccagaggaaagtggtctctctgccaggagggtctgggcccagacttgctcgtgaagactatatctgaggagacccaggtgatttctacatgtccactttccacccgggcactctgcatcatcaggcttgtttaaaggaaactttaatcacagctggttcctaaattaaggtgtcacaaataatgactcaattaatatagttaagcatagtccatccatggactatcaatattcaaatagaacataataaaacatagaaatgattatcaaattacactaaaaagatggtctttatttggttattcaaatatgtttccagatctttcattactttggagttaccactgaaagcattatacacacactaactctcatttgggtaatagtctaaagttatacaattacactatccagtatagtatccactaaccacaggtggctttgaacacataaaatgtggctagtcagcgatgagagggctgtaatgtaaattacatactggcttttgaatacttagtataagaaaactcattaatttttatgatatatattgaaacaaacactttaaaattattgattacataatattttggatttattaggcgaaataaaattttaggttaaataaaattaattttatttttacttttttcatgtggctattataaaatttaaaatttccaatgggcttgtattatatttctattggacagcactgctgtagagaaacattaagttctctgtgtaaaaataacgctatctctttaggagatgctttcctgatatttatgcataaatgagtagaactttcactttcttttctagactaagtgttctatagttactgggccttcaagctgcctgcctgtccctctcttacaggaaagacccatctcaagttagtcaccattacccatatttagatttctttctggaaattttattaccttagccagcctcctggttcatattatataacctatttgaaagaatttaattagcattgcattattaaactaatgattacctaatcctcacttctacttgattcataggagttattagcttaacattaaatagcaaatatctcactgttgaaacttcaaatatgtttttcttgataactttttactttttcatttgcaatgtgctttaaattgtagcttatgaagctgagattgcagattggtcattttgaaaaatcatccctgaatgaaggctgttatacaattatgtagaaaatcaagacagagagcttcactaataaactatcaggttaccagaaagaagtttccttatttccagcagtttcccaaactttatgtcccaaaaggatgaggtttccacctaatttgagagatgaggctttctaaatgcactttagtttttgccttaagtttacttggtcactgagtgatatacccaatgacttgaaaatatatccccttggcaacagttctagggtcagatgctgaaatccgttgcacatgtgggtaatttatccattcagttgttcattgagggatgcctaagggcctgaacctgggcatacaaaagaaacatactccttgtcccaaaggctttaaagtttataagataggttattataggaaagtatggtgagatttaatctaggtaagacaataaagtgatgcattcctgaagaattggtgttcaagtgggggaactgaaaaataatcagaagttagccagaggaagaggctatggaaaagtttgccagaaagagcaaactgtgtgtataaagaccctgaagtctttgagagcacgatgcttttgaagaactaaaaattgtgtacagttgcactatggagtgtgagctaaactgtaggttagagaggcaggcaggaattacttctgatacaactctaagtatgaatttaccctaggatatttaaaactggggagtgacatgatcagatttgtgtgtttgacagattctctggttgcaggttagtgaatgctttggagtaactgggtcaagactgaaggcaatgaggcagttgtaggaagattttgttataatttagactacagatgacaagtgtctgtacaaggacactggcaatagcagtggagaagaacatggagattctgaaggtatttaggagatagcacttggtaattattgaatgaaagagatgagtgagaatgttccaaagatgttactgaagtttctaatttgggctgtgacatggatgatgatccaatatactgaaaaagggaagagcagcaggttttctggcaaaatgatgagtttcgttggcttgagattcctgtgagacatagaagtaaaaatctagtgatcagttctatgatcagttccatgtatgggtgtggtagacagtagagaggtctgtactagcaaatcagaggtgagtaattgacgtaaccccattcacctccaaggctttgattaccatctctctggggtaaatagatcaaatggccaatggcaaatttctaaggattcctacagttcgagaagtgattagaatagtgctgctcaagtctggctgtaacttaaattctcatgcagagcttttaacagttctggtggcccatctcaaactactagaatctctggggtaagtctatagggcaccagtagtttccagaggtccccagatgattccagtattcatccatgcttgagaaccgctggagaagaaaagaggctgaaaaaaaggctaagagggtgaagccaaagaggtagcaagaaaaatcaggtcaatctgacattaacctgattaaaggaagagagtgttttgagaagaggtgagtagttggcagtagtaaaggttgccaagacatcaaccagggtggtaaattatgaggtctcattagatttagagaattagttcattagtaacctcggtaagacaagctttaatggtgaatccactgcagagggttgagaagtgagaaacaatagcaagcgtcaataacttttaactgggttcttccttcattaatacattttattgattacttatgtattggaaatacacagttgaataaggcatggttaaagcccttgagtaactcagttgagatgatgggagagacaggtaaatggacaattaattatgagataatgtaataagcatgacaatagacaggtacatagtgatgagaagaaatgaatgggagaaggcttcctggaggagtgaaatctgagtagtggacccagttctgactggttttgaagagcacatgtaagggctcaataaatgtgaaataattttcatctttttcacatttgggcaaaatcccctgggatttgctgcacatttcagcctcattccaaagtgtctaggtccgccttgggttccaaagactcatatcaggtagttcagacagtaacacctgctcctgaaatagggagcttggaaatgactgtctttaaaagcagggatttttaattttgagattagctggaaacatcaaattagaatatggaagtggacatacaggtgacaggtctgggctcagtgtgcttgttctcagtttacctctgagaatttttaaaaatcatagaaaatcttttttatataaactatgtaaaacactataattcacaaaaatgttcagaaaatagattgtagacttagttctaaaaaccccttttatgggactccttgtgtgcagtggattagacatgttcttttgacattatgccctgtgtagaaaatgctggtcaatgtgcaccatctgtttgtgaatcccttcaaggtctacctcaccacaataccagtctgttttcttgcggaagttttctagaagtcattagactacaatcattttgtctgccagtcattgtcaatatcacattttatcctttaaactctgcccagagaaacgtcctttgatatctgtaactcctcatctcattctgatcctctattggccaggataatatgatacattcctcactggtttttctcatgtatttttaagccttcctatcttcctgacctcctttaattctttcattgctgtctttttttctttttctttttcaaccatcctaccctgtggattccaaaaccaagcatggaactttaatactgaccaccaagcatatttccctggagtattttctgtttacatttttgtattttcttgtttcaaagatagacaaagtggcatccacacattagtgattgtttttcaaatgaatttttaaatccaagagattaattgaaaaccatggaggttcagaattttctttccttattttctaatgttagaggtttaaatatgctcttttaataggttgtttcagaatagtataggtttattcaaaatgtccatagttgaaaataatggaaaagtactaacaactaattgtctggcagcatcagatggtggttgatagtgtgagttttaatcccttccttccccacttacaagtggtgtgaccttgggcaagtgcttagtcatcccttgtttcagattctgcatccataaaattgggatgataatagtattgtctacttcatagggatgttatgaaaagtgagttaatacatgtctttgcatgtattaaaactgtggtacgtagtaagcatgcaataagtattagtaattagagactaactttccctctttaaattatgcttacaaaatgtatcagctggggcacatttttcagctttagttattaaaaagacttgcgtacgttttctgtgggattttgaagaagtcctggcagagaccccaaacctaaaatcaaacccagaagtgacctagttgttagagttctgaggcctcatgatgactcaggatcagcccagatttataaaattgcaaccataaagcttggcactactctctggggacatttacctcttgaactctttctaaatagaatagaataagataaaaaaaaatagctgaaataactggctttttcaggactacaattatataaactgtttctcacataaattgagcatgattattggccattgtgagattttatttaggcaatatgaaaagatgacatttaaacacatttttttaaaaaaacatactttgagaatggtttccaactttgatgttttgctcttttgactcttattctccactagactagctggaggaaaagagttctagaagtttagtacttttatgtcctgtatcacctctaaaacccaaggatattttactttccatcacccaaaattatttttattgtagaattcataaacatcattatcttttagaaacattgccaccaggtttaactagatgtgtgaaaagagtacatagtttaatatagtcaattattatatgaattagtattaatggatttagtaagtattaggacttaaaaggaaaaactaaattaaggggccattttaattaaaaagctaaagactgctgatcaattcttgcagcattgtgagcgccctctgctggctcagttcaaagcaccataatgcacgtaccctgaggagcagaggcattgattatttattgaccacctactaggtgccaggcattcttgcatacacaagcataagttttctgtcatcctcatagccctgcaatggtaaattttgtcatgttctcatatttgaattgattttctcacttttaatatatttttcctaatctgaagttatgtgagtgaagggattatatactttaattattgcttttataaaaaatatcttgaatgaatgactctttataaaatatggaattggaacaagggtcattcatgttttaggattaagaaaaactttagagtggaacaatttgaaatgtatgggttttgtcttacaatggaatagagcttcagcttaaaaaaaaaagacagttggtggaaggtaagggcttttactgcttttctgaaacttcacatcacatcatgagttttgaaagatcaggtaagtatatatgttgtcttagtagccagaaagccagactgagagccccagtcaaatgtctgaattggtggggaagtgacagtacgatgacgcaggtagataaagcaggcatttacttgcattagaaagtcccaagctctcctagccaaaaagtatttcactagcactgtcaaaagttatatagaaagaagaccttagagtctgaccttttccctggtccttctttctttagtggaaatgccaaaatactgagaaccattctaaatggaggaaaagagcagggcaagatagggaacaagtaagtgacctttttcttgaacaagtgaaagtcgattgtacagtctgtgggcatatttgctatattttatatattttcagctaaaagcttcagaaagtggaatagatttcagttaattcatatgtctggaatatttctagagttctatgctatagagtgaaataacttagagatcaaagatgctattttttaattctaatctttccacttacggatttgggcaagttatttgattcctttaagactcaattttctcttctgtagggtaggattaataatacagcaatcctctgctactactgtgggtgtaaaatgagttaatgtgtatgattacagttccccaataatgatatgccacatatattttatgagccaggttatatgctgcattgcatgtgcagcttaatatgcttacattaatctttaatatgatgatgccaatggcaactaacatttgcatgttttcgctgccaggctgtcatccaagcacgtcacacatatctcatttactccacagtccttgcagaaaccctcggagataggcatcttctgaggaccccagctgattctgtcttaagtcatcccactcacaaatcatcctttgtaaagatcttcaaactcagagactgtttcctttcagaccatctgttactgtcttaaaattgaagaaaataatattttggaagagaagtaggggagaatcatagtaaagagaaaagacctctccaaagcttagatctctgagagtttggtgataattatgcagtagtacattctagtaaaggatttttttgtggtgatataatgtatttcaaaattccctccctcatacatactgagttcctgcctactgcatgtaaggcactatcttgagctgtgggaatgctgctgtcaacaaaagtcaatctgccctcatggaggtgacatacaaggtcaaatatctaatctcccatagtccctgtcacacttggagcaatgacactaaaactggtgatatgaataagaatgaaagggggaggagtaaagaatgtatttaactagctttgtagtatttctttgatcaaaattcctgttcatttgcatttatatacacatttatatatgctgatacacatcagtaggaagaaataaactgtagtaagcatgcatttttacattttctttcccaaattaaaaaaaataggaaagagaaaggcttaaaaggagatggtttttaatgtggctttgttttttaaatatctagtggaaaaatgcattcaactgtggaaagaattagtcattctagttgtttaaaagcagggaaaattatcaccatgttaatttctgctgacctcttttatgttaaaccatgtaaagtactttttcaattatggagctgatttgatttactaagagtttagatgagtaatttatgaactgaattgaaaaccagattataaatcacttcagcctgacatttggataaaatataatctgaggttgtttatggtgttctgtcagagaaattcatgagaattagctctcatggcagttctaataatcgtcatttttgaccaacttagaaatattgtatttctacccaaagacaatttgcttaacatttgatatttcaataggtaactaaacaaagggggaacaaaggatattacttttatttttaaaacagtaggtttttaaataatacaagaaaaggcataaccatctgttaatacatcaagcttgtccatgtggtccaggatggctttgaatgctgcccaacaccaatccgtaaacttagaatggcgatcattaaaaagtcaggaaacaacaggtgctggagagattgtggagaaataggaacacttttacactgttgatgggactgtaaactagttcaaccattgtggaagacagtgtggcgattcctcaaggatctagaactagaaaataccatttgacccagccatcccatgactgggtatatacccaaaggattataaatcatgctgctataaagacacattcacatgtatgtttattgcggcactattctcaatagcaaagacttggaaccaacccaaatgtccatcaatgtagactggattaagaaaatgtggcacatatacaccatgaaatactatgcagccataaaaaaggatgagttcatgtcctttgtagggacatggatgaaattggaaatcatcattctcagtaaactatcacaagaacaaaaaaccaaacaccgcatgttctcactcacaggtaggaattgaacaatgagaacacttggacacaggaaggggaacatcacacaccggggcctgtcgtggggtggggggatgggggagggatagcattaggagatatacttaatgtaaatgacgagttaatgggtacaggacaccaacatggcacatgtatacatatgtaacaaaccttcatgttgtgcacatgtaccctggaacttaaagtataataataaaaaaaaaagatataaatgttggcaagaatgtggaaaaatggggaacccttgcccactgttgatgggaaagtaagtataactataatggaaaatagtatggagattcctcaaaaatttaaaaatagaactattacaagactcagcaatctcactgaaggtatatatccaaagaaaataaaatcaatatgtcaaagaggaaaaaaaatatgagattttcttgcaattttttttttagctgatcagttatcattagtgtcagtgtactttacgtatggcccaaaacaattcttccagtatggcccagggaaaccaaatattggacacccctgagctacattgtagagctattgttcacaagcccaaccatatgctacaactacctggggggcttcaaaaaaattcttatgtctggttcttaacccagacatgtcaagtctgagcctctaagagtggggcccaagtggaggtactggtttcaaactcccttcagttgattctaacgtccagtcaaggctgagtactgagtggaaaaggagtggactcaggatcacacaggttaagggagaaaagctttggagaaggccatgatcacaagctgatcatgtagcagtcttacttcttctaccaagattccgcaggcacaacaaaagaaaagagaagctgggcatggtggtgggcacctatatccccagctacataggaggctgaagtgggaggattacaagagcccaggagtttgaggctgcagtgagctatgatcacgccaatgcactgcagcctagatgacagagtgagatcctatctccctaaaaaataaaaagagaaaaagtcccagaaattaagaaaaaacccagaacactaggggaaattacaggatgttctctgaacagattctaacctgtaaccagtacttgaaagttacctcaatattattgctgttgggggctgcctctatggtaaaaacagtgttaagaagtgaaaaggggaaacatatctaaatgtagtatatgtatttgctcacttattaagattggtttttcttctgtggaagaatgattgtttcatgactatttccatgaactttctttctggctatgcattcattctttttacacacattttgaattaagatatatgaaataagcagaagatgtttagtcaaaccataatagaagctttgaattgtttttcgtttactgacctttccatttcagcacccatttctgggctgtttgtcgggggtgggattatgacaaagatacagtcctgggcaagatgaatgaggtcactatttactaagccttggaaataggccagaaacattgtaaataaataaatgtagttaaccttaacaaaaatgaaaatacttattcctacaagatattaatcaatttcaccacaatttcctctgagtgatcgcatcctgtgtgtctaagaacccttgagtgctgatgttgagagtcatctttcagtatctaagagtggattaactaacaactgtataggagatatttgaaaattaatgaatcagaaattttatctatatattagaaggcaactattgtttggaaccacattgtaacagatatgagattacatctagtggcattttgacccccaccccaccaatttcccacttacacacctgccatatgtttttctatttggaatctcttctgctcacgggtgaatgaaccacatcactggcttcctgggaaagctcttcctacatttattcttaagtaaacatctctttcttgtggcttctggagggctaattgttctcctatttctaagaatcattatttttagcctagaacaagaagaagggaagggcatgagccacactggaaataaagtcccaggactttggtgagactacatgggacacatcttaaaatagcctaatgatttagtggcccttttcccagagagctgagaggcactcatgtggagagaaagaagtttcagggaagtgatgttagtaagtgagaaagtgagtagtttgtggtgtgtgtaaacctcagtgtgagcctgggcagtgatgacattgtgatgttacctgatggagctaaaactaaaacaagaaggaggcaatgcagaatattaaatagataagagttcataatgcaagagtttgtctagtcttcacttagaaatttacaaaacagttcagctaagaaaccgataacaatacactatttttgcacataattttttggccattttcattaagctatttacatggtacattgtggttctaaactattgtctttttaatcttctgggtggctctctctagaataatagatttgtttctaaatattggatgtaatcgtaatgaaagtgtctattatacacgccatattatttgtgacccccatcctctcctgtccttaattttcttcttgctcaattgtcttaactgagtgttgactataaattcataaaaattttagtattttcagagggaacttattaacatggctattgtagtaaataacaggaacttcatgtagactgaatctaccatttgttatctatttttgacagtaaacaattgattttagtgaaaactgaaaattgtattataatgaaaattaaaatgccttgtttgtcattctcttttaatttaaattttgttggtttggcattaggtagccacaataacaactccctattttagaccttacctatctcccacacacaattttttttctcctaccatcttccctctgttttccccttctcttttcgtgtcatttctctcttcatcccttcctttctcaagttaacacggagaccttatgtgtccacctggactgttctttaccaaggtttgggccacagcaagactcctttccaattctaatagcaaccattgccaatcaaccccagcattctttgtccagacctagtcttagtcctcctcccttcagtctagttctccaggaagccattaccagttagtgggggttgccatttattctatgtgtatgctgtcgagaaaaacattctctgcatttcacagtaacagtgttcctgaccatgagaaccacttagggcaggggtccccaatccctgggctgtggatgggtactggcccgtggcctggtaggaactgggctgcacagcaggaggtgagcagtggaccagtgagcattcccgcctgagctttgcctctgtcagatcagtggtggcattagattctcgtaggagtgcaaaccctattacgaactgcacagccgtgggatctaggttgtgctttccttagcagaatctaatgccagatgatctgaggtggaacagtttcattccaaaccttactactgcccatggaaaaaattgtcttcacgaaaccagtccttggtgccaaaaagattgggaaccactgacctagggtaatcagggcctcacctggatctgctggagcagaatctccagaggaggagctcaaacattttcttcacttcagttgtgattaaaggttttgtttttcctgaatgacattttagaaaacgaaagtataaacaaacatcttcccacactccttaaacaaaatctctcctacccaggagacttagtgcaaataatttcacttctcaaatattagccttaccaggcatagtggcttatgctggtaatcccagcactttaggaggtcaaagcaagaggatcacttgaggcaagagttcaagaccagtatgggtaacatagtgagacccccattggtaccaaaataaaaatattagtttgtatctctgtaagtgttctgagtttgcccaggaagctacatttaggggtcaacattataggaggagacaaagtgccaatgatatagagaatggtcaccataaattcatgaaaacttggtacctagtgactagtgttcaaaattaacaaaccgaagttccacatccttatccaatcaaattgatgctaatgtatttatctgccaggaattaagaacagatgcaatagaattgtcatatgccaactgaagagggtgaaaagaaagacagcaaaaagaatattaggatactgcatcttactcttccccaaagtaacttatttaaaattacttaacatgggattttaataggaacccagctataacacaaataattttttctaacaaaagaaaataatgatcactgtgaagaccacttcttatatagtatagaagtactatctagtacatgagcattttatttatgtttggctattcatgcatttgccaaagtatctattgaagttttttgtttactactgagataatctggtttccaaatcacttttatctctgttgaaaacatgagtcatattccaataaatgtaaacatagggcagtttcttataaacgcaaggcattattggtatgctaattgtatgttccactttctgcatgcttaatcatcaccttccagctccaataaattgtaccttaattgctgaggatgtattatagtctttctattcttaatatctcagtagaagaaacatttttaaaagtgctctgataatattgcttacgttgttagataaatggctaattcttttccaaacgttagacacagcagttatagttgcacaacctggtattagctttaagtggttttccccactcctagtcctgttagctatctcttatatgattgagtctatctttttatggtgctaccagtcagaggtcatttctacaaccaaagtcaccttgtattagagaataattagttggcacagagtaattcacatttatcctcacattgtgcactgaatataagatagagaagtagttaacagaaaaatactggggatgagtgcacagttttctcttcttttgtagaatgttttcaatacaactgataaaattattttcacatgctataggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaaggtaaggcatgattttgatacgaattagataaagataagtaagtgaataccttttagtgttttaaatttatgttcaagtttagatgttcagaggagagggagatcttctaagtaattatgttctttttaactactcaatttctttctttacccaattgcaatagcattatttttcataaatgcactttgtgctataaaaattctacaatttgaataactctgaaatctagctctttaactacccacttttgcatcaaatttactttcaatttggtataggtgagactagtacccagcaaatataggacatttaaattgtgaaattatattggaagtctgattaaaaagaaagactttaggtttccttttttacctttagcttccaggagtaattgggaagaataatcagtgtaagcaaatctttcattcgcactcactatctctttttctaatttacatgttttccttcaagcagcaagagattcgtgtcttgagtttgaaacatttttctcatggtaactatgctataggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactctcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctgtatgtttgctgtcttctttttcctaatagttttcggtttatctttaaaatattttcatagtagagtttttagtttttctcggatatacatagccacatactacaaaaatctcaagatgccataaacctaacccatctacaattgtaaaatacaggatcaggtaagatatatttttttaaagggatgaaaactcctgaccagaaatggtcattataaatgacttaccaatttattgaagttttctgcttagcaaagccaaaaggaagctgtggttccaattcttattttcatagaagtttacttatatcattttttggaagaagcaaagctttgcccccttagaaagttccaaaagcattcattcatgggactttgtaataatagacctttatgtccatgcagatcttgattcagtctatatttcagttgggcaaaatctaagaaaggacactctcttcaattaatggtgttagcaatagcaaagacatggaatcaacctaaatgcacatcaatgttggattggataaagaaactgtgatacatacacactgtagaatactacacaggcataaaaaataacgagattatgtcctttgcagcaacttatatggagctggaggccaataacctaagcgaactaacacaggaacagaaaaccaaataccacatgttctcacttataagtgggagctaaacattgagtacatatggacacaagggacacaaagtaggcacaaacactagggcctacctggtggtagacggtgggagcagagagaggattgaaaaactacctatcaggtactatgcctattacctgcatggggaaataatctgtacatcaaacccctacaacacgcaatttatctatgcaacaaacttgcacatgaaccctgaacctgaaagtttttttttaaatgcctttgggaaaattggctatctgcgtgcaaaagaatgaaattgaacgcttatcttagcaaatataccaaagtcaactaaaatggattaaagacttaaacacgatacctgaaaccataaaatttctagtggaaaacataagagaaaagctacttgacattagtctaggcaatgagtttttggaaattacaccaaaagctcaaacaacaaaagcaaaaataaacaaatgagactatattagaaagctcctgcatagcaagggagataatcaacagagtgaagagacagtctgcagaatgggaaataatattcgcataagtcctatatatttaaaatgtataaggatctcaccaactcgatagcaaaaaaccaaataactgattaaaaattagtcaagagaccaaatggctttctttccaaagaaggcatcaaaatggccaataagtagatgaaaaggtgcttaacatcaccaatcatcaaggaaatgcaaattacaaaccactatgaaatatcacttcacacctattagaattgtcattatcaaaaaggcaagagataacaagtgttggcgaaggtgtgaagaaaagggaacccttgcacactgttggctggaatgtaaattggtacagccattatagaaaacagtagagaagttactcaaattaaaaataaaactaccatatggtccagcaatccctcttctgggtatatatccaaaggaaatgaaatcagtaccacataaagagatctgcgtttttatgttcattgcagcagcattcacaatagccaagttacagaaacaagcttagtgtccattgacagatgaatgaatggataaggaattgtgtgaggtgtatatatacacacatatatacataaacatatacaatggagtattattcagcctttaaaaaaggaaattctgacttttgtgacaacatggatgaccccgaaggacattattttaagtgaaataagctaggcccagaaagacaaatactgtatgatctcacctatctgtggaatctaaaaaagtcaaatacatagagaagaaggtgagcagagagagggttaggaataggaagatgttggtgaaagatgttggcatttgtgtaggatgaataagtctagagatctaatgtacagcatgaggactggagttaataattgtgcactggaaatttgccaagagagtagatttcactctaaatgcacaaaaaagatgaccgtgaggaggtatgtaaagtgtagtaactgtttcactatgtatacgcatatcaaacctgatgttgtacaccttagatatacacagtaaaaagaaagcatgggctcaaaatcacaaatcctacctctgtcttactcatttgacaaaaattttttgagtatatgctgtgtgtgcttcctatgaagaagcagagggagatatttttattgccatttcatagggatattttgaatactaatatggaagggatttgttatatcaaggttactggtttttatttttaaaaaatacaaactatagaccttaaaggacatttttgtaaggatttaagaaacaaattatggagattttatctttaagataaaattctgagttgttttaatatttcattttagattatgtgaaaaaatttggagaaaattttgcatcatgtcaagctggaatatccagtttttacacaaaggtaattgttcaaaaaatagctgctataaatgtttacatatagaatcttaattcttctcatggtttggaagactgatatgttttaaagtaaaaattgtgtaacatcttcatcatgtctcttaaacttgagtattacaacttaatttttgccactcaaaattccacatatatttcaataaaatatcaatatttaggtggctatactgcataagatgaatgaaaatctatactaaagaacatttctttcatcaacaatttaatgaaaatcaaaagtagctatggttaattgtcttgttaacttaggtattgaaaatatcaacccaagtatgttattttaaatttctagttgaggggcaaaggaagaatatcagtctatatttttcattaaattatgataattgggaaatttaagaatttaatatccccttaaatcagatagacaatattcccaagatttcttactctctttctaacattctaggatatgtatgaaagggcacagttgtactcaaccccaaatctctcagttttcttaaaaacacactgtgaattcaggaatgttttttgactccatgaagatcaggcactatatcaagtttggggttgacagtgtctgcacatattaacagttatattaaaatgcttacaaagaaaatgctttcttcagtttaagttgactttttttaagtttaggattgtttaggagtatagaaatatgctaaagatatttaattgctgaaagtgttcatactataccaggcaagggcatgctcattccaatcttctcctaaattttcctctgtataacaaaatatgccccacattccattggacttttttccctaagctaacattattagaaatgttttccctaagctaacattattagtcaggggttctttgcaaatagaagtaaattaagtctactttttattctttggcaacacatgattatctccataattagcactaatgaattacccacatacgattttctttaataggaaccacattgcctttctcccaaaagcttactctagcgttcagtacttgtcccttcaacttttgaaatccactgataaatgcattgaatgagagtttcagagtttcttctctgagatttcgcttttagaaatccattagccaacttctctggctttttttttttcctagtatgttttaacttcacagaatattcctacttcaggaattgattattataaaaatatgttctcttcactatcgtgtatctggaggaggtttggggtggtgagattaaagtttaaataataatagttttttttttcttacaggatttaattgtgatgggggccccaggatcatcttactggactggctctctttttgtctacaatataactacaaataaatacaaggcttttttagacaaacaaaatcaagtaaaatttggaagttatttaggtactataaaaattgacaaacttaaatgatctgtgccttacaaatactagtactgtaattataaataaggaaaatgtattttccaaagatctaaatggccagtataattacagtaataattaggcagttcagaaactgtctcttaaggataggatttatgaaacttcagtgaactcagtattttacatttacacatgtgactaaaatcatcaatatataattcttaatagaactcctagtttagtttactctttgtagttcactttaggaaacactagtaagtttctatctctatgtagtcaactgattatacaggttgtttctgttgagtgcctcccatatctcaggaactttttgtgagaactttacatgaattaactcatttaaacatctgcataagtaagtatagtttccttaagcaccaactgaaagccagtggtactgtccaccacattctggatgaggggctccatgaagcacatgggtctaaaaacagctcattgaccttcacctcataagttcttagaatatttcccagagcttaactatttttatcatcttcctcctcctcactgtcatctcataagtcaatagtaggatactttatcatctgtatttcaacagaaatgcaaacttttctggcattaatgtccattacaagaaaataaatgcttttcctatagattttcagaaaatccagctttgtttaaactgtatgtgtgtcaaatgtgagcatcttacactcagaaataattataaaataagcactctttctttctattcaaacagaagaaatttcaagtagaagaatttgttacaattcaatgttttcttgtttatgatgaaaggatactttgaaatagttcaagaaatataacttgttacgccttttatcacataaaatacgaacaattttttgtcatcgaaaagtcatcacaaagatttggtggcaaaaaaagttgaacttcagcaagatgtttatttaaagtttaaagttttcatttcccaattgagattttatatttaatatactctaaaatatgtctgttgtaatcctagaaactgattatactgcaccagatgtaaagatgctattttcaatttctaggactcggaaatacataccatatgactgcagttttgtaaaacatatcaaaattgcataaaacataatgaatgaccaattttgagtatctctatgctaaatattcttaactgcttaatgtagtgattttgaattcggtatcatttaattttatgatctattttacccatattaccatatgatgtactttacccaggactctcatactttctcccttttcttaaaggatattcagtcggagctggtcattttcggagccagcatactaccgaagtagtcggaggagctcctcaacatgagcagattggtaaggtaagaattacatttttatatttatttcttcacaaaggttcaaatatattgcatgaataagatattaaaggagaaactgtgaatgttgtaaggaaagaaagattagaaatgatgaacagattattacatttagtggaattggtgaaagatgttatggttttagaagaaatttagcaaaaaactttctgaaaaattacaaaagtcaaacgagacattgttttaagaaaattataagatagaactatctaaaaatgtccagggagtatatggtgaacagtttcacagctgaaaagaagttgaggtagctacatattttgtagtaagactagaaagaaggaaatattattcctggttttagtttttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaacccttttgtgtcactctcaacaggatttatttttatatttgagcaattaactgcaagttgtaaaaattcatgttttgatcaaacagaaaggagtggtgttttaaaaaatgttattcctaaaaacttttctaattctttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttgggacagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcggtatgtccaagtgccccaactggaagccatttatggaattatgatcaaaactcaaattggtcttattccagagatctgagattgttttcaggtttcttttattgacaaaagttaaaattctaatactgtactgatgctctaaaaattaaatggaatatgatgatgaatgggaaagtttcccattttgatattccagaacaatctatgaaatagattgttagggagtttctctgttcacagcttgtatgtgttcactctggtagctgaaatttctttcagttttatgttgatactaatctaatttgaaagaataattttcatacctccttcaaaatgtagatttcttaatagttctagttaaggtccttatataaattataaaatattactaggactagaagatgaagaattaagtattttcaatttcttaatttgaaaacaattagaaacaagatgtgttttgttaaaacattaattttcataattcatatatattatgctcttgataagaatataaaattggcaaggtttattccacagtggatatattagttgcataaataggtaattactgactgtgattcaattttaaattattagtgataatttgtggtagaaactgaccacttgataattcaaagacttctggccttatcttgccagcctagattcttggcgttaagtcaaaacaaaaaattggtggagtcttaatgaaatcttcttggcccgttctttgatttgaaaacaagagtgggcttgtgagaagaccagttcatttataatggcatagcatttttcagtcaggattcaacaaagtggactctgtttcaagaaagtatttgtaactatgttcagtcaatggtttcagagcatttagcaagttcttatattaagcatcagactaaactctacaatttaagaaagaaaacatctagtctcataaatggaagattctctaagtttgcaatatagagcagggaagttatttatgctttggtatttcctacactgtatttaacctacatttaatagtaaaagcaaattatctacacagtgatcattaaatctcatagtagtaatatcagataattttcttccatttctatctccaaaaatagtggtctttgtacttgctacatcctcgtgctgcaaatttctcttattttcctctttacgactaaacatccacatgtatacctaaagtaaagcaatatagaatcattttcccccattgaaatcttaatctcattaagaaaaaacagataaacccttctacccacttggctaccctccttttcttccctcatgcctaccctgaggcactactcttatgaaacacttggattaaattaataattgattccagcttttaaatcctctgatgtagattagtcttcctttgttccatctaacctctcatttctcaactctgaaatggcactaaccactaagtggcatttatttacattgatttgatttggtattgtgtgttcttctactgtagtatagatgccttgtggagagagattgtctgtcttgtttaccgtggtttcatcagggcttggaagagtcctagacaagtaggtgaaattgtttttgaatgaactcaagaaagaatgatacttgagtgactggcttctgcctacttgtactaaaatagctctcaggggttcctagcgaactctcagtcaccactctctgtgactagggaatacttgaagaagagtgatcacctcttcctattgaaactctccttccagaacttcagagccattgcattgtcttaagtctataccttgtctgttctccctggagccttttcacccttccactccttaatttggacatttgcccaggagccaagctgttttatccctgactcctttgaatcaatcattcactgcttcagtgtcagtgattatatttataaagatgattcccagtcatcttagttcatttaaaataaaataaatgacatttagtgagtatctgaaatgtaaccaggactataaaaagagctaataatcttagagctgaccccaggacttcaggatctttgtgaagacaccaatgggagtaaacaattgactacaacatggtacatggcacattataagtacatacaaagtggaagaagtgattccctttgggtcaagaagcttttacagaggaagtagtgtttgagaaagacaaaaatcagaatttttctattggaaaattcacaagtgaagacacttgacaaagagcatgtgtatgcttaagaggtgccaagtaaatttgagaagaataaaggacatggcctttttttctttttaatacaaaagactgacatgatcaaagtttcagaagagaactggtagctgttattgcaacagcccattattacattattgaatgtcttattgtagtaactcatcttcctccttcctagttatcagttgactaatctatgctccactgctgctggttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctcctggcatgccatttcctttatgaaatgtcttctgttataattagattttttttttttgcatctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttgacagactcaataaatatttattgaattgaactgagatgtgtgtactaaagctcagtctgtagtttgtccaacttgtttgacacattagaaaaaatccatatccaattacaacagtaaatcgtgtaaagttgtcagggagtgttataatgacacgttttctctccctttctatctagggagcagtaatgaatgcaatggaaacaaacctcgttggaagtgacaaatatgctgcaagatttggggaatctatagttaatcttggcgacattgacaatgatggctttgaaggtaattaaaattatcaaattggtacttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctacagctatgttgtggaggatctggggaattcaagaagagattctgagcaggccactgggaggcctggggacagtggctgtttacccactgatattgacgttttttattaattgaatagatggtagtgtggtaactgtgcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaaaatagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaccagcaattctgtgatatttattgaacatttattttgggtcagatgtaccataccaggtacagaatatgtgccataataaatgaaaatgaagaaaatagtggcacccttttttatagctctaccatcaagtagaaaataaaattaatacttgaaaacataagccttatttcgtggcaagtttaagggttctacctaataaagacctatggataaaaccatgtttatgcattttgatttgtcatgtgtgttgtatgagacaacccaattctttcttttaaaaacacaaaatcactgtttagtaaaacacttattttgtctatgatttctctgtcttgttttaattgacacatttaaagaagaccattcactatttttactcttttgaatgtgaaaagtatatgtatgtacacatgagaaattatttttgtggcatcaaaatgtcaatgacaaatttgaattattgttagagctgtaaaactgttgtgagcataggcaaattcccttatcaaaattactctatacctgggaaaagcccaagtaattttccagtggtgtgaaggacagagagtgttcggtcgatgagacttaggaagaggacttcggaggtgactttcaggggacagtgcagtctctcaatttgtatatgagaccctgggcttcacacagctcttgtttcactgaaatccctcagcactccactcctaaaggtaatacctttatgtctggaaggttattatgcaaatgattttttaaaatattcctgcatatttttgtgctatttataatgtcatttataattcaccgcatatttacatttagtggctacattaacacttcagtgagtgtttataatgccatatatctttttctacttggtccagttctttttttattttattttttttttgagatggagtctcgctgtgtcacccaggccagagtgcagtggcatgatctgggctcactgcaagctctgactcccgggttcatgccattctcctgcctcagcctcccgagtagctgggactacaggcacccgccaccaccccagctaatttttttgtgtttttagtagagacagggtttcactgtgttaaccaggatggtctctatctcctgaccttgtgatctgcccgccttggcctccaaaaatgctgggattacaggcatgagccactgcacccagccctccagttctaattttatcttctattttgcccatgagtaggcgttttctatattttagatattagcaagaccattgctgatgtggaaacagggccagtgtgtcctagttcttggctgaggtcttttattccattccaccatgtctgcctgcatgaggcagcaggaatttacaagttatttttctttatgtgtttctttattactttgccccatcttctcttattttatttttctggggtggatgggtaaagatactttgtgttcatggcaagaagtgtaggattatgaagaaagagactccaacattggatgcaaatcacacttaatgtctttttattatgcaaatttttgtggtactttgcatagcaaacctaagttatcttggcatttgtcatatcacttttcaattgttctcaaatggaaaaaaaatcagactctatttcctgtgtccttagaaaagcaacacaagccattttctaaaaagatgaccaattgatttggcaaaaatttagtgtaaaactcatcaaaagcatgaaaaaaattggtcagacagactaatgtacctgacatgaccaacagcagatcacattttttatttcatatgtaaaatagacttgaccactatttatcggtttagtttcttttttcaccttgagccttattatctgacttttagactatatgttgaatatttttagagcagaaccataacaagttctacaattgtaaattacaagctgtactattattttgtgtgcacctgaaatattaatatatcgtcaaatcattaagtgagcacttctgttttatttgtttatagggtacaagtgaaattttgttacatgcatcgattacatagcgatcaagtcagagcttgtgggtatccatcatccaaataacatacatttttacccattaagtaatttctcatcatccaccccacacaacctctttcccttctgagtcttcattgtctatcaaaatgtagcaggacgagccacagacaaaactcttcggacgccgagttaaagaaggaaggggtttatttggtggggggcatcggcaagactcctgtctcaagagccgagctccccaagtgagcaattctgtcccttttaagggctcacaactctaagggggtgcacgtgagagggtcgtgattgattgagcaagcagggggtacgtgactgggggctgcatgcaccggtaattagatcggaacaaaacaggatagggattttcacagtgcttttctatacaatgtctgtaatctatagataacataaccgattaggtcggggtcgatctataactaccaggcccaggatgtggggccaggctgtctgcttgtggatttcatttctgccttttagtttttactttttctttctttggaggcagaaattgggcataagtcaatatgaggggtggtctcctcctctaattctactttatacatccatgtgaacacatttttaaagcactgatttatgagtaagagcatgtgttattttactttctgtgcctggcttgtttcatttaagataatgacatcccccaccagttccatccctgttgctgcagaatacatgatttcatttttttttttatggctgaatagtattcgtgtgtgtgtgtgtgtgtgtgtgtgtgtgtgtgtgtctgtgtgtgtgagagagaacctctttgacacagaacaggaattggtattaggaagggaaatttgggggtatgacctctgttgttaatgagtctatagagcatgggaatagcacaggatctggaccaggctgcagggtttaaatcccaggtccacaacatcctggctctgtcaccttgagcaggttataccttgtgcctcagtttcctcatctgtaaagttggagtcagagtatttatttaatatggtggttgtgagagttacttgggtaaatctgcacaaagtccatatcacagtgcctacattgtaaacatagtataagtgttggctgacatactaataattttgatttatactaaaagaatgaaataaaatgttcagataagaagtaaaagcaatcattaaatacctatgttctgtatattgtgtcccaaattaagttgcataggcttggaaaacatttattgtatatatttcaaaacatatctttctcatttgaataatgatagctagaactttattatataacagatccaagcgtaatccaggaagagtctgaatctatatatgtgatagccagagattgaatatacccaagtgtcctctgtatggaaaaaaatttatctgggcctttttaatattttggctgaaaaggctcatctgtatttttcctaaatatttgccttaatctagatcactcttgctaataacaggtactgtaagaattacatcgccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacaagggaggctgaggcaggagaatggcgtgaacccgggaggcggagcttgcagtgagtcgagatcgcgccactgcactccagcctgggcgacagagctaaactccgtctcaaaaaaaaaaaaaaaaaaaaaaaaaagaattacatcaaccacttcactaccaaggcttgttatttttttcatgtgttatgaagaatcaatatataggaaattctagagatgtaaccacagtggtggaagtataaacccagccctgattaaaataaattgctgtcttcccttcaatggctataaaatacttttccccactccttcttctcacatccctcttctcctcctcctcctctttctcttccttaccattcctgctcctctgttcctgtatgtatatattctgcacaaatctgactccagttattccaaaccaattgccattcttcacatgtgccatgctgcctattgcttccctgcccttgcacaggcatttccctgcctctaaattgcatttccccttttcttcacctgtctatgacctatggatactttaatctcatcttgggcatcattttctatgagaagccttttctaatttccaccacttcctcctcatatgctgtgttattagtctattcttacttgccattcctccccactagacaatgagtttcctattgtgatactgccctgttttgccagctcctggcaattgcctggaatatagtaggtgctcactagctgtccgatgaatgaataaatgagtgggcatatttgtatatgaaagtttgaaaaactttgtacaagtcaaaagaggctagcctttgtatgtctaaacaaagtaaatataggtgtctaccatttctttttaactgaaaatagaaaagcttttgcatttttaaaattttacattgtttagcatggagttatatatcaaagatatttttatcctcattgaaatagtagccaaaaattaccactatagttgataaaatgattttcaatttgatggtaataagtaatatcatgaagacaaactactttaggtttctattaaataaaccattgcatataagtaaatatatgcataaatagacaatacttggtaaaataatgaaatgctcttgcaactgtagaatattatttttctcctttgtgctatatatttatagcatttaagcaaccatgtcatttactcaggttttcttatattagttgatcagatcttttttcccttggtatcatagtctgacataattatcaataatacagaaaggtgatataatcattattttacagaacaaatcctttttctgaaatcctgtgtgtctgtgtgtgcagatatctctaacagataccttaatcattttcattggaataggaattaaaagtcattttgcaaataaggtaagtctagactcccaaaataaaaattcttatgatcaaatattcatagattatgaggttattacatgcgaggcactgctctaagcactttacataggtcatatccttttatgctgagagtggtttttattatgatcccattatataggtgagggaattgaaacacagattaagaaatgggcccagcctagtgtggcagtgcccagtggcagagctcggatcagaccccagtggtctggctgtagagcccgcgctctaatcattttgttacactgcctctcagatgcttccactctgctttcttccatgtgcaaactattgtgtgcaatcctgtatatgatgatgatagtattttatttttttctgtctgagaagactgttatttttcataaaagagagttttcttatgtgatatgaattaaggttcataaggttagttttcgaagttgcattctttgtatcaagaatttatttttccattgtttaaattattggatagatgttgctatcggagctccacaagaagatgacttgcaaggtgctatttatatttacaatggccgtgcagatgggatctcgtcaaccttctcacaggtaaggtactattctatttccaaaagaagcattggttataatgcatatccttaaaacttccagggtttatgtggacttatttttcttaattttctcattcaaatacttaacactttatttcaccgtttacttatagtggcaaatgatcttattttaagggattaataactcttcaaactccctttctccataaataagagttgtagttcatttccaccctagcttgtctatagcccattaaagatttctctttgtatttcattaaattgcattctgaggtaatatccatatgattctaaaatatgcccatttggatttgattaactgtgtcttggccttgtggctagagccccatattttgtgaagattgcacagggagatcaaacacacatatgattctctgggtttttttcactgttgagtagtaagatgatagcactttaataatgtctcaggatcttactctgacttcacttttgtatgttgaaaaatcatggcatttcagtgcctagaaaaaaaatgacattcatatgcagagaagaaaagtttttcccttgatatttgcatggaaatattagctggcacagttatttttgattagaaaaatgagcaaatggttctctgtaattgacataaaagaaatgtatttgtctagtaaaaaaactaattttcttagcacgaatatcagcttaatatttataaacctgtatgtgaacatgaaattagatatgtggactagaaagtacatatctggctagggttgttcttgttaaaaagtcagcttttatcaaaagcctcagtcataggctccactaagtgattatagacatcttgttttacaaattcttatttagttattcatgttgggcaaggaagtaaatagagagcctgaagagacctaaggaggccagacatggtggtacacacctgtaatctcagctactcaggaggctgagctgggaagactgcttgaacccaggagttcaaggccagcccaggtgccatagtgagacccccatctctaaaagacttgagagggagtaaagactatttcagaaaatctgtacagcataattttccctttgctcgcaaagtaaatttttttagtcacaaatgtcacctgttcatttcaagctggaaaaattttgtcacccttagaagtatttgatttaactaaaatgcagctttgttagtagatgtgccaaggcatgcctgggaaagctcattatttagctaaatcattgcttctctggtatattagtattcaaaaactacttcccactcaactttcctatttttcagagaattgaaggacttcagatcagcaaatcgttaagtatgtttggacagtctatatcaggacaaattgatgcagataataatggctatgtaggtgagtaattagtttatcataatttataaattggaataagctctatcatagatactgctttatagtgaagtacataaaactggtatgaaagacttcatcttactgataattttttttcttcatttttaaagttctccttaattcattcctaaaatgatcaagtaattcctcagcttaacagtgctagttacacaatgttatagtctgtgtttttgaaaacatgaaagcactcatgaaaatcaaatatatgaggaaaagaaagaaaatttttatttagaaaaatttgagtgaatgtttctagtccaaaaattgaattttgttttagtaaacttgtttttgtcataaagtttatgatatatcataatgggatgaatgttgtacatgaatagattcagagaaaagtggaaagaatcgtaagatgttagcatatattctctaattttctataaatagtgttttaggtagtcaaaggtgatacgtagttaagtatttatggctgaaaaataattctctttgactaatgatgatcattaatctgtgttgttttttatcctccagatgtagcagttggtgcttttcggtctgattctgctgtcttgctaaggtaagactgatatatttcactgcttaattgcaatttggtttaattgtaaaatgatgggaggtggtgtttaaaatcagcagtggtagtgacctcatgatgctcttttggtattctgaagcttaattattgatttttagggtatttttttcaccttacagagatataattaaatcatcaaagtcaatatttttagacatttaaataaaaagttattttgccctgtgcacagaaatgtaattagtatgtacacacataataagactcatgaaattacttggtgaatgtaaactgaaaaaacaaacgcatttctctccttaaggaaaaataattctgcaattaacattgctacttttatttccttctcaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattggtgggtatgccctacaatattaatgcttgatggggtgcggttcattcattaatcccacaatcctgcttggagccctcaccggttttcaccacggagatcttctttagagcgggggagagaagctacctgatgcatgcttttcctctccatcttccagattcttgcgttgttctaaccaatgagttgggcacattagaaggctgtagttgtttagagattatgagaagcaaaggacatagtatcacttgctatattagtttaaggtaaaccaactgagcttaacctgtgaaatctctttcttcttgacattggataaaattgacattttatcaagtgtcaataattgaggaaagccaggcatggtagctcatgtctataatcccagcacttgaggaggctgaggcttcagcccaggaggtccaggctacagcaagctgtcatcacaccactgcattccagcccgggcaatggaatgagaccctgtctcaaaaaaataataaccataaaaataaatattaaaaaaattgaagaagctagacttgattctgatttctataaataatatgcttgttaataatttactgcgactacaagctcctaagaaccgtcacctatgtccctctgtataggcaactctcaattatctgctctggagaaagtatcattgatatagctcatccaaaatattgtggtggggaatcccaaatcatgtatatatgactttataagtatttttgctagcagattaatgttcctaattatgttttatttaggctaatataagaataactactagtgaaatgagcctgtggtaggagaagagcatatctgggcatatcatttagagattaataattcacaacgtttatgatcccctattaggacctgtcaagagtttattgtattcatgaccctgcaggctgctgttatctaaacatcgtgaagggcccacatacttattaaataatgccatggatatgtaatagaggtcttagtatgcattaggtacacaatgagcctgtacctgaaaggtacacaatgagcctggcatctctactttagatcagactcatttttaatagtgtcctggaaaagtcatggccagagctacagtaataagagggtggacaagccttcatctagttattgattggaaaatggcaatttgagagcctgaccacagagtaaattacacagtaacacagacaagctgaaggataatctgaaagacacacattgagtagatgacgctctttccttttacataaaactagtgtttcctctactaacaattccattgtgaccagatatttttaaaaatagttgaagacaaacatacgaaacacataaataatcatcacattattggagaagcataccttataattatcataaaatgactcccaggagaaataattcacatggcaagcatgtttaataaaaccaggacattttaactcttactaatagtggattttttttcacctttttcatttactttttttctgaactcagggcaatgaacttgtagacagctatatcaattgcagtgctatttctctgaggtattgaatctcagttattataattttgaaatccaattggcttggacttcattattttccaactaaaaagatgattgaaggatttatttgaaatgtgtaaagagtaatatagattttatgcttatgtttccttgaaaaaagtaggtaaaattcttctggaagtgttactcctaaaatacaaatgaacatgtcaagaattacataaattctttaaactatcacttatgaattattgcctctatgtagtgagtgacacctcagcagactattagatttagcttgcatggcaaagaactcatttagattcatgaaatggttctcactttcttggtaagatctggcttggacgtttttgttaattttttcttttttccttttttttttctttcaaatttggagatcttcatgagcagatgaatatttactatttcagatttgaaataaaccctgccaaactgctagaatatttattgagagaattttttaaaaattgcacaaattaacactggaaggtcaaactagaaaccaataacacacagaggaaggacagataatcagggcataagactggaaagatgacatttttaagaaaaccgtatatatagatttgacttaatcatgtgttcacttcatgtataaaaaaaagccttcaaatcagaaacaaatctaaaatataaaaaagtcatatataaaattagtcatataaccacataagatagaattattccaagtgacatttgagcaaagtgctgtgtctatacttccttagtcaatgttctgagaaaaaaaggaatatgaaacatgcaagacttttattagcaacaatttttatatttttgaaatttttatataaagattaagcaaataactaaagattttaatgttgttaatagaaacctagaggaaagttcataaatctttataaaagcaatttttaaaatttgtatttttaattgttccctctttcatatttcaggttagtctttaaaaagctgtttaataaagagaattccagatattatttccagtagtccatataactttaactattatcacttcaaaaataacaatagatgtatttcagtaattagattaattgcaattctctatatttttgcagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcgggtaatgtaagctattttttattaatgaatatgtgaacttcaacgttgttgatagagagcaacttattgtattggtatctttttataaaatgtagataaaagcaactgttacccctcctgaactatgacctgttgctccagttaaggtatgagacaatctcaacccaagtaattcagagtcctcttattgtatcatcctttttcacatttatcacatttgacctcatcatttgaaaacacttgccttttcctttctaaaatttcatttctcctatccctctttatctacttgcctagaaatatacatcttcagtagctcaactgagcctcaaatctattccgtggtacgttttttggggtgggtcaggggaggcagggaagttagtttgtttttcatacgactccagcgaagcagaatccaacatgactgcttttgggttatgtctttgtttccgtgccagctttgccagtgatgtcagtgggaactcacacagttgtagcatggtggggatcatctgtgggccaggacgatagctctcatgatggtttggggtatgtcctgccaaagcacagccgatttcatgtttcttttattaaaacactcattcccaaactgatcatcacattcctcacattggtcaaattttatcatatgaagctgtgccaggtctttttcattagggaacggtgtacttcatcagaaaatctattgtcacaaaaaaccaaactattcccaggagccctttctgggatttcaaatagtagcttcagcttagggcttaattttcccttagatacttattccaagcaaatgcaagcaagcatcaagactccaatacgctattaaatgctaagagcaataatccccatgctatttcctcatttcccttaacagtttttattgttgtactagaataaacctattagatggttcagagccaaaagtatagaatattaatgtaaccatcatttatatggtaggaattaaagaggttctttttttcatgcttcatagatgtcgttttacttaccttagtcaattgtagagacaaatattgaaataattttaaaggcaataaaagggccaacattagatgttcacaaagaaatacattgtgttaaatttgtaaaagtgatctggtttatttagtcctgtgtttcttggcatcgttcctgtaaataagggatcatcaaaattgtacagctttttcggagtaaatttgtagcagaaatgattagcagaggtaagtgttgtgttgcatgtatatttgtagtgttaccatggttttgatggtagcaagattcagccattgcctttgtaccatattgcaaatattaaatgatagcacttactgctgggattgtacatggcagggactttttaagaaatgctcgtttccttcagtatctttttctcttcctaagttaccttgcttgtgtttggaacacttttaaaactcgtatatagaaaggcaaaaagttactccaaccctctcctttgtaacaaacccacacagaagataagaaccacagttgcagctaccctgaacttgagttctgtcaaggagctgtagctgttacttaagaaggtataggaatgtaatgattgtactttcccacctccaccagggtaatagcccaaggcattaggaaacattaacactcttaagtttctacagtctgaaagcataagacagcaacctgaattcttccatcttcctagaaaagaagacgcatagcggttgggatgcctgggttgctcctgtgttccataaaacgcatctggtaccatggtaccaggagtgggaatgttaacatatgtatctattttatctctgcattccttacaatgaaatgaagtggcacttgttaattatgtactggggcccacaacccccacttgtcagaggactccctgcctgtctgttggttggacatggtttacttgtgtagatgtccctactggccattcactccattaatttgataggtatttattgagtacccacattgtgtcaaattctgtatataccagtgaataagacataaaaacatcactaccctcatggagcttatagtctactggggtgagaaaaaaataatatgataaaaatatacattttatagtattttggaagatacaggtgataaaggaaaaaggagggcagagtacagaaatgtgcagtgctgcagaaggagtgaagcggagaattttaaataggatactcagagtaggcttcattcagaaagtgacatctgagcaaagacgtgaagaaagtgaggaagttacccatgtagatatctagggcagttgttcttagttttagggtgtaatagcaacaacacctgtagggcttctgaaaacacaaattgctggcccccatctagaatccctgatttagtaggtctgcagtaagggctgagaatgtgcatttctgcaaagttcccagaggacccatactttgagaacagctggttcaggagaagagtattccagcgagaaaagctgagtcaaaaggcctcaagaatgtacctggttattttaaagaacaatggggaggcaaggatggctagaaatgtaagcaaagggaagaatggtggaacaagagattatatagaacctgtggctttttctctgagagaaagggggatctataacagcattttggcagagaagtcacatgatctaacatacgtatacaaaggaacactctagctgctgtgttgtgaatagagtaggagatcaagattcgacacatggagaagaggctactgtggcaacacaggtgagaggatggttccaacaaaagtggtggcagtggatatggtaagaagtagttgaagtcaatttgctgacatccaatttacaatttgctgagagactggatgtctggcatctgagaaagaggctctgtgatgactccagggtctttagcctgagccacttggaaatgtagttttcatcaattgagacaatattgcaggagaacaccttttgagtggaaaattctagagttcagtcgtgggcctgcttagctagagagacctattttaaatgtaaatatcaactaaggctttgtacatactcatcttgagttgaggacaggcagagaacaggaaaggtaacttaatatatctttggcatatggatggtatttaaagccgtattaagatggctgagatcagaagagggccaccgtctgtactctgggccgctacaacatgaagaggttggcaaaaagaggcccacagaggagataagaaggtccaatcagtaagaaaggaagaaaatcaacagtgtggcatcctggaagtgaagtgaaaaaaggggaaagcatgatgatgttttctatactgcagcttgatcaaataagatgagggctgaaaactcaacattggatttataatgcagaggctgttggtggtggtgacaacagcatttcagacattagtgggggaacggggggaaggaaaggaattggaagcgtcataggttattctttcaaaaagttttgccacaaaggtgaccaaagaaatggagctgggggtcagtagctgaactggagtgaagagttttttggggttttgtcttttaagacaggagaagtattagcatgtttttatgctgataggcatgctgcaatagagtgaaaaacttgggatatatgtgacaggggagaagagctggaactaaattcttgaaggcaaaaagggaaggattaaatgtacaagtgaaagggttggttctagataggcatgtgcatgattcatctgagtatgtgcttgcagatgctgggtagatgtggtgatggggactatagaagttcttgtctgattgctttaataatctcagtgaactaagaagcaaactcatcaactggagtagggatggaggaagtggcatttggagtttgggaagatgtgaaatagtcttctaggagaatgggagagtaacaaaatacaggatggttgtcagatggtgtttgggaccacttgcacttattgtcataaactgagtgtagcctgtgtgcttgtgttttttttcccagtcacattcagtcttgcaggagtagatgaagagttacaattaaccagggttgtagtttggtcaagagagtgaagcaagcaaggagcatgcagcgggagggaatgtacaagggaatggttatatttttagttgtgaagttgaagcaggctaaggaggggagggggcacaccaagacggtgagggaccaggaaagaaatttgaattggagatcccaggacaatcagcaaattgttggaattgactattaaacggatcgagctgcaaagatggcatagatattataaaatacaaaagcccttggagacctaaaagtgagggaaagattgaattttgcttttatttttgctgacaatactttgattaccttatgcaaacaaaagcctttaaatttacttacaaaatccattgcgttctttgatggcggggaattcggctgtcaaaaagactccagatcttaagtttaaaaaattattctcttttaatcacaattctttagttttatgctagatcttcttggactagaggtgcatttttaatagtctaataaggatctatatcactggcatgtagatttttgttctggcatgttatttttctgaggctatgttttcatttatctggttagtaggggaatcagttttcttaagtctaatcataattaaaagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagttagaatgatatttctgtaatataaaggaaatggttaatttcatttatatcttttagtgttttatctattgaaatcgtcttctattagacattgctttttcctctatgaaaagatgtttccccatttatgtaagtatatgaaaaatctttgtttttgctttatttaaatatacaacttcatcaaattgtggagatttcttaggacaagggataattttgaagcagttttgatttagggaaacccaaactgtaacttgaagcagtttttagacatgttagagcagccatggtagtgaaacttcccttgaaattttgacagatgatatctcttggttgaacttgatggatccctgcatcaaaatatccactgatatttgagaggagaagaagggtgctacattgggataacaaaagaagcaatgagatttcctgtttgtctgcatttccaacaaagctagaaatactggcttagttgctgaacaaagaatgcctgtccccagagatattctgagagccagtgaattcagtggccttcgcatgttttattaaaatcatgacatcaatctacctgggtagattagttaattcttttctttgatttctcaaatttctgaattttagatttctgaaatgtgggtttattttgttatgtaaatctttaggtgacttctaaaactcatcttttttccatagtagtttcaggaaaacgtgtatttgattagtaaatacatttttttgtaattttttatttcatttgcttatattattgagcaatacatgcacatagtttaatgaaatgtcatttactccaaagaagaaattttttaacaatagcacactatggactgattcatatatgcagacatttctgtggaaaatctaagtgtgagcaaactatatcactgtactaatattatggtattctaaaagtgaattgattattataacatgtgaattcttcattagattgcaagatctttgaggcaggatattatcttttgcatatttatattcttagagctagcacaatccattacataaggcagaaacaataaatatttaacaaatttatggatgctatgttcttggtgctatttaaaaaattctataagaaaaatctgagaatgttctattggtataatggttagggcatttgtcttaggggtgctgtcttttctcaggaaattgtaatgctagatgtctgactgttctgtaccacttgagccaagcttactagataaagggactgcaattatacaagatggtgatggttcaggtaccaacctgtgtcttggtctcagcttttccttcccgagccctgcattagcaccagagaggtgtttccaaaatctagtcatattccttgcttaaaatcttcctatgtaagagcctccccagccccttttatgtgtagattaggtggccctacttcttctgtatttagacatgcctctgtcagaatattcatgccccacactgtctatgtggatttgtggaacatagatggtgacaggtactgactttcagttttgtatccctagagctgccttggacacagtaggcccatgaatagatatcttcaaatatttattcctgacattattttttatttagtgatatcttataaatttttttgccccaccaagttaacaggaggacatgggcctgttgctcagctctcaagttggccagaaatacagatttccatgaaagtcaagcaagaagacagacgttatgtaatttcaggcatgtgctaatttgcatgcttgtgggcaccctattttatgtaattgtccataaaaatgtggcatggaatcttcattatttttaatatagatagcacatgcccatccaaattttaaaatgtaaacaaatctacttttttactcccaaatatttaattaatcacttcaagacatttttgatattacagcttttgtccttaggtggagctgttaaagttaaataagtgtgaatatctgtcaaatacagtttttgcaagagtgcatgtacattttatatattgtaagaaaagcgtaattaatagctaattaggataatgaaagtaatatacaacagatgtagagaagaccttgtggaaaattagtatgaattagatagcatgtgatttggtcaaagtaagcttgttgagaagaattaaaacagtggacatgtggagggacaatcagtggctgtctagctcctcctacacctagggaatgatttaatcaagtttgctattacttgaatactcagggcttcaagctgttccgttttcacaagtcgataacttgggatttggccttgatttgcagcattcctatacggtcaaagtttcatgttgagatgatcacttaccaagtaatttaatataagaatctctgtataagaatggaaaagtaatcagggatcttgagtactctcaggctccaaatcttctaaataccgtttaataaatagagctctattccttgttctataactaattttctatttaatgttgatggttggcagtagtagttcagttttcttattccttccaaatgttcaccagaatctcctattctaggaaactgaaatttagtaatttcttagttggcttatatacctgaaatttgaagcaacatacaaatcttgtcaggtctgctttatggacattatgtcatttaatcatcacaacagtaaggtataagtataaccaccataattgttattattcctattttcagatagcacaactaagccatagacaaattaagaaacttgtccaatgttatgtagataataagtggtggaccccagatttgaacaccagttcttcaccttcagatcactattgcttttaaccactatatacataaattgataatgttgtaaatgaaaagagaaaaaagattacatcctttttgtttataattacataaagacatagaatagatatagtcttttatgtggtgtgtgtcatctttattaaattacttcgttgatttttatcaaaagttactatataaataatatagcaacacagcaataatttgtgtgatagggatttattccctatttcttaaggattattaattgatgagctttgaaaataatctattccttatctgctttggggcagtaatgtttaagccatattgcaatcctgaaatgtctatagataaatagaaacctggtccactgacattacttagtaggaggtctgtcaattgcagtgtcatgggtctaccttgaggaactcatctagcataatataaaccttaattatggttgaagctaatatgtctagcctgggtgaaaatactagactctttaatggtcaagagggaatttgttgaatctattttttaagatgagaagaacttatagattgaaacagccatatgaaaagtagagtcaaaaactgagccttaaattattagtatgaaagacatcacagtctgtgaccaattcatcaaattatctcctgcgtatagcaacaattctaataccaagaaaaacaaaaactgcatagattttctccacttgtttccgtgtaggtgggctatatgtggtgatgtgaactgctctctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataagcagaagtctgttttgttgagtaccctttgaaaatcacatttctgtctgcgtagtgcttgaacaggtgctttctaagagacactgtgttttatatgctacctgattttcatatacatttgccctgcagtaaccctgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaaatctgtacatgttcagcactgatgcaaccatccattatttgccaactatttttgatccaaggtggctgaacccacagatgtggaaccgatgggtacagagggctgactctctttgttttcatagacttgagagtctaggacacttttactatctagtgaagtgcttacttaatcgaatgacaaatgctttcaaagatttttttttgtttatttcactgtgtgtaagcaaataattttgaaaataatgtggaatttttttaatgaggatagcaagtaatcaaatgaaaagaaaatcatttgtaagttgatagaaaatatttttaaaagaaaataatgtctgcatatagaaataaaggttaaaatgtaagaattgtcaatcagttgtaataaactcgagctgtttctttggagacagaagacaatgaattttaaaaatctgattattgaaaaaaaaaacttgtgaccacatatcaacaagaataggagtaagaaatgctgtgtagacataagatattaagtttaaatgaatgttatacagagcagaatggattgtgaatgggttacaatttctgtgtaactggtaaataaattcaagagttctttgtgaagtataaaagcacaataaacttagaaaaaacaaaaacggctgggcgcggtggttcaagcctgtaatcccagcactttgggaggccgagtggggtggatcacttgaggtcaggaatttgagaccagccctaccaacatggtgaaacctggtctttactaaaaatacaaaaattagctggatgtggttgtgcatgcctgtaattccagctactcgggagactgaagtgggaggatcacttgaacccaggagagagagattgtagtgagctgaaatcacgccactgccctcaagcctgggtgacagagcaagactgactcaaaaacgaaaaataaataaataaataaataaaaactttaacaactaataagaaaatcagtgaagcgaccagtgtatacaattagatgtacaaaacaaatacttttcctatataccattcagtatctgttagaaaagataatagaaaagttccataaagaaagaaaagggctgggtatggtggctcacacctgtaatcccagctctttgggaggccaaaactggaggagcccttgagcccaggagttcaagactagtctgggaaacattgaaagaccctgtctctataaatatgaaaaaatgggctgggcatggtggtacacatctgtagtcctagctactctgaaggctgaagcagaaggatcgcttgagcccaggagttcagaactgtggtgagctacacttcactccagtctgctgacagagggacacatcccatctcttaaaaaaaaaaaaaaaaaaaaaaaaaaaaaaaaaaaaaaaaaaaaaaactaaaaaggatgttttataataaatctggagtcaaatgaatcaaattcaatcaaaatgttgttgagagatataaagagaaaatgtatagggtaaagttaaatgggataaaaagcaccttgaaatgatttacagaaagtttatcatgaaaaatgcttatgttataatatcaagttatcttttaaatgcgtagaaaatagcatggaagaaaatactcccaagtacagacctttataactattattggatagtattatttttcatttttattttttttgtgtttttcataagaaacgtaaatgattttgtgtgatatgaaaaaatatacatcttcatttttttaacggtttagataaaagataagtatttgctttgtcttccatgtatagtgtttggcccttttcaggaaaggagttttatttttttttaatctacgtgcttgtttttgttaattcatatggtggttattttccttagaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacggtaggaatattttcctttattcaaattattgtatggcatttaactaaatttttaaaatatggcataattctgaagaagtgaactatatgtcggaatttttaaaaatacgaatttttaaaaacaaaaatagatttattcatttctttaaattgtttatattccctttaggatattgaactgaatattttaaaatatgcatttaatcacaacagtagattctcatataaaatgctgatgttctatttttaatgccttgccagtgaagaaagatatattactagagagaaatcataatgggagaagattgtatttacaagttagttattcagtgtcatcatgtgtcctcagtttatcttcctcttctcattttctcccttgctttcatcctactcacagattcactcatgtcttcataatcaaattttcttgcttagttttacccatttacagacacatgtatttatgttatacaataatttctttttaaaaatttcattatatgcttttcagccacatcccaggatcaattgcatttgagatggatcctacattctaaccagtgaaccgttttctaaattatctcaaaatatttaagtttcactgacagtgtatttattctcaggagtcctgttgttcagacctttagtgtctatcaacacaaagacatagtgtttgtccaaaaacaggatgtgtctgggcatagtaaaaagccttcattaaaatgttcactaatgacacacagaatgtaaaagatgaaagggacatttaaaggtctagttcacatcctgtccagacaaaattgccccatagtcactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctcaatattgcaagtacacaagccaaaaccttagcaattggtagttatattaatttatattttgattcttagaacaacctgctttaccaatagaaatggcagaaaaaaaaatcatatttatttagagagatatttacacctctcccccagctgtaggcacgctatttgacagtactctagtcacttcacacttaatgagcctggctccttctgactttctagatctctctttgttttctgcatctgtctctctctacctgttcccgttaccttcccttttatctctccccattttttccttttgcccagcttatgccttgggtcttcctaggtcctttgtagtatttattgatcttattaaaaagcttcaagttaattaaattctgaaacccttatttaattttgttcaatatttactctaagtaaaatttctaagtatctccatgtagctaatttcaatgaatataaaatcactgtcccaacatctgtcacaattaagtgccatacttacacgtaataaatgggatcaaactgcagcaacagaaaattgagaggaacccaatgaaaaacatcttggcagctaataaactcctttaatgcctttcatttaactttttttccaaatcttatttcacttagaaaatttgggctttaaattttacctatttagaacttagctcttttagccctgcaagtaattgtcatttgaaccctactaattctcaaattgaactttttaaaagagataaaataaagagttgtcaatttgatgtatcaattttatttttctcatgcatcacaggtgtcgtcatctttaaaatatatataaatatacttgctgattaaatcaaaataaaaaacgttgtctttttatttccagataaactttgcaaggttttgtgcccatgaaaattgttctgctgatttacaggtttctgcaaagattgggtttttgaagtaagtatatgtggtatatagtctctgttattcatcgagagggtgtaatgagtgtgtgcatttgcattcccaaaagaaaaggaacaagagctaacccttgaaaattaacagcgtttaaagaattagcaacacaatgcttagttttttatcggccagaaaactggttatatcactcagactgatatataatccaagtatgacaaatttaaaaaggaataaactatcttgctcttctaaattcatagaaggggaaacagagtaaaaaggaaatagatatgtgttttagaatagcatctaacacatagcaaagactggataaatgttggttgctgtcgttattttataatggcaaataaaccactgcaattttgtatcatatctggatcccctatattcaaatcattttgcatatcaaaaagatgatgtgaaaacaaggaccagagagagagaatgaacacttcaggttgaggattgatcatagaaggcaagtgaaagaagggaagaagatgcatcagtgacggggcagggaaacagggaactatttttgggagattgggatataaatggagcagctttaatctggggcatgttgaatttggagggacttttctatgtggcattccacttgaaaatctagttcaggattatgtttggaagttcctccatatattagtgacttgtgagatggcccaagggatagaaatgtgaatttcacagaggaaaaaaattacagatcaaatcttggaggacagttttattcaaggagattaaaaagaatggggagtccctgtaggagactgagaaggcatcttcaaggaattaaagagaaccaagtccctggtgaaatagccaatggagaatataaaaagggagacttaatattgtaaaatttataaaaagatcagatagcgtaatgtctaaaggtcatggaagttggcatttattaataaaatgtgacgggtggtgaaaaaatgggtatcactggcaaatgttaagatagaactctcagtgcagaagtagccaaatgacaggattagtgattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttttcagtccatacttgaattccactctgaagcatttcactgttcacttcctcttttgaacgtcttatcctttaattttcatgatactatcctactcccattgtcttagtagttatttagccctttcttttcagctgtttttgatggatctttgggtttggcaccctaaatggtcctccctcagccctttctctcactaccacattcaaccttggtagtcttgctcataactgcaatttcaactggcatgcctacactgctgatgcctaaaccagtgtctcttgagtttcacacccacctacatatcaaattccctattagacatgtccttttggttgccctatagtttcaatctgtccaggcactatccaggaatgacatggacattagaaagttaccaaagccagaaacctagggctcaatctgcattcttttctctttcttatttctgatatccagaattattaagtactacaatactaccacctagatgtctttcttatccatcatgctttgctatctctaccactattactccaaactaggcactcactatcctacctaggtcactaagttctcctgctttctaggatactggcctttgattttgcattattaacatacacatgtgataacagtgcttcagtggctcattttagacttaaaatctaaactcctgggtggtatttttcaccaattccccaggaagtttttcatcaatggctgaatacttatggtggtttggctgtgccatgctctcctgaacctctgtatcttctcacttcttctgcccatctacctgattaacttttatttatcttttaaatctcacctgtttcctaggggaagccccctggtcttcagctacttaaacttaagttctgttgtgcccttggtcctatggccctgtgctcacgattattgagagtctgtctccacactgtcctggaagctgctgcaaagcagggtcctgtcatttttgtgttcccaatgcctaacagtgcctggagtgctgcaggtgactggagaggtttgctgagaatggaacaagatcccaaaagggatcagattcataggtagaggaattagccttagttaagaatctccttatcttgagctaacaagctatgaaaatatgtttgacattaagaaatttcaatgtggaaggaagggaaatacagagaactcatggatggctaggataaaaagcaagtttatatgtggtaattgaaggcattgaggatatgtttgggaactgaaaggaatggaaaaaattcaaaatagattaaggacagggagtcaactaggaataagtaaaaaggttgacaaatagagttgagtaccctactgtggtaggatcacatatggctgagaatcaattattttcacttaggcaatgtcagtttagccttgagagtccatagttcagggccaaaaagccttgacctatttgattgatgattggattttatacttaagttacccagattaactgtaatccagaaacagagactacggactactttgtatcccagcatgtagggcagtgcctttattgatttcttagttgaataacttataatcttcccatttctgtatttattttcttcctaaaccgcttaattatcttggtgtttttaccctcatgggcctttgataagaagacgagctgtgtgggggaaatcttttctaagctgcaagtaaaggagtgttttcattttcttaaatcagacacttgtgctatcacctttcattgcagtctctctggcctatgagaaaatgagacattgacatttataagaaaatattactaactatgcttctttcctgaataatgaaaatgcatcttaatgaattatttttctttgttacatgttttctcacaacaaaatatctgctttgcatttttaatttagagtgataatatttcttgcagcctatcaaacccattatgatttttaaatggcataatgattttaaatgaagtataaggctgtgtttcttaaggtgttgtctctgagccacctttatgagaatcacctggatgcttgaaagaaatgcagattcctaggccccagaccatccacgtcagaactaaaggggaccaggccacagatcttcacaattaatagagctccaagttcttatcacactgaaacctaagaaccaatgttatggtggtgaagagcttccagatttgaagtcaaactgacctggttcaaatcccatatctactgtattactagtgaccttttcagagaagacttttaacttctctagacctctttcctcattgctaagtgggtaaaaatagtaccgactcattaaggttgtcttaaagggtaataatgcaggccaagtgcctagtgcaaagcctgatttccatgaagactcaataaaagtcattactatttctatttttgaaatattatggttggaatttctatagataagcttttttagtttggccataaaatgaaacattgccaattctatatataattctgcatataagctttatatcctgaaaatatagctgctgtgactggctcagtagttgcagtcttacaaggtttgaagtggcatgaatgtccatataaagtagtaggcgccatattttttgtatcaactaagaaagttacaggctatgtatttctattagataaatgattatttgaggaactttcaaatgagagcccttctaattaatttcttagactcacagtgaaaggttctgacaaagtgctttgtgttttggtaaattatactctatcagacagaaatatgtctctcccacagaggtgtcctctctcctttctcagaaacagtaggcgaattgtgaccatatgttccatacattctcccagctataactctgctggcactaatggtatttatgtgccccagagctataaacctgttttaggtaaatgtatttactcagtaaagaacatgagtttctgaagactgcaataataaactgtcaacagtatgctaaacagtgcttatccactctctctcatctcttcattaagttgaggcttcctcctgtatgtctaaatgcttaggacaataaactgcatttataaaggacttgcagtgcaaaataaagatgaaccaacacgacttcaagattacaaatataatagaaggtattagccatcacatagggagtttaaaatcaaatccttgaaactcatgtaaatgataccgcaatacatttctgcacctcagttgtgcttccagaatgagtgatgtaagctttccctgaacaattgcttctgtatctgctaggaatacttttaattgcaagttttagagtaattaactaatagtgacttgaacaataaagatattatttcgcataataagcagtcttgaggaaggatgttcacaggtttggtgaacagctaccaaagactagacattgatggttatctttccagctctctcagcttttcctcatgatcacagtatagccaagcagcatcaagcttccaagcaagagaaaagggaaaagagcaaaagtgcttggtcatctttaagttgcccttccaggaagggcagtgcctcatttgatgtattctgattaaccagatgtgtgttacctgtttatccctgattctgttatggttgaaggagaatggagtcgtcatgatcacagtaaatggatcctgaatcaattattttgttattgtgatacattctctggagttgaacctagaggtctgtcttctgaaatattaagggaatgctgcctgtcacctgaataatctagggctctgttggcagctaagaagggaaatcactgttggctagacaatgagcaaggagcaacatttgccaccatgctgttaattcccgaaagagctagtgtgatgaaattgtccatttttaaaatggaaatagtacgaatatttgcctcactgacagcataaagttttgggagaatgaattatatgctttataaactaagacatgctaattactggttcaatcttccaatttaagtttttctgctgttcttcccttaacctcagtgagtttgcctgtctttaataaaatcttcctaaatgtcaggtaacctgtctattccaacaggcaagaatttttcagtattgtctttttccctgaagtcagtagtaaaggaaaaaaagataaaaattgtacttaggcctgtagactacttgctgcaggttactcttttgtcaaataaatgagtcatgtatcttgacatagtgaagtatggtatcagtttacgttatattttattctagcatcttgattaaaaacaagttagctatcaagccctaattcattttagggagacagggtgaattcattatactaagacttggggagcatttcttgcaaaataaagctatattattcactcagaaaaaaacatagagcctggtgctgtggtacatcatttttctatttttcctctgtcacttattaagttatgattctgtatgtacacagtaccttgatttgtttaagttacatggattctgtgctgctttgtaaatttcaagtctgcattatgcatgttttaatgaagaatgaactatgagtcccagggacagctctggttcagtcttgtcgcacttccagatgtgcacctggttctttattatgtctcacataggaagctggtaggtatctttctgagagcatcttgttaatgaatcaatttacagtaagatgtatatttaggggaaagaaagtagaattgtaattatggtaatggggcaaaacagcttaaaaatggaaaataaaccaggagtctagctgctgaaatgtgaacattgtgtttctctttaatttgctgttgtcttggaacctagctgtttatgcagtgctttcaccttctgttgcttgtctaagtgccaacttctttcccaaaggtgttcagtgactaatgctttggttacaagccagaatattttataaatgtctatttctgggcagctcttctacaagtcttaattaaactttaatgtcaagctgaagtttacttttagaacctcttaggttgctttagtcctaacatgattatagagtttggggtgggggggcaggatgtgggacagccatgttcccacacacttcctctctcccatttaacagtgccaccaagcagattcatactacttaaccccaaggtttacaacacaggcacgagtaaatcacagccattccctaaaatgttgtggtagcacactgtcactcagactcctccaccctgcagtgatacccagggtttggaattactgctttgttagttattacacattcttccagcatatccaactgctcaaatcagggatcccaatgtagagatgatgcatgtggaagtagcattctttcctttcttctccatgtctggaggagttatgaggactgggggatcattttctctaattctcatatggcttattggggtaaagaactgcatcctatgccatctgaaataatgaagcttctattatagtcagaatagtacaaaatagatttcaattaaatatggtaatatgttatatgtttattttgtaattaatttactcatcaattggattgctctgtagcaagagcctgcatttttttctgtgaagggacagatagtacatatttgagtttttgtgggacagagatctctgtcccaactactcaactctgtcactgcagtgcaaaagcatgtctgtgttctcatagagctttatttactaaagtaggcagacatgtgaatttggccttcagggagtagtttacagacctctactctatgatatgcttgctttttatatggaaattctaaagtatatatatttttattaattaaaaatagtgcctgatagtatattttgttttttaaacatagtttgtcaatataacttaggctggttgtgaaagtaagccaagattcaaagatttttaagaaattaatcctcagttaaaaaattataagaatctctcctagatagaaacaaagatagatataaatatgtatctagcctacagaattacgtgtgtatgttgaccaaaaaactataatagttccaaaaatggaaattgtcaaaagtcccatggataattgaaaggataaataagatgtggcatattcataaaatggactatatacaccaatgataagaaacattttacaactacatgtaccaatatgttaatctcacaaacaaaattttgaataaaagccatgcaaaagaacagatactcaaagattacattacatttatataaaatacaaaaccgaacaaaaccaagttatattattaaaaatcaaggagggtgaggacaataactggaagaaaaagccccagagggtttttcagtggtgctgctaatatttatttccttgagctaggtgcttaacgcatgtattcataaaaaatattgagctgtacaatcaggatatgtgcatttttctatgcatgtattatactctgataagtttaaaatagaaaaaaagaggaagaattttctagcattaagtgaagtgtccattttcttagaagttacattagagttataaaagtggggggaaatatccaaaattattttatttgcatattccgaggttcataagaataactctgaaaaaccgtaccacatttccagtttggattttgccatggtcatatgatgccattaattcataggtcatttcagtaggtttatcaccaccaaaacattaggttgtctggatgggggtacagatcgcaatgtggtaatgctagatatttactttcttagtgagacatttggaatttgtatagcatcacagaacagataaacacggtttaaggctataacgtgacagtatttatgctgatactttcatagacttctaacagtcaataacttatccaataatttccccaatttttttctgacatgttgcttggacaccaccgaacccttctttacatttaatacagacatgtacttacctgcttatattttttgaagactgtgttgttaggctctgagaaagcatgtgaatcacgatccagcatcttctccccaaggcaaattagtctagtagtgagaggaaccagagacttgacattgtgaaaatactgcatttttatagaggtgccccgtgtgctttgagagagggagaagctgccaccttacgctgttaggggagagcaatgcagggtgaaggtggttaacagtgagttttggctggaagaacaactgagaattattgacgtccaagataaatcttgaagaataagtacacgtcagatgcatgaagaggagatgttgacatcagagtgctagtttgaaggaagacgcaaaacatcctggtgtattagatgcctgtttatagaaaaatatgactgaaacaatgaattgtgcagtgaaagtgaagcaggggccaactctggagggcctctgtgtcatgctaaggagttggaactcttatcttgaaggcaatgtatggttctcaacagacaccattatctagtttgctttcttgaaaatgaccctctggcagtgtgaagactggattaaaggagaggagaaggacttgagacagataaatcaattagaaactcaatccaagtgaatttaggttcaatcatgacattttcagacttaaaatttcttgaggcagccaatttaaccatagtagtagagaaagaacaagtatcatgtctttactacctcaggcaaaaagtggtttcccagagccctctattcacaacacttgcccgtttgtgtatcttttttacatttatttacacatctgtcctttattatatcagctctaggaaggagtgaagtgtgttggtatttgggaacgatgaacttagtgcctgatttattgtacagaaactttcaattcattcatgaatcttcaagtaataattaaaagcagaaattttgaaacatgttcttaaactctgtccttacatactctgtctttaatcaattcacaaaaacaactaaattcctactgtatctttagtatttccataaatagtttattcaaacactaatcttctctacaaatgttgatttgaatgacacaatttaaacattattgaagaaactttctaaattctgcagtgctaggtggatatttatcttttttatctatcctcacctgatattttgctttgggtaaatgcttctctacttttaactaatttttctgaatgttaaattactagatatctaagaacttctgttcttaggggaaagtttataaaatgacatactgtattggaaagttttccttagcatatagctgttctaaccctctcactgggaaaaagaatgaactgtagaaatttgcaattgtttcaagacttcagaacattctagctgtggcctttgaataagttccttatgtctcaaatacttcatatttaaaatattttaaggactttatacagtatacataacccagatcttcagtgaatggtaggtagtatggaataggatgactgaggcttaaaaatgctaaattacttccccaccagaaagaactgctggcagtgccaggacttgaactcgtgcatatatatggatttacagcaatctatactttgcaatacacaggaggatgaagcatttctccagttctgtttttaaatttggcctagttactggtggaggtgaccagctgcttcacaatttaattctagtccaacagattttagtgccacgcacttgtgggtggacatagtagttcttcctcatgccttgctcacttctaccaagtattccttctagtcttcttttctaccagttccttccattttcctccctcggttcaggcagcagctagttcaatgtctattttaggcttgcaagaaagaaaagaaaaactgctttgcctttagaaaatgttacgaaataatcaggaaaatgttaaaattatagaagcaagaggttatgcagaaaagaaatgagaaaagatacgagtttaattatagctcattaaagtttccttgggtaataggtgactgaatttataaaaaacatgacaaagagttcttcttaatatggttttacatctgcttgcatagggtcaatcccatgattgtttttccaagaaaattagtattttatgttcagcataaattatatacatatatccttgtatgcatataagagagagggatttttatttcctaaacaagaactaaataatattacttaatttttaggccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggtaagtactgtaaaccacaatagcatgatactacttggtattttacttaattttttaaaagtaagtggtagaattcacttcactgatttggggtataagtcttaatatttaggctcctagttattttcagacttactctgtgcccctgctcagaatggcaagttcttgggtcttaagtccaaaggcatcagcctcctgttttccagtactaggagtaggaggaagctgtttgggtgcctttacattctcactgccgtagccagcacacgtctgatgttggaacagtatccccttgattgtggtccttgcacaagtaacattgatcctccatcctggactccagagttatagttctttattttaaggtgacactcagacaattaatagaattttctctattctttatcaaattcgctcatcttttgtccagggaccacaccttcataccaatagtgacctttgacctctcacgaatatctgttaccttctttctctagtgtttgcgctacttgcaaaagtaacagtggaaactcagatattcacggacagtatttttaaagcattttatacttattgcaattataacctcattacacctattgagattatagctattttgattaaataccttaaacacattctcacataccagacagaagaggaccattaaaatatgaaccttatggattccttgcctcatgatttttcaaggaattcagaccctggattaaatagggaatatatcaagataaatgaaagctacaagtccagaattttttttttgtggagaatctgtttgaatactagagtacacacatatatgtatatacacacacacatacacatacacatatatatacacacacatatatacacacatatatacatacatatatatacacatacatatatacacacatgcacacatatttatatcatatgtctatttatctcaaacatataaatagaaaatagttttcctagaaaagcaaatacttctgggatgatattcttttcaataaccatccttaaacatatgttacaaactttttatttccttcctgtccaaaacagttgtttcatttttcccattaggaagagaagcaaataaactgtgaagtcacagataactctggcgtggtacaacttgactgcagtattggctatatatatgtagatcatctctcaagggtaagtgtttcatatttatggcttttgttcactatcatgaatatttttttctattcttccctatctttaggttgcatagaaaatattataaatattttagcttggggtaggtagctgagtgatgaaataaaactggttcttgaaatctttgagctttgtgtttatattcttggcaatgtttgctgttttaaagggggtggcatgtttacatcgaaatgggcatgtgcatgtgtcaatcagaattctgctccccctacacacccttcccgaaaacccccacccccaccgcaggtggtcctgtctgccaggcatgttacctctgctatacaaaaaggtgtttttggcaagagtctccactcaagttgtgaaagcatttctaattttgtctagacttgcctgcgttcacattcagagacgtctttgtctctgaatgttacgtgtggatatgtgtgtactttaaaatagccacaaacccaacaacttccctgaatcttattgccaagggaggagtagctgatgcctttacaatggttcaattctacattccatagaacataaacttttaagaaaaaaattcagattataaaaaatgtacttaagattttttttaatgggctttcctggtctgtgttttacagatagatattagctttctcctggatgtgagctcactcagcagagcggaagaggacctcagtatcacagtgcatgctacctggtataatttattgttaataaaatgaactagaaatatacccccatattctgaggggggggaattaggagaaccgtaaaactgtgttccattaattgtaagagaaaacttctcttacgtggtatgcttttaaaagaaccaaacaacatagttaaatgggagttactggcaatgttttagctcttgagctatgttaagtatttattagattagattagagtagacatgatgtgtcacgaatcaaactgtgtatttgaaatcaaaaacagaataaacagtttacaagtaataactctacaagatttaaaagtgagggtaatgacttccatagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaacacttcttcaacctaaagagagtaatagatttgtttctaaactacctatttattctggtttttgtaccacctagaacataaatgttaaaaaatcttttaatctaataaatgtaactatttgttaaaaaaaaaaaaattcctctatctagcattagaagcaaatgataacagtttaaataatgagagaaattttctgccaaccttgtcctaaaaaatttttactaccatatctacttttatccccactcctcaaaaagcatttaagcaaacctctgagtatattaggtatacagggtatgtaattagttctctctgaagatttttctgcttggtgaattctaacagggtgttttctgtttgtatagtgaaaatgaagaggaaatggacaatctaaagcacagcagagtgactgtagcaatacctttaaaatatgaggttaagctgactgttcatgggtaagtagacataaaggcttcctttcaaatttagagctgatttacagtttccttgcttcttacattaatgaaaaaactgtattctagaatttttttaaaataaaaaggatactctatcttttaataattacctcattgttatagtcccttacttagctgtccattataataatccactctataatcatcactgatactacatcaaactagtacccagctggaggagatttcttactgtgagagccccaacaagctagcaaggccacactgagcctttcagctgtgcactgtgtaatcctaatctggaattaggcagtatgcagtctgcataatcatacttaatgcccatgtcaagtgtgaagttcagagaagtgtgaacttagtcaaatcactattctgcagacccgtatctacacatgtggcaaatggattgagacgtgagagatctggctgaaaggtgtcccttgtccactttttatacctatgggatcaccagattcctcaaccacagtatcagaattcattgcttcctcatgattttaatgattgagtggatccccctctcattcaagaaggagatgtgtggagaaagaataaaagggggcttacggaaaccttcagtaattccactagaacttattcatggtgttagtccttaaaactacatttttatgcagtagaagatatgagttacagaacaaatagacagatgagcctttcctgttgctctaaatctaaaccatcccgcagtcatcttatccacttagaaaggtgatatacagtcatgtaaatgtaaaatgtcagtgtctgatggaattgagtatcaagtttgagataaagcaaacgggtgaaaaaaggccattcacaggagagtaagacctagagaatcacgagtaagcaaataaaaagttcattgcgtgtttcctggttttcattgtttatcttgccactcctcctggcttatgatgagtgtcttcctatttttctgttattcacatctcattattttgaacaaggtatgttcacctgttaaactgcctaaatctatgctggttactttcctgtttcatgagtttctaatttggtattacctaatattagctgccaaatgtgagcaccttatggagtagagatctccctagaaacatatttcttagagtttattgcagataaaaatgtcaaatcacaggcctttaaaagagagtgacagccttgtattgtaacaaaaaatttatcatacttaataatgttagacttgttccccagatttggggttcattataagtagccagcagggatcatgagatgggaagaaataattcaaaaatgggtaacataaattgaggtatgagaaccttaggaaaaaactaagaagttatcccacattacatttgccaaatttacatgaatcacttaagggctgaaagagaaggaatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctgcttctcgggttcaagcgattctcctgcctcagcctcccgagtagctggtactacaggcacacgccaccacgcccagctaatttttttttgtatttttagtagagattgggtttcaccacgttggccaggctgccctcaaactcctgacctcaggtgatgcgccctcctcggcctcccaaattgctgggattacaggcatgagccactgctcccggccctaatttaatttctttttaaataaaatgtatatctgaccacaaaaccaaaagtattccatggtgacttgtaaatatgctataatccagactatagaaaaagactctttataatacgtcatcgaataagacagttaattaaatttgaatttgtttttaccaggtttgtaaacccaacttcatttgtgtatggatcaaatgatgaaaatgagcctgaaacgtgcatggtggagaaaatgaacttaactttccatgtaagaaaagttaattgtgttaatatttgtaacaacctaaaaggatgtcactgatgcattgctccaagggacattgtacacctatgacgtccttcagcctctgcagaccacagctggctggaatggggcagcagcagtggtactcctgcctctcagacccctgctgctttccttccacttgtcttgtccctgatattcaagcccatatttccttacaggacaggtgagaaagagcatgcaggaacagagataatgcctgaaacaggcaaagttatgggatgagctgaatttgctagagacacatacagaaaacaggacaggccaagggaaggcatctttgggtgcaaatcagtgaaatttcttcttggttcaagcgtataaaaacctcagcactacaaagtaaaggaggctcttacctcccatctccatttaagatcacgttggttagcctttcaagccataagtttatgacctgtgacaagtgctttatcaattattaaataaccttttaaagtaaagagtactatcgtaattcagaagtattaggagactgatgtaaacctaagtttttaaaaacattttttgctgtcaaactgatatttttattgtatcaaagatgttggtgattagtaaatataatttccaaaaaaaaattctttgaaccaaaagcactgtccaagcattcttatagaataatctatatttgtgagtaaatcttggattaggtataatattttgtaagacaatgcttttcaaaatgtgtattagaatcacttggggtacctatccagaatgcaaattccttggctttgccccaaatctgtggaaaaagaatgaccttgaaatcctgttgattctatgtatactccaatttttgttacactagttgatactaatgttgaaaaattttagttctccactttgaagtcccaagaaatgctctttaaaacccaatgggagtttgtgctttgataaactaaaacagaaaccaaaccggactctagaatgtttatttattaatttacaattaatagttaaaaagtattttctactaaatgtataatgtagtgactggcactggagaaacttgcagtatataggatttctgtgtctagtcaactatgtagatattcttagaggtttaattgttgttaggcaaacagatgtttgtgatttagatatttaatggcatccagaagaccttgtctgtagtattgggcactgctaggtatctgttgctgacattttcctgctgcaactgccctgtgcttttatggattagcaattaccacctgttcccaatttggagacactttcttcatctatgtcacatgcattcataaaatgactgcaggtctgcaagtcatcttttttaatcgaggtattgggatgcatctctttctgacttactgtattggttttacagttaagctgccagttcagtaggctatattttggccccatttcccttttcaggaatcttcaatccccaaatttatcatcctcttatgcattttttgacaagtattgttaaaaaccttttgtgctttctcaaaacccaacaacatacttttcttctgaatgcatcagcatatagatcctgaataaaaatacatttttattcactttctcctgctgattatcctcttagcacagagtgcttttgcgataacatcataggatttagaattacaatacctgagttttggtcataactcttgtcattttttaacttttatcttgggaacactaagaacacctgttagcatttcccttagctggtgaataccaaaatgttggcctacctcatgagaaccaaatgatatttttaaaatatgtaatgtaacatacaaatatatattgtttgtctcctaagactgtttctccaataaaccatcagcctgtactttttgttttcaacaataccaaaactagaaggttagaaacaatgactcatttgaaattattagcaaactttaaaaattctgactatggatatcctgtctccctttgttatgcagctgccaactataaacctccaccactataaatgttgcatggaatatacgggatcacctaaaagctcactgatatctgtacttacatttatagaaaacatttaatttgttaaaaaatttttccttcttatcaggttatcaacactggcaatagtatggctcccaatgttagtgtggaaataatggtaccaaattcttttagcccccaaactgataagctgttcaacattttggatgtccaggtaaaaatgtatttcttccatctaacctttattgtgtgtcttaaatactaaaataaatgcaaaccaatcctttattcgagtaatgatgtgaaaatggataattgttaacttacttcagtcacactctaagctatgaattcaccatgcatttattgagttatgctttgaatattatacatttctttagaactgtagagttacagtgcaacttttacatttgatttaaataacagaactatattctaccatctccattgaataattattttaagatacattgttgtgtgatatggacctatagaggtaacttctattagtagaattcttcataaaacttgaaactactgtgcaaatatgaggattatagcctttttttaaggaagcactattcaaaccacttcttaagaaccgatattcttgcactgatggttccatcagaattgttttgagcttaacaggttgaagacaaaagtcaacaaatctactaaataggtttgaggtctgatttttaaaaatcctatttaaattccagatttagagagaagaatatggtgttatattgtttcgcctataaaggcgaagaaatatttaatgtcatgctaatgttccaatatcatttttcacatttctgcaaggttaaggccattttatcagcttagaacctatatccaacctgctgtaatttggctgggtttttgtgtttctgccacagacatttaatcactcccaaatctgtcaaaaaaatttctacaatttcagaggtacttgatatattttagcaaagataagctactggaacttttaaaaccaggttgctttttgctgttttttccagtgttgaaagataagatttctcttgctttctgtcttcatagactactactggagaatgccactttgaaaattatcaaagagtgtgtgcattagagcagcaaaagagtgcaatgcagaccttgaaaggcatagtccagttcttgtccaagactgataagaggctattggtaagtttcagtttttcaggttgtagttcctgctttccaacagagaagtgagacacttaaaatcaagtcaatgggtttgagctgtcacttcaataataagagagaagacaagtttaggtagtattcttgcgtggaaggaacaagcatggttggaaagttgagatagacccagggtctatcccatatataaacatgttggccgggtgtgatggctcacgcctgtaatcccagcactttgggaggccgaggtgggcagatcacaaggtcaggagttcgagaccagcctggccaacagagtgaaaccccgtctctactaaaaatacaaaaattagacaggtgcctgtaatcccagctactcaggaggctgaggcaggagaattgcttgaatccgggaggtggaggttgcagtgagccgagatcacgccactgcactccagcctgggtgacagagcaagactccatctcaaaaagaaaaaaaaaaatgttatacagtttcatttttttatctaacaaatgcccactatttgccaacaagacattgttccagacccttcaggacaccaagaggttgtcttcacctgggcagcctttgtggcatgggttaattttcattcttttcagcttagtgaatgtatgaaaagaaactggagaagcagtcatcaccttgaaatgatccatgttttacaacaaacaaagaatacgtaacttagcaagactctgattaggaacattttttaaaaattctgtcccagaagattatgttaatacaaataataagaacatatgctgcagtttaaatactttattataatttagaaaacaaacattcatgtcttgtttaaaggtaatttaaatgccactaaggaaagcagatgtttaatttcatatttatggaaagatgattttcaaaatgccattagagtatatattaaattctatataaaatattttaaaaatattttccaatgttgaaaattttaatgtagcacttttatattcccttcaagtactgcataaaagctgatccacattgtttaaatttcttgtgtaattttgggaaaatggaaagtggaaaagaagccagtgttcatatccaactggaaggccggccatccattttagaaatggtaagtaagtctaaaacattgacaacttggtggctaagtttacataaaatctataaattcagtcatataggcaggatagtatgaaggcattcaacaaattaaattttaaataaaattttggagtaaaactctaaaactgtatttctatcacttcaactatctacattgactaagtgaaatggctttagaaattaacaggtaataaaggctaaaataggccaggcacagtggctcatgcctgtaatcccagcactttgggaggccaaggcaggaggatcacttgaggccaggagttcgagaccagttgtattcctaggtagatgtctggtgttatttctgaggtctctgttctgttccattggcctctgtatgtgttttggttagccttgtagtacagtttgaagtcgggtagcctgatgcctccagctttctttttgcttaggattgtcttgactatatgggctcttttatggttccataggaaatttaaagtagttttttctaattctgcgaagaaagtcaatggtagcttgatgggagtagccttgaatctgtaaattactttgggcagtatggccattttcacgatattgattcttcctatccatgagcatagaatatttttttccatttgtttgtgtcctcttatttccttgagcagtggtttgtagtgctccttgaagaggtccttcacatcccttgtaagttggattcctaggtattttattctgtttgtagtgaatgggaattcactcatgatttggctctctgcttgtctattattgtatacgaatgcttgtgacttttgcacattgatttttgtatcctgagactttgctgaagttgcttataagcttaaggagttttggggctgagaccatggagttttctaaatatgcaatcatgtcacctgcaaacaatttgacttcctctcttcctatttgaataccctttgttgctttctcttgcctgattgccctggccagaacttccaatactgtgttgaataggagtggtgagagagggcatccttgtcttgtgacggttttcaaagggaatgcttccagtttttgcccattcagtatgatattggctatgggtttgtcataaatagctcttattgagatatgttccatcaacacctagtttattgagagtttttagcatgaagggatgatgaattttattgaagcccttttattttaaaaatatagctaagaagaaaaactaaggctttcataaaatcaaataaaatcaaaattcaacaacaaaaacatatttaaattttaaaaataatgaaatatatcttggactttttcctacaaaggagcatgtatatttatgaggagtagtttgagatgaaactagttttatgtggagttctgtttttcagctttctcatctgttcaatatggataaatgagatgatttttataagaacttagttcatggaacataggaagccaaaggaaatggcagctgttatgttcaagtggaattcttgaaattgccaaacagtgcttaagaggaagatacactagacaggcaaagaagaaatatccattttagtttcaactgtgctaaaagcaaagtcattgaaccatcagcaagtcatttaaccttttgcagtttgccttatctttttctctaggtctaggttttccatcagtggccataattggcattttgaaccagataattttgttttggggggttgtcctgtgcattgtaggatatttagtatcatcctcagcctctatacgctcactgctggtagtaccacctcccacgttctgacacttgacagtttctttagacattcctgactgtcccttaggtgataaaaccctccctgctgagaaccactgctctagatctataggaagcttgtcatttttggctctaaaatgttaaataacatttacacaatagttttaaaggtcatatccctctttaagaatctgactaaatatattctcatctccctcagcaaatgcacacatgaaaacatctcctaaagattcttagaatttataaagcccttctacagatccccaagcttcatggattctgcgttataaaatccttgctttagatagtaaagttctgagttcatccactgattttatatttgaattctataatgtatttaatttagaaagaaataaaaagcccaaataagatagattcaatatgcggtggtggggtggagaacaatggtaaatggtaacttacctctttctgtagtctaatatttaaatcaagttatttgcaaggtagctgtttaatcaaaggatttcaataaaatgatactatataaattaataccaagaccacactttgggaaccaaaggaggcactgcagttaattttaagtggtgaaataaattggggaaggtaaattgtgaaaacctctagctagaaggtaaagatcctgataaattatgtctttatgaaataaaccaggctatggtgatccttcttttattaaacaggatgagacttcagcactcaagtttgaaataagagcaacaggttttccagagccaaatccaagagtaattgaactaaacaaggatgagaatgttgcgcacgtaagattaccctcttaactgctacattaaaattataggaaaacacatttcaagggtgtctataattacttccttctgagtaactgagttgggaaagtagagtgtgaccagctcatggagggcccccaatacttggttgagagttggcattttccacaactggcaggagggaacaatacagcagttctttcagagaggtgaattgggcagcagtgagaattgaatagattggaggaaaagtcatggatacagcccattacactcactgtttctgctaaacagttaccagtgtttcctgcaattatattagaaccagcaagaaaatgggctgggcagttctaaatactactggggattatggcagggctttaaaggaaatataagcaacgttttaaactgatttttttttttttggtttttgagttttatttttcttaactcacgtaggttctactggaaggactacatcatcaaagacccaaacgttatttcaccatagtgattatttcaagtagcttgctacttggacttattgtacttctgttgatctcatatgttatgtggaaggtaagcatttaacaattaccaacattagtctactaaaaatgacattttctcaaagccaatttgacttccaagttattagatttaaatatttcactatttgaatgttaactttttatgttgctcagtactgatctcacatttctcttcaacaccaaagtctttctagaaaaatatgcattcttaatttgttttgaaagacagacgttccttttaaaaaaccatttggaaaagattgcaaattacacggaatgtcaattttggagagaatgtggtgtgtatcactgagaatttctgcattaaaaacaaaaatgtttctttaacccggtatgtccccactaatttttactgattacctctgttaaacctttatgactgatgttacaagggatgcagtttaagaaatattggtgttaactgcttagatattagaaatgagtatagtagataagagagtgttcataactatacactagtgattatgttatgctattttcaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataa

SEQ ID NO: 710 - DNA, 15044 bp, Human; identical to SEQ ID NO: 675

SEQ ID NO: 711 - DNA, 188504 bp, Human
  misc_feature (1)...(188504): n = A,T,C or G
aaggacattaccagcatactcttcttctcttgatgcatttaaaaaaatgagtatgtgtagagtgtttccttgatccatgttgaactttaattttattgttatttattggaagctactcattcttatattaatctcagaaaggcattagctatgttttgctctggtcttgctttaattctaggcttatgcagtaggcaagttagatttctaagggatgatggaggaataaatggctctagcattctaccaatttggtatcctctttaggccaccaatgaacttggtaactaattgttgttttccaccagccttgcaatgcaacacagctttgcaattttatttttttgaggctactaaagcttcctgtatctgcaaaattaaactaaaagaaacaagaaccggagttgtatataaagagagaacagagaataccaagcttaactttgtccttgtagaagtattgattagtctggttaatgctgtactagacatcaaggaaaaacccgactttctttcttagatccctcatagcctcatagagaccagccctctacaaatcaagacttgaaaagttattcagcatattccctcatgtcaaaaactgtagctgggaaactaggtaggcgggaacagaatctgcctggtgttggagaggatgtattaatataaataataaacacaaaacatgaattgtagaaggttgcaaatagaggaaaacttcagacaccaaaaggatcaaaaaacataaaaagaaacagatacaatttttaaattgtaacttgttgtctagtgcaatgataaaagctatccacgaatacagcgattttagaaagttaaattttacatgcagtgctactaaaataccaaaggccatacataatgtctgacccaagctgccacctcatatagcaacttcttacatgggggctttaaaaagattgtttgactggtctactgtcctgcagtgtcaggagacggctttgtctgacatattgaatttccagtgtctctcacacttcctccttttcagatgcacaaaaggtttttgtaaagtttctcttggttttaccgctggcagctacagaaaccatgccacaagtctggtgtagagttatagggtgtgattttatttgactggtatcttcagagcttctggatttttcagtataaccgagaatttccttaagagctgtaaataaaaatcggtaccagttcgaaccctttactggcccggttttgtgtgaggttggctggctgctgtagcacgttctccccctcctcctcctcctgcaccccctcggttccctcctctgcctgcgggaataccacttcagggcgttcagcagccttcccagggtgggtcctggcctagtaccctaaaactataaccgagaatacctatcattgggcagcctaggaaacgcgactgggacttttagtaggggcccctcaccgctctgaagcactcacacttgagtcagggaacatgggtttgaatccccacccggccgtttatcttgtgctcttgggcacactgtgtcccctatataaaataagcacccatctcttcatctgtctcctaggcctgcgacgatgcaatgactgcacgcaaagcgcacattcacggtcaggtcacttctggcgtccggctgtggtccccgcagggtgcccgccggcggagcgcatcctccggcagggggcgagctccgcaccccgctttcctcatgggccggcgcggcccgccgttcaagtggggagcccagaggtgctccgcgccgtgggcggggggcggttggcgcgcacaaggccggactccggcggggcgcacctccacacgcaccctcgcgggcagcgggtcggagtcggggcctcgggccggctgggggcggggcatgggcgcggcgcgcggggcccggaacgccgagacaatgcggcgcgcggcggccaggaacggctcggcgggccggggcgcnnnnnnnnnnnnnnnnnnnnggaaccctcgccccttctcccggaggcgtcggggcccgcggctgggtggcgggtagttcccgccggctgtgcgcgcccgccctccgggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggtgaggcggcctgcgcggcggctccggccgcaggtatcccgcgccccagccccgcccgccgctcccgcatccgcatcccgagaaaactttctttgctccgaagccggacgcggccgggccaaccctgcccgagacagaagccctttgttcccgcctaggtggctcggaggagatgggtgatggccaccttgggcctctttaagacctcccctctctcggcctcgtggccctcgcggggttccgcggcctggtcttttccccgcagcgcggccaactttgtccagagtcggggtccgcggcgagcgggggatcccgctgcccgccgccgcccgccgccgcccggggtctttggtacccggtgcggaccttatcaacttgttcttgaagtggaccggcgggggcagctccgcgctccgagctccccgccgcagcccccgagcgccgcagggcccccaccctcgggtccgcgggtccggggcatcccgggctgcccgggaaggcgtgcccgcctcagccagggcggcctggctgcgctccacccgtgcccggagaaggaactgcgggcaaggtgtgtgagagtcggcgcttctgggtccaagaagcctccaggagccgctccccggttacctgggtctcacctgcttgaacccggaatgccgcccttccccctcaacctggaaaaggcctggttttagtaaagtgctctcaaggtgcaaagtcatcacgcctagctgctaagcagtacgctctccaggtcctggggagaggaacacgtaggaacgaagaagcttggttgaaaattaaagccgtggggaaaggggcagagtctgtgagtccaggggccaccgttggctgtggtttgaggcacatcctcacctgcagtcctccttttccttacccatcaaacgggattagtaatgcatcctttccaggatcagagactgtgtgaagtgcttagcactctgctcggctcagaataggtttacaagtcacacgtgtggcaatagtgaatctgtgattaaatgtctctgggccaggatgtcaggttacagttttaaaattgggtattgcaggtgttttagcagaagacgcctgggctagcaggagtgtgtgtgtgggtgggggggtgggtgtcaccaaagagctttaaatgaagcaatggcgttattttttttttctggtttttttttttttttcccatttgaacaaagcatctgctattaggaattgcttgaaaaaaaatccagaatgttttcccttaatggaaaaattttttctttgtagctgtaaacagtcaataaaagggagtcaaaagtaacattcagcattctgaatcctgttaatataacttgggtagccttccttctctccatttaatttggcggaagagagctgcatgtaaacctttcctatgaattcggtgattccccagatcacttaattctacttttagcagcaaggcttacagatgatgccttcaaatgaggcagatggggatgggtgaatgaaattttttcctaagtgccagttaaaaagcacggtgttttgagaatacaccattaataatgtttatggaatgattgcaaccaaaaaggtagctgaatatttcttaagggaaggaagcattgtgcatgatgtctttctttagaaagcttgattatgtttaaagttctgttgcttttccccactgcagtttgtcagttaaatattattaacactggcagatgttggaaagccaagcaaacaagaattgctattaaaattggcatacctttctctgattaattttagtttacagtgtataattccaaagctctttttgtatgctgtgcaggagattaccctagagctcagttactgagcagattacaaagagactggatttggtcatttcattaaattgcaagcttgcttcatgctgccgtctaagcccaagaattggttcaagtctcaaaatggaaaaattaaaatcatttcaggtttatttcactttaagcaaatctacatacatgctatgatgatggtatgtgtgagcttggttttataactaaatttgaaagttgttcactttctgaggtaaatcaatgtggatttctttaaataatgctctttcccaggtgtctaatgttcgtgtctattaccaaaacttgttctatgtatggtttaataacaattgatgtgtacagtattttggttttaaacaaaaatcttctcatactgagacgaaacatgagagggtatcatgacataaagttactcatttaacaaataaataaaatttgcaagctcttggtcttatgtttaaacaaatgaatcacggaactagcaaactaattttatatttatttatttatttgttacggagtttcgctcttgttgcccaggctggagtgcaatggcacaatcttggctcactgcatcctctgcctcccaggttcaagcgattctcctgcctcagcctcccaagtagctgggattacaggcatgcgccaccatgcacagctaattttttgtatttagtagagatggggtttcaccatgttggtcaggctggtctcgaactcctgacctcaggtgatccacctgcctcagcctcccacagtgctgggattacaggcgtgagccaccacacccggccagcaaactaattttaaactgattaacctttttgaatctgttatttccaatgtaggttctatctgccaaagaatcattttacaattaaaatgtgctgttttgatttgcatacttgttgctggaatattattatagtaactgttgggcccttatcctgtactatgaaactcacaggtattgaattcagtccttatctctgctttataggcgaggaaattgaggctcagagaggttaagtaatttgccaaaggttatagagctctgaagtggactttgaacttggctcctgctgttttcagaaaccatgctgcttcctgttacttttcttaatgccgaattctctaaattactcctttgtcagattgacctgggttcaagttcaggctctacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctggcaagctgtagagcctgaacttgaacccaggtcaatctgacaaaggagtaatttagagaattcggcattaagaaaagtaacaggaagcagcatggtttctgaaaacagcaggagccaagttcaaagtccacttcagagctctataacctttggcaaattacttaacctctctgagcctcaatttcctcgcctataaagcagagataaggactgaattcaatacctgtgagtttcatagtacaggataagggcccaacagttactataataatattccagcaacaagtatgcaaatcaaaacagcacattttaattgtaaaatgattctttggcagatagaacctacattggaaataacagattcaaaaaggttaatcagtttaaaattagtttgctggccgggtgtggtggctcacgcctgtaatcccagcactgtgggaggccaaggcgggcagatcacttggggtcaggagttcgaaaccagcctgaccaacatggagaaaccctgtctctactaaaaatacaaaattagctgggtgtggtggcgcatgcctgtaatcccagctacttgggaggctgaggcaggagaatcacttgaacccaagaggtagaggttgcggtgagtcgagatcgtgccattgcactccagcctgggcaacaagagtgaaactgcgtctcaaaaaaaaaaaaaaaagtttgttgtcctggcagctggtgagagcatacctgtattttataatttttcacttgaccaccttctctggttcaagtcatcattttgtacaattttagcaaacttagcaaagtctggtgctgcaaccagagtctgccctgtgcttttggaaataatggaaaaaataagcagttgtggcagaaatttgaaaagtaagggttttttgttccttttttttcttctttttttttcgtttcttcgagcctctgggcactttgaaatattctcaaaatagggaaaaattgtatacatatttggaatattcatgtttttagttagaccctcctttatagcaccatccattctgccttacgtatttggcattgatgtagttttaaaaataaatttgatgttgacttgtaagtattaaaatttaatctacttccttccggggccataattctctactttgttgtccttggttaccttggcaatcccattgctgtcataagcacagggttctaactgcaggggtggggtgagcatctgggcctgcaggctcccaggggccctgccgtccatgggaccagacccctcctagcagcaacagtgggaaccagggctacgtgctttttggcaagaatgtgattctgaatgttagccctttgtgacttgtttgaaaaacagttcctccaagtccccagaacagattattgctgtcttcagaaggacatcaccttcttgcccagagcattcatgtttttggaagtgagccttgatgggtcaaacagggccaccttttaaactgtgttctgaaatttgaatttcagaaaattttgaatcacttaaggaagcagccattttctcttcatatgtgagccttcctccctgccccctggtgaatgctgaattcagtttctttcttaggctcaagagtagaagtactgatgccactcctcacgggttccaggtcctgccatgcactcaggattcctgagtccttcagtgtgctgggctgtgtgtgaggtggcaggaatagaacaccaagaagaatatgtcctctctttggagggacctacagtccagcaagaggaacagaatcctgtaaacaaatcagtgcagtaaaatctgaggaccacatctgtaggaatgcttggagtcctgtggatgtgcaagggtgcaggtggtcccagggcgtggggctgtggtgagggagggccttatatgatgtcgtaccgttgagtcttgaagtccaggcagttacctgtgggttaccaaatgctaaggcactaagctggttcattctggtcttctgtacctgcctccctgccttaggtaaatattgatctactcctgaggtggtggccaactcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatgaggcagcctaagacaaatccagctctcagccgccacattgcaagtactcagtagccacacgtggctggtggctaccatattggctcagcaaccaccgggagagccatcacctggaaacttgctgaaatgcagagccccgggttccacccaggacaatttttacagcatctccacgtacaccacaggcacgtgagagcttgcgaagcactgttcgagacggaaccccggctgcacactggagttgcttgggcgtttgtgaagcagagctgcctggctccactccctaaaattctgacttaaattagtctgggtggggcttcgagccttggcattttttaaagcctcctcccaaatagggttgataatcactgataaacagacagttacgtaacaaccttaggcagttgatacgtgctgtaaaggaaagtcatgcataacatggggatagaaagtggttctggagatcaggaaaccgaaatcaggaaaagcctctctgcagaggtgacatttgagcaggctggaatgcagagaggaagccagccacagaagatgtgggaatagaacagcttgggaaaaggccctgaaatgccaatgggcgggatcatggaaggactgaaggaaggtcagggtgtgtggggaggagtgggcgaggaagagaaggatgagagacgggcagaggggtgggcagtgccaggtcacagagggccttgtccatcttggggaaggaatttggattttgttctagtgtgatgggaagctgttgaagggttttgagcagggaataacatggtccgatatccattttaaagacttcactgtggttctagggaaaacagactagcagggcatgaaaggaaagagggagaccagttgtggggtgaggggctattgcagtcatctaggcaagaggtcttggatgaggaggtagcagggggggtggtggtaagtggcctgattgaggtccattgtacaagaagaggggtccaaacctactgatggattgtcattattgtgtgctagtggcatagaggtagacccaatagaactcctgccccaaacagggcaacagccaagctcagttcatccaagccccctgaacagaccttccagcatccccatggtgaagctgttgctgtctagagctacttagtgtcagaatccaggccagctctgtgctgcttgatgtgactggttataggacttgtgttgggaccagttccagggtcaatcaaggaaagattgaagcatagctgcatagactggggcccagggaaagagagaagcatggctgcatagactgagactgagggatctgctcatgcgaccctctgctgtttctatgcagactacagcaggtgatacttatgggcattgtcagatgcctgggatgctatccccatttcagctccccaaacactcctctttctttccctactaaagagaggtgacgttccgtgatatgaacctacctcctttgcttacgccttttctgtgtaatgtggcctccaagtggattgctagggcccttccaggtactttttttcttttctttttcttttttattttgtttgaggtggagtcttgctcggttacccaggctggagtgcagtggtgcgatctcggttcactgcaacctctgcctctcgagttcaagggggattctcctgcctcagcctcctgagcagctgggattacaggtgactgccaccatgcccggctgatttttgtattactagtagagatggggtttcaccatgttggccaggctggtcttgaactcctgacctcaggtgatccgcccacctcggcctcacaaagtgctgggattataggcgtgagccgctgcgcccggctgcctttccaggtgcttttataccattatcgtttttatcatgtcaacaatgtcttggaataaacagactaccaacccgagctggaatacttgggctgtatttttatgatgatggtcatttctatgaagggatttgactgatttagtttcttcactcataaatgtatattgggcccctaccgtatgttgtcactgccaggtgccagggatgtaaaagtggacaggatggcctggacgtctaaaaaaaaaaaaaaaaaaaaagtgaacaggactagctccttccttagaaagcacttaatagtctcatgttttatgtgcagttctgtttcatccttttaaccttgtttgtgccatggctccctttgacactctggcgaaggtgatctgcctcttcagaaaaatgttttaatgcagagaacaaaataagattccgaaggaaactaatcacagtcatgcattgcttaatgacgaacatgcatcgttaagatttcttcattgtgcgaacatcctagagtgcacttacacacacccagatggcatgcaggcacctaggctatatattaagagcctattgctcctaggctgcaaaccttacagcatgccactgtgttgaataccgtggtaactgcgacacagttacagtatttatgtgtggtatttgtgtatctaaacatagaaaagacagtaaaaatccctcttataatcttatgagaggtcgtctgtgtggttcattgttgactgaaatgtcactatgtggagcacgactgtatattgaaattcagttaggagaatattttaaaaatttttaccatgctcataatgcttctttactaaagcatttaataacaagatttactggtgggtctaacaaataccttaattttgaggtatttgatgaatataaacaatacgagatatttctaataaagataatgtaatgttcatatcttttattgcaagtattgataatattaccatgtgttgcttacatttgtaattgaaagatacgataaatttcagttagaccctaatgaaaatacagataattttttttttccaatccaagtttatggaccccctggattcagacagagaattccaggcttgatggtaagatttgtttagctagttttttttttttttttggagtgatggattctttaaccactctgtttgttaaatataattattatatttcataattattatactgtccttgccatgaattggttctaagagtctagctgagaagagttgcaccctaggccagtgttagaattatgaggcgctaaaggtgtttagaagcgctcttggcggggagccatccactgtggttttacatccgtggggtgccctctgttctttcagggttatggcttggcagcttctcatctgatcccacaggtcagttcatatacttgtgcatgcctcaagagttcagcagagctgcaaattggaccttctgagtcctgtaattaggattctgagctgggtaggtcctacaacccagctctcctatttgtgcctttcttgtttgtgtcacacggcatgtactgcctttgactctgcagggcaagttccattgtgaagcaccagaagattcatgggcaccacctacccagaattttaagggagactttgcagtgtgtgttattttcagtgagggtatggatttgaaatgctgctgctgttgcaagagtgtgttggggatatccagagtgtgggtgaagtcaatgtcagttcatattttttttttttttttttttctgagacagggtctggctctgttgcccaggcttgagtgcagtggtgtgatcttggctcaccacagccttgacctcctgggctcaagcgatcctcctgcctcagcctcctgtgtagctgggactacaggtgtgccccaccatgcctgtttaattttttttttttttttttttttttttgagacggtgtctcactctgtcacccaggctggactgcagtggtgccatctcagctcactgcaatctctgcctcccaggttcaagtgattcttgtgcctcagcctcctgagtagctgggattacaggtgccaaccaccacacccagctaatttttgtatttttagtagagacggggttttgccatgttgggcaggctggtctcgaactcctgacctcaagtgatccacccaccttggcctcccaaagtgctgggattgcaagtgtgagccaccatgcccggtccctgattaatttttgtatttttttgtagagaaggtttcaccatgtcatggctggtcttgaactcctggactcaagtgatcctcctgccttgccctcccaaagtgctggtattataggcgtgaaccaccgtgcccagcctcccccttgtcttttctaacatttatggggcacttattatgtgccagatatgctttaaattctttacatatatcaattattaactcatttagttattatcaaaatgctataggggccagcaaaattaggccacggtaccaagttcatggagcttggaggtgatgaagccaggattcattcaaatcaagcattttgacaccagagtctgctatttcttttagcagccaacagcctctgtagagcccgtgcccaccaaggcccttggtgttgcagcctctgtggccagcatgccctcccttgctgttagtgttagaaagttgcagctattgcattgctcgagtgggtgcttctggcaaatccttgttgcttctcgtttcctgtttgcctcatctgtcctccttgctgcagaaattgttcttctttcctctcctcactgctctgctgacatgcccagccccacggagcagagtggccaggggcattgctcacaccctggcaggaggccttccctgctaacagtgttaataacgatgtcatttttccactccatgctgaagatggctttgtcaataaaatcaggcagttgatgaagacagttccctctcatgatgaattcacttgtcttttaggattctagccaggcagtcaggattgtcgggacctctttccccagcttctcagaagaaatcatgttcttcttagaggtatgtttttgttttttgtttttttttttgagacggagtcttcgctctgccacccaggctggagtgcggtggcacaatctcggctcactgcaagctccgcctcctgggttcacgccattcttctgtctccgcctcccgagtagctgggactacaggcgcctgccaccacgcccggctaatttttggtatttttagtagagacggggtttcactgtgttagccaggatggtcttgatctcctgacctcgtgaggcacccacctcggcttcccaaagtgctgggattacaggtgtgagccaccacgcctggcttttttttttttttacatgaaaaaataatgatgacaatgctttaatttcatttctctgagctttaattctgtattaaggactgtgctgtgttttaaattgatgatttgatcccctcaacagtcctgaggttagtcctatagtgacatgcctccaggttccacatcccacaaccagcatttgatagagtaagaatcccagtgctgtggaggaggtcctactcttcttgatcttttaatgccccacctgtcagtctcctgctgggctctctgttgcctgggaagatttctctgtaggtgttcctgtgagtttccttagtgcaggttaatgatggttgttgatcacctgcagtccccattgtcactgaatgtgattgcctggaggtcatcagacactaactcctggggaggcacttaacatcagaagtgtttattaacttgaccttgaccaattggcctccttagagctgaggggccaagaacactgtcactgtgtgacaaggactaggagccacccagacccatagagtattcccttcgtttcagcaaatctgtattttgaggctgccactgaagggtgaatcatggatgtggcgtgtctaggcagacttgggtggagaggagtcagctccctgttaacagaggactttggagaggttttgaaaggaagggagaatgttgaggccttgtactgtattcccctgatagcctgaatctgttgtcagctcttggaccttggagcaggtgacttcactggtcctgcctcagttgcgtcatttgtaacatggagggttggatgcgatgagtccagtctttccagctcttgaccttccatgtctgctgctgtctgcaacacttcccctgcctcttgccacccttgctttttttggctgtcgtctctgtttttttctttatcttgactatttatatttatacttttcaagaagttagagctaagagtgaacgttacctctttcatccccttctttaaagattccctccttggagatatcactggagttgatgtggtggttggtacttgagctggaatcccaatgggtgccttgctggtttgagattgggccgaatgaggccgtgttgtttgccatctgtcttgcctcagagcagtattttttgcagtctttgctgctttcgttggtctcttaattaaaactttgttgtgctttgcttctctggtgaaaagcaggttgtgttagtgatgatcatggggttttgtggtcattgagtaatgtggactgttgaacttcaagaaaatactgattttcttatatccagcgagcttcctagattttgtggggaaccagtgttctcatcattggaagatgtgctctctagtgtgaagcagtgattttcacatttgccctgtgattcggttgtgtttatgttgtggagcagaaagacctagccagggagttaggagagcgggattggagttgtaaggtcaaccttattgtgaccttgagccagttaactgtgtatctggtctgtaacatgagagatttggactagatgttctctgaccatcctccctgacctaaaaattccatagttctttgtattcatatatactggatgtgaaaagtccctggaataaattacaggaacaaaaatcagccaggaatggctagttgatagtcctgaaaagacaacatcattgctgaatcatatcttcaagttgaattatttatttttgaaaaaacctttctatagcatcctgagaaacttatttcttattgttgttgcttttttaaaaaaaaattgagatagaattcacataccatagaattcacttaccataaaattcaccattttaaagtgtccaactaagaggtttttagtgtactcacaaagttgtgtagccatcaccactatttaattccagatcattttcatcaccaaaaagaaaccccatacccattaggagtcattccctagtcacctgtacccgagtccttggcagtcactcatctactttctgtctctatggatttgcctattctggttgtttcatatatggaatcaaacaatatgtggccttttgtgtctggcttcctttatgtagcctaatgtttttaagattcatccaaatcataacatggatttgtactttatttctttttatggctgaataatattctatcaaatgtgtatgatacattttgtttattcattcatcagttgatggacatttgggttgcctccacttttaggctattatgaataatcctgtgaatattcttgtataaatttttgtgtagacatatgttttcacttctcttgggtatatacctaggagtggaattgctaagtcactttaactttttaaacttaaactttttaaagtcagtttaactttttgaggagctgccaaactgtttgccaaagaggctgcaccacttgacattcttaccagccatgtgtaagggttctgatttctccacatccttgacaacacttgttatgtttgtcttttttattacacccatcttagtgggtgtgaagtggtgggtttgatttgtgtttctctgatggatgactaatgattttgagtgttgttttatatgcccatggctgtgtgtatcttctttggagaactatctattcaaatcctttgccatgtttatattggattatttgtctttttattgttgagttgtaatctgaacattagacccagatcagatatataatttgcaagtaataatttccattttgtagattgttttttcactcatttgatggtgtccttcaaaggacaaattttttaattttgatgacatccagaatagtcatttttcctttggttgcataatacagtcacaaagatttacacctatattctgttttatagtttcagttcttacatttaggtctttgatccattttgagttaatatttgtatatgatgtgaggtaggggtccaacttcattcttttgcatatggatatatctagttgtcctggcaccatttcttgggaagacttttcttcttgaattctcttggcatcctttttaaaagttgatttacttctgatatatgagtttatttctggaccctcagttctgttccattgatctttatgcctatcctttatgctagtaccataaagccttaattaactgtaggccttatggtatgtttggaaatcaggaagtgtgagtctttcaactttgtttttttttcccaagattgttttggctattgaggctcccttgcatttccatatgaattttaggatcaacttttcaattcctgcaaaaaagccagctgagattttcattgaggttatgttgacactgtagttcaatttggggagtatagacatcttaacaatctatcataacctcttctatctatgaacttggaagtttttttcattttcttttcttttcttttttttttttttttgagacggaattttcctctgttgcccaggctggagtgcaatggtgcaatcttggctcactgcaacattggcctcccaaagtgctgggattgcaggcatgagccactgcacctggcctcattttcttgtctttaatttctttcagtaatgttttgtagttttcaatgtacaaatcttacacttcttctgttaaatttattcctaagtactttattctttttgatgtgagtggaattgttttcttaatttcatttctggattattcattgctagtgtatagaaatatggttactttttgtatattgatcttatggcctacaatttgctgaatttgtttattggcttttatagttttgtgtatttgtatgtgtattccttaggatttttaatatgcaaaatatcatctgcaaatagagacagttttgtttattctttaataagctgagcaccttttatttcttttttttgtttttttgagacggagtctcgctctgtcgcccaggctggagtgcatggcgccatctcggctcactgcaagctctgcctcccaggttcacgccattctcctgcctcagcctcccgagtagctgggactacaggtgcccgccaccacgcctggctaatttttttttttttgtatttttagcagagatggggtttcaccatggtcttgatctcctgatctcgtgatctgcccgcctcggcctcccaaagtgctgggattagaggcgtgagccaccgcgctggcctattgctttttcttatctgattgctggatcagttcttaatcatctttaaattcccaatgatttgcacagaataggtgctcagtaactttattgatgaacttcggtattaaaaatcagtttttatgtaagctgcagtttcttgtatttaatttgttttattctttatttggcctctgggcatgttgagaaaataggaagatttgcttgcttggtctttagttgcaaaggaagttagtggaaatgtttttgcatttgtaaatgggttttagatatttgccttgtctggccacggtgcttggtagtcactcaggaggcttagagccaggcctcgtgtgttctctgcaaccgcaaaccctttccaagctgctgtttctgctggtgagtgtggctggtgttttggttgctttctatcaacattgccttgatttggtccccacaggagactgctcacttcttgacaaaaggtaattattgagattcctggttttcttctcaccttgtaaattctcttgtttttgttttttggcaaataggaatgaggtgtgtttactactggagcatcgggctgtcagaacccgtagctttggtttgccttggtcgcagcctgccaggttgcatacttttgatttggaagaggtgccggtgggtgtgttcgctagcaggaatcacccacagtaaaaatcatgggtaggagaaatggccgttcaccttttcccatcttccttccttccattgtctacactcctggtcccaccttttccttggggactgggatgcttatgctggaacctaatcagtgtccaaagcttaaaattctcctctcctcctcacttttttcctctttgttttctcttgactttcattgccttggtctatttccagaccctccaaggcctgtgttttctctttaaaagatcctgttccatccagaggagactcaagagtcccactttaatttgggattttaggcagaggccttcctgcatctctcaagtcacacttgcaagcgactgctttggtgatgacatttaaagttggcctcctttcctaccactctgactcccctcaattttctagaactgggtttattgttctatattttaaaattgatttattatcttctatagcaatgttggaaggagcttaattttggaagtgcacagttctctttatggtcaaagcgaagtaaaggagatttgattgatcttatgacaaaattgctttagtcatagctgataggaaatctcttaagggccctgttttatttgctcttttaatttatgaaccttcttggatccttcaagcatctgtatactaagccagtaaggccttatctggaacatgcaggcttcatttttgcccctaatatgccatgaaatgctatagggttctgatgctttgttagattttggtgtaaattagggagtaacagtgtcagcaaatgtgtatttcagaaatttgttaatttttttttccaaaggaaaatgtactattagctggaataacctggcagccatagggcgtacattagacctggaagtaaacaaaatgacccccaatgaagtagaaagtaagctactataaattatagcccattttgtttccctgtaggtcagggccatgtcatcctcaggcttccagaaaagaccatgttgtgaaataggaacaacagagacccagtgccctacagctaaggccaatgggagggaggggaagagaggagttagaccagcttagaagggtgggggcccccttctactctggaatccttgcaggtctcactaagccacagcagagcatgtttattgatgttaggttggtcattaagaatagtcaaaatcagcgtcctctgatttggtgcgctgggatgcacgtaatccactgaggatagtatccatgaaaatagtttttgaactttgctttataaattttgatgagcttgagttcactgagaaaattaatttctgtagaacaattccttcatttaatgttggcccaaatgaagcatttagtatggaatttgggccttggtggaattttctgggacacgtagcctaatgtgaggacaaccattgctgagcagtgcgagggaagggaggattgcctagtgagtgactggtgccgagcaagaggcttcctgcttgacctctgaatactctggcgcttcctttttggggtcaggaagcttccaaatccagagatccccctgtttgcagttcttagttttcctctgaaacccccacaccagactgagtgtgcctagggttgggactaggtattacttctctttgaatcccaacatgatgcctagcatacataattctcagaaaatgtttgttgattgtcaaggtccagctaatcttgttgatttgtgatttcatacctttttctttcaaaggattgctgtatgcctggaaataaatccattttggtttgcaaaatcaaggttgtcgtgtcatcctttgaaacaattagagaagcaggaaaatcttctaaggatgatcgaaatctccactctataaaccatcccaattaatatctgatttcttctttgaaaaacataatcatatcctttcttctgtagaaccttccctaacactcctcatttatcagaacaaatttctgaattcttgaagcaattagtttttgactcactttatgtgtccttttttatccatccatctgtccatttatctgtctctgtccatccattgatccatctttgggacagacctgggatgtctgtgctcagaagcagagtgctctacatctgggaagcacagtggtcgtgcccacagctgtcaggctccttgcatgctgggctgtggtcctggcttctcttgtcttctgtagagtgggagtctcaccaaaggagggcatgggagggctagcttgagtcaaggtgcgtaagttggaacattgcagatggggttcagggtacccagggttgtccctgtttggtcagggcagggtcagcaaagctccagcctgtttttgtatgcaaaaagtgtaagctaaaaatggtgtttatggtttttaggggttgtaaacaaaatcccagaagaagatgcaacagagaccgtgtatatgcaacctgcaaagtctaaaatatttatcatctgctcctttatagaaaaagttgtcccaagcctggttagagctctgagtgagtgtgggtagatctgtctcacagatctactctgtcccagagtctgtctcagctaggccagaatactgagttgtgaggaaccttaaagacacttgtctagtggtctgtaggacgcatggccctgtttagacattctgcttggtatggtgacccagggacctgctgctggtagaagcagccttttcttccccaggaaatgtatactaaatgaaagcaagtactttcaccttttcctctgtggtcccgattttacctctgaggtcatgagtaagtccaggtgacaggtgggtcagagctggattatggagggctgagcatgtcagttggaaattgattcagaaggttgtggggaaatattaagggcttttgcgtaggggagtgacatgagcatagctgggcttaggaagtctggcctggcatggtttgggatcctgggggagatggagcaggctggaaaggttaggggcagggagaccaataggaagcattggccactgccgtgggaagtggttgtaggggtctggattagggcatagggaatacaaaggaagggacgtattccagggaagttaagtggcaactcctcatcttctagtttgtgctgtcaccagggttggttggtgtgtggctggcacactcaggccggccttcccccttcccttcctcctttcatagagcaactgctccataccaggccgtgggttctgcggagttcctgcctggaaggcgcccatgagctggaggaaaggagaaacaatggttctgccagggaggagatgacattggataagctccttgaaggcggaggttgtgtcctgtgtgctgcctcatgcgagctagtctcaccctggggcacgtaagaggggctcagaaggtcagttgtttgaagtcccacagctggctggccacgtagacgataatgctgtacaccagaaatcaacattataataaaactcttaaaaatccaatcttatctctacttttaaggaacctaccatttacaaataaaagatcacccacttatttattcattcagtgtctgttttctgtaaagcacactgtatggctgtgtacccttatgcacagtaattgccaaaatgcctattgcagggagcggggtcacctccctgaggccatgcagaactcggcatgggtctactttccgcccctcttgagcttttatttccccaaatacctttgcctcatttcttgatctgaggatgttccataatgacttcaagggcaccttccagcttggggattctgtaattttaaagtccagcttgctgaagggctttgtggtaaagggggagttgggaggaagcctcactgaggttgtcctgctctggatgctggcctctgcacaaaggtcctttcaggctgccgtggggaggactgtcctatgtcacttcttcttccctcttaagccctggaggggaggacttgggaaacaggtcacagggagcctggaaaaacaaagaacacgccgtccgtccactcaaaacattggcaatctagcaaacggtgtgctcttccctggcctaacatcatcggtgtgtgatctctctcccagcactcacccagggaccagaaaggcgggaggtctggagagagattgcaggtggcttccttggtcagtcaggaggcattcccttctcctgcatgctggaggggtgcaccatgggcctgggataggctgttgtcagtggagcagaggtgtcgcccagccagaagggtaagggagctcagatccagtccaggtgttcgggtcctgctccctggcgagaaggaagtatgtgtgagagagtatttcagatcctcctctcctgtggctctggaatcctgctcatctgccatccggcgtctccagccctgctgtgcttgagaagtcttcatttctcactagcagcctccattatctccacttcctccattatccccacttcctacattttcagggcacttggcctctgctgtaccctcagcccccaatcctaagggcatgtgctctgtgaagagggggacttggggttgtgcgcccctgtgccctgcagtgcctgatgcatgagtgttgtgctgaccctccctcagtgtcgttcagcagtgagcctcctctaaagcaagttcaccatttacacggtggacttgtttcctgtgtttgtgttcttatttcctaaaaccgaactgcaaactcctgagggcaggatctcttttttctttttttaaaataagctctcatttgtatttatacttggctattttcaaacgctattcgggtgggacagggctcatgcacattttacagctgagaaacagcatcacagaggtttaacggctctgtaaaataagataattggtaagtagtagccctgagactttaaccaggatcttacagctcttgttcaatgaatgatctttctgtaacccagaaccagctgagtatttgggaggtcctcagtaaccgttttattgagttaaaaaaatatgtgggtaaggtatttgtgagtacacgtgcatatacaaagattctatgtgcttagaaacttctttgaccagcctcttcatttgaaaagggatttcaaggttcatatatgcattgtttgttgcatgttactttctttggaaatgactagtgaggacagataacttagaaatatttgcatgttacatcagaagagagttaatagtactggttactgttaatactagtggtattagctgttccagcaaaaggtactgcttatttataataaccagataatagcagcgagatcggagaggatagtctagataacattatgagtgtatctataattataattgaaatggaatgggggtgaatcttttaatatgaggttttaagaattctggaattttagtgtgagacataattcatggtgtatggttgatagggacatactctttggccatataaccttgaagaagtaataatcttgaattatttatcattggaatgaatcatccttttgagagaatcatatcttccttcagtgttaaaaatatacttatgtcatctgtcatggtgagtattccagttacaatgcatatttctttttttcacatcctgcctactcacttggtgttatccttgagaagagaaagatttgagatgatggctaagtggttcccagtctttgagtctataatcacattccctgttttttcgcattccttttggttgctatgttttggtatttggtctttggtctctttctttggggaagagtgattgggtggccacaggaggagtaaacccatttgggagctgatagttgatgtatttttgttatgcttggcagagtgagcggcccccatcttcctgagcagagttcatgtgtgatatacaaatgaatggtctctttccatctggccgtcacagaggcaagaaactgtggtgcctctggatcattgaatttctcagactctcaagggacagcagaatgcgtatgtgaactggcatacccaaatgcaaattatttctggtgatacctaatatatgtaaatgtatgctgctcagttggccaagaaattatgaacggcactcttcctaaataatgctatataactgaaattttagttttattgtcacaatagtgaagtgtgttgatagtcctatttcctgtcaaatttctgtgacatttccagcagcttcaagcacccctcacgggccaactccccagaggtggaagatccggtatctcaggagggagtgctgccgggctccattccgaaagccacacctgccttgttaccacgtagggatctggcagttgaaggctaggggcggaaagtggacaatcaggatagagacaggactcggcagagaagcggagttttagtacagatgtactaaacatctgtacagatgtggagccccccccgcatcatcacacttaacttcaggaacaaagaaacccaacagatttaaagatagtagggcatacctgcagggctggtggcggggcaggtggccggtgctgcttccatggtggacttcgcagttgccctggggatgctgacccctggactggactttgctcagtggtgcccgccacagtgagcctcagccccacctctgttgtcttcaccctttgacctcacttgagcctggactgagggatttcccctgtcgatgaaccaacctgagtactgtgcatccagcctctcactgagctgggaaccaggggcagctacaaaggagacaggagaaatagccgtcccccttgggcactgctggcctggcaggagaggcccagcatgtgtctagggaggagcggagcggttgtggccagcattgagctggctgcttttctgtaggagcctgaatctcagtcgagcctggaaggacatgcaggtgttagggagccaggattgcctgcgttaggcacggggctgggcacacagagcactggagggaattggttgagtaagtgatggagtagttgatagcaaagggagactggagagagcattctgcagggggacaaagtgcctgagcctaagagggggagacaggctgtctggagaacatgaagcaagtgcctggccctggaggtgtgtgcccctcctgtcccctgtaaattgtgggtgggccaggctgttgggggcatttgtgggcctggagtgatgctgatttctgcagccctggcggttgtcagtgtgggctggggtagagatgtgtgtttgtgtatggagcaaggaaggtcctagccttgctcaagaggtaaagaagctgctggttgagaacagcttcatgaattctgcaagaagagatgatgatgtttgcttcttttacatactgcattaaaggtcccagacactggggcatttgctgatgtcagtaaagagggagtcctggatttctaggcactcacagtttcagaataaacacatatgtaaacagctgattaccatatggtgtgataaatgtgtcaggatacagaggcagttgctattggcaacaccaaatcagtcataaccttcaggagtgaacagggcttgtttgctcagggtctggccagggacccagaggaccagtgttggggacccagaggggctgcgtgggcctgctgccactgcgagcctgtgttacaagactgagcagtgcagccgtgactctggcaggcgagtttcccaagccgaggtttctggaagccacagcctgagcccagggcctggaacctgcaggcaaaaactgtgctgagactgattccccagtggtcagccccacagctggactgcaagctgctttccctgggcagactcagcctcctgcaggaggggtgtgggagggaaggagcagtatctgtgtgcagacctgggttcccccagaactgagatgctggatgaggtgcctgcatcccctgagctgcttggcgaggaggacggtccatgttttccatcacagctgggagtaagagcagatatgtgcaaggcaaggacgttgtttcaccttttgaaggaaggttgttaggaaaacgcctgcattttctaatcactggagaagcccttttaagcagaccagatttataagggttttgatgaaaacagtggtttgggagcagcaatgtctttaatagcaacaaagcccagagatggggtctgcctgcacaggagcatgggccagggggtcctgtgtgacctgggaggtgtgtgagggaggccctgggctggttccatggcagggcacagtccagcttcttgcttcctggcagcacaaacccctgcctgtttctggcggggagatgctgcccaggctcggctgctttgcggttctatgtcggtcactttccccaggccacttccttcctttttcttcttatgccagcctgggcaagaggaatttgtgcttcctgccagcaggatggatgggggaaaggcagtggctgggtgtttctctctgctggaagggtttgctggggtgaatcctttcccttcactccctcctgtagccaggaccttgtcacctccagggagcaggtgacagtttccttgactcctcaccaggttttcaggctctgccctcttcctctccccagccaagcttgcctctgacctcagccaggaggaacttgctctagggcttaagtcaggtcacatctaactttaagacccagttttagcatctggtatggaggcaacagcctgggctttgacagacttgggtttgcgtcatgactcggtacctgctacccgttcgctgagatgccagtgagcagtcgctggtcatgttacatagctgccacctcccggaggccagctctgttgtgtgtgcatgcccattgagatgcccgggtgccgccacacccctagcctgcgcctgcctgttcttcctcctgtcagagggccctgttcttgctcatagactcctgcacagcagcgggcctgtctgtctgcctggcccttgggtgtccctggcatctgcatgctgtgttcccatggtccttctgctagttggagcccttgtgccatgccttcctttggagactctcctctctgtgccgtctcgcatgccatccttgaggttttagctctgtcacctggcagcctggcccttccctgcagcaggtgaggactgagagctgggctgtgcccctcccacccacttgacccagcggacactttgggaagtggcaaccataagtctgcctggcttgctccagttgcccatcttgtcctgtgagtgaagctcctgcttccatctctcttgatctggccccttctctccattcctccagctgcagtgggtgcccctgtcatttgtcagccagagcattcaacagcctctgctcccactgaggtcatggtgattgtcttaaagatttgctctttagcttctcagctgaagacacgttggtggcttccctgaccttttggaaagtaaccagactctgggtccttctcctttgttgacctggcccctgcctccctcccaccccatctcatccatgcctgtcctctgtgtcaacacgcctcactgccctgcgcccgatccttttacacaggtggtccctctgtttgtagagtcgccctgctcttcgtatctccctgcctgttctgtgaagttcagcccagtgccccttccttggaggccacattagagggccctcctctgctggctttgtgcccccgtacccctttcgcagctgactgtccacattatactgtctgtatctgttatttactgtctgtctttgacaaactatgatcttggaagtgcagagaacttgtctgatttgtttaaccacctcacttagcacataacttgtcatatttttaatttattttctatctccccttctccccattagatcataagcttcctgggggcagggatttttgactcttacttagtgatgcatcctcagcacccagaattgcactggacacatcatatatgtttaatatgtgtttgttgaatgaataaaactgacaggcaactacagcttagattgcagggagtgagacatgctgttgccggagctctggtgtcattggttcatagaaagcttgtttctctggccatggggacttgattcttagagggtaatggttcgaaagttgaattagtgagtgtaaatccttaaaaaagtaaaaatatgtttgtgcccttgtacagaggggctgccttgcccttctggaagaaggaattccacgttagacgtgttcccagctgcagttttgttctgtatctattgccagcaggaatccaaggatttcctttattatttccaaattgctgcctcttaggaatggagaatgctgccagtctgtgctctgtgttttttttgctcagtgggaccaaagtagttttgtggtagagagatacagagatacggctttgagacagtttgagtcatctaattactgtccaggagggctgggaggttaaccctggtggttgctttggtgatagtgatcgatgtctgtgtgacaattataatgaaggctggtattatgccgggactttgaagagtctatcagatagtgaaggaattgcgaagccgtactatgttgaggtctccagaataaacatcctcagaatggaaggtccagatgagaaggttaccttgatgagaggcctttatgctttttgtgctattttcctttatgggctctggtagttctttagtgttttataatctcttttcagagaaagctttttgtaaattcttcagattttactttttaagtaacacttacaaaagttgtatggtggcttgggaccaatacactttgcaggaaatgcagagatggataagaaatggttcattcccttcaggacctctcgttatagcttagcctatgtagtgattagagcatctgctttgaagccagctggacctggactcagatataggttttgctaattgatacctgtgtggccatgggcaaatatgctcatttactcatttgtgtttaacaaacacttatattgcacttactgtgtgccaggcagtaagtgcttaacacatgttaaatggatttaatccttacaacaaccctgtggctaggtactgtcatcatccccatgtttaaagaagaggggagtgggctgggcatggtggctcacgcctgtaatcccagcactttgggaggctggggtgggtggatcacctgaggtcaggagtttgagaccagcttggccaacacggtgaaaccccatctttactaaaaatataaaaattagctggtcgtggtgacaggcacctgtaatcccagctactcgggaggctgaggcatgagaattgcttgaacccgggaggcggaggttgcagtgagtcaagatcgcaccactgcactccagcctgggtgacagagcgaagctatgtctcaaaaaaaaaaaaaaaaaaaaaggaagaggggagtggttcacagaggtgaagcaatgttccctgggtcactgagcagagaagtcacaaagcctgggcactctggctcgagttcatttttcttcttgacgctatttgtgctgcctctcagcttcctaagcttgagcttcctaaactgtaaaatgggaggcagcaataaccagactgcctagagacaggctggtgtgagaattcagtgagaaaacccggggagaacatttagccagagcctgtcgcatggctggggctctggctagtggagggagaggagacagcacacagattgcaccagaacaaggtaatggcggcgcgtggccttgcaggggccttgataataggaggagctcagaagcagggagagatcacttcctgctggggcagctgggacattgtcatgaaagaccagggaggggacagatgggacatctgggacttcacagccacctggggaagtgggcactatccccattgtgtggatccagaagctgggctgtttctaatcagttaaaatgagtaggtagagccaaggtgaaggaagatggatttactcagggttcagttggttggactgttgaattgagctgggggcaggtggaataaagtctggtcagccactctggggccgatgcacaggggcccagcctggagcccacttccggccttgcgaatgcttcagtggctttgcatattgtctctttgttctcactctttagaaatgttctcccacaccttccttccagtggatttctagaaataccctatttttcatgactcaccaattgaacacatcctgtttggggaagtgataagagaggaatttgagaatggcatggagttgactcctaatgatgactggtgcaaggagtagacggcccagccttctgcttgctctgcctctcacctgtgtctccagacgagctgaatttctccaagtgccgtgtttcactgtccccgcccgacatatgccaactggagcttttcctgtcctgttgtaggcggggatctgtgtgtggctacagagtgactaatggtagaattaatcgagttagagatggggcctgtagttttgaacctgatgagttagatgaccttttggaccacacagatggctggtcgtcctgtgcaccagtgtggcagggatggagcttgtgccagctgccccgggcagagttgttttctttttaagaggtagccaaggcagccttgcctctcaggacccagccctggtgggtggcaccccagcccttccctttccagggctctgattttcctcatggcttgctgttatttcactcgcagagttcagatgttgttcattccagcagaggccggatgtgtaaatcatcctgcagcagttctgtcttgtatggccggaggctccttggtgggctgattggaaagcccagtacattagggagtgaagggagtgaagtaaagagaaatggaggagggagaactggagctggggcacgtgagctgctgtggtagcgtgcgggaggcaggggagttcagaccacgtctcggggccaggagtggctgacagctgaggtgtcgggctgggtagggcagagtgagccgcatggcctggcagctgtgatgggaacatgtaagaagtggtcaggctgctgttgttttagatgtctgaaccctgagggtagaactcggagaacttggttggtggatgcagccggcaatgccttcccatgaatggcaagggcagtgggcttaggcagatggagctgctccacctggcagtttagcctcccaggggacttctggcaaggtccggagtcatgtttgatctgccaggactggggactggggtgctggtggcatctggtgggtggaggccaggatgctactacacatcccacagtgcccaggactgcacccaccacaaagaagtaccttgtcccaagtgtgtccgggcctgatgttgagaaacgctgggtcaaaaggcttcaggtgatggtggacttggagggccggtcagggagggacaaagggatgtccttggcacctggactgctttggggcccctgtttcctgctcttggtgggcctgagtctctctgtaagttttgcagtatgaagttgacctggatgtttcataagcagaggcttgtaggtaatcaagtgccacgaagtaaagatcatttcgggccacttgaatatattaagttcgtcgacatcttcaaagagttagattgaaatgctgatcctcttatattcctgacatattcttatccttgcctgtattatttttttctgttttttaacctgtgttgtgcagtatgccagatgaactttttagggtgtatattttgatatcttacttttatgaagattaataaaattaaaattgtctctgtactgatgtaaagagcttgaacttaatttagttttataattgtctgtataaacattcttaatgtctaaagaggattttttaccggagaggcaaagggaaataaaaacttgataaaatttaaaaaattaaaagcaactgttatctgttattgtatgtatgtatgtgtaggtggttgtgtgtatgtatgagagacacagacagtgcattttacttttttgttttttaaagatcctgcctttaaatttggaactataattatttgtcagcacagttaaattttttttttcttgcttttctttctctttctcctttcctgtgttggagcaaaggtgctgtgtgttgtctacttcaggtttcttttttgagtgaatgggacaaggacagggcaatatctgagtgtcagaaagatcccccccgaggctggtgtgggtaccaggcagggctggggtacggagacgggcaggcggaccaggcaggggctagtgaaggcaggacgaggtccaagttgaggccatggccaaggggaggggaaggcaggaacagcttggagaaataggcaagagggacaagtctctgacctcttggctgtgcgggctgggaatccaggaaaacactggtttctggcttgagtgagtggaagcttttttaaaaaaagagagttaaaaaaaaaagccctgttttgtacacattttgatggttaatgttgctttctgacttttgcttttcaaaaagtgaaaatggaaaagtttaacagggcctcaactcctgaggctggattaggacatttctcatttacattgtgacttttagatgaaaacataattgatacctttgaaaagattaagatggttctgcctattttctgaaatttaggaagcacccactgggtcttttggtctttttttttttttttttgacagattcttgctttgttgcccaggctgggatgcagtggcatgatctcagctcgctgcagcctcgacctcctaggctccagcaatcttcccatcttagcctcccaagtagctgggactacaggtacatgccaccatgcctggctaattacttttatttttattttttgtagagatgagggtctcagtatgttgcccaggctggtctcaaactcctgggctcaagagatcctcctgcctcggcccctcaaagtgctgggattacaggcatgagccaccgtgcctggcctgctctggttgaaggctagattctgagcgaccaggagactgagtcttttcttgctcacctggtggagtacattgtatacagtaggtgcccatgtttcttcttttgatttgcagagcagttgtcttgaggaaaaccagtgagatgatcccatctcttcccatgattttgagagtatgatctctgtcccaattcagaagagccctgaggtgaggtaaagatgttagaggtgagtggcattctgtgtctgacctgtggctccagtgtgtggatccgtgggctggcgtgtctcacatgtgtggactggggtttccctcttccacagggaggtggtcagtgtgtgggaggagccatggctctggcctccgactgctggggtttgaatttagggtgagcacttactaacactgttagctgacccgctacctactgatcttcacacggatgagcttattgatggtgcacacagatgacaggtttagattgtatgctggttccttgtatttgttctgtttttaaaacctcagctcctctagtctttggtagacactcttatgttatatcttgggcaacttagttcctctttctggagcctcagtttccccatctgtaacaccagagagctggacttaggggaaccgcttgatatttgacaatactccaggcttttgtaaacaaattgtccacagctttgctgagctacagccacatccgcttgaaaaagcattgtcttaccagcctgtgcagaatccagatcactttcatccaccttcccatgggggctgctccatcccttgtcttactggaaatgtctttctcaagggtcttttctggtgtacaggtctccctggagatggaaaaccatagcactggtttaagtacagtgttttgtttgcatggggaggagaggctgaggcaacagcctgtgagttcaggagtaataaggtgtttgtttccctttttggccagtttttttttggtggcataatttacatacaatgaaatttaccctaagagtacactttgatgaatcttacaaatgtacagttgtgtaatccccaccattatgacctaaaacaccccgaaagcttccctcttgctaacctgactgacttggtggttctggtggcttttttgtagattgcctggcatttctacatagatgattttgtcttctgtgaacgctgtttgcctccttccttcctgatctgtttgcctgctcctgctttctcttgctgtactgtgttccctgggcctcccgcagcctggaggggtagagaaagagtggcctcctgcccatccctcccagcccctctctgtcccgtggcgttagcagcaagcgctttgtagctgcctgttagtgggttgccttctgttcctagtttgctggtttttttgtcatgaatgggtgtttaatttcatcagatgctttttccgcactgactgagatgaccatatggtttcccttttttagcttgttagtgtggtgaattacatttttaacactgcaactactctttggtgtggaagccttatgtgtggggtaagcacagatttggtgtcatcatgttgggatttgaggattagctgttctgcacttcataaggatatagtacattcagttattgacagcagctaggctgtgtagtcactcctgtggggctgatttgtttaattatgattgttgacctttttactctttcattatattttgggtagaatgaaatcatgtgtgtggtgatggaggggtggtggtggggggagataataacaaactcttctgtagcctgaactcattacttcttataacccataggtgtaggtaccattttctttattttatgaatgagaaaattgaggtccagcttcttggaaggtaagagaaatgagtcccatttcccctaatattaaccgagcaccatttatgtgccggccatttggacccatctaaggggcacaaaaccattgttttttgttgttgtcgttgttgttgaaaccactgtaatggcagcatctttttttttttgttttagatgaggcctcactgtgtcgcccaggctggtcagtggagtggtcacggctcactgcagccttggcctttctgggctcaagtgatccacccacctcagcctcttgagtagcttggactccaggtgcacaccaccatgccccagtaatttttttgtagagatgagtttttgtcatgtttaagtgactttcccaaggccttgtagctggtaagaaggaggtcttctgtttctaagttgaattcttttccctgtcctgctacttttggggtggtttatggaaagaaattaagtcagggtgaaaaaactagtcaacttcttagagcaatgtagataagattttcacagttgatcttcacagacttatctaaatactgaagccccattatccctggggggtatgttccaagaccctcggtggatgcctgcagccagctaatattgaactagtttgccttcaatcacgacatgtctctgttcatgtcatgtcttcctcccataattttttttttttttttttttttatttgagacagggtctcactctgtcacccaggctggagtgcagtggcgccatcacggctcactgcagccaccatttcctgggcccaggtgatcctcccacatccacctccccggtagctgggatcacaggcatgcaccaccatgccaagctaattttttgtagagatggggtttctccatgtttcccaggctggtctcaaactcctggactggagcgattcacctgccttggcctcccagagtgctgaggtttcaggtgtgagccaccgtgcccagcccctcccacaagttaatgatttttccatcataactaagcacttgccacgcaccacggccgtagcttttgcagtttgagatgtgaaggcaaagctagcatgagtttatttttttcttctttaccatttcatgaatagaagacccacttttcccttagatcttagcaacctcagcataggaatttttccttaagtcaaggagtttcatctttttacttaaaggaagtgctgtatgatttctccttggcatatctgcattaccagcatctagggttcttgtgctctgggaccattattatgtaaaaaataagggttacttgaacacaggctctgcaatactgggacaatcatctcataacctaggcagctactaggtgactcatgggcaggtagcatggaccttgtggttctgccagacaaagggaggagtcacgtcccgcgtgggaggcaggacggtgtgagatttcatctcttgacatagaacagcaagcaatttaaaagttatgaattgcttatttctggacttttctgtggaatatttttggactgtggttagtggaaactgtggaaaatgaaactgtggataagagggtagtactgtatctggatgagtccaaaaacacattctaagatgaaatattattagctcacatatttatcttttaggatacaatctttcttaatttagcatgtgtgctggaagatattttgtcagtattaagtaatgctgcagaattttggttgaactgttgtgcatgtagaacattaattctttgttttcctgatagtttttggtgagaggttttctgggaagtcattgtcctattaccactttgcatgctaaactggtgcgattatgagttccttatccatatcagggttggggatgtacatacatacatgaaaatcaaactggctgggtgtggtggctcatgcctataatcccagcacactgggaggccaaagaagcaggaggatcacttgagcccaggagttcgagaccagcctgggaaacatggcgaaaccccatcttttacccaggcatggtggcgccgtgatcgcaccactgcactccagcctggagtctcaaaccaggctcaaacaacaacaaaaaactaattgctttaagtaaatgttcatgcctcaccaaagatatgtactgtaattttcctattgtggatatgtatattttcaactcctccaacattagtgagtatatgccagacactgtgctaagtcaaggaaagcgaggagaaggaaagggatggcattttgatctggacctgaaaggttgaatctaataagtgagaagagaactcaggacctggcaggtggaggattacatggttgcacatgttagggtcccaataagtttaggggagcatgttagacagattaagaactttgttatcaggcggacacatgtgaatttcacacctggttttactacttggtaactgtacttctgggcaagttggttagcttcttcgagcactagtttcctcatgtgaagcaaggaggagaaggcataacatgtacctcacaggcgttcgttgtgtttgctatcttggaagagaggggggaggtctgtgctctgtgctggaatgaaactttttttttatttggccagacagtgatggtaggcattctttggaccgtgatcttaggggcgcatgctttggcggtttacagatagagatctgacctggtccatgggaagtgcagattcagttccttgctgacactgtcaggagctcttccatcacctagccttgtgccagcacactggtggtgcttggtaaatgtttgttgaataagtgcactaaggtttcactgtaacctctagtgatctgcttctagaagccttttcttctggtagggtcacacctagaggaattggatgctacaaactgtgatagacccagtaccatactctagctgctgtgtctagcttgacagggatgggcacttgcggtgccctcagcctggcttgaagttgacatcttgtattgggcggtgtgtgggctctgttccctgagtcttcatcctgaaactgctggggctgatagctggtcgcgggatcacctttcaaaggaacgcagtccagaggcctttgcttcctcaggatggattcaaggagagaatcctcagctgatcatcattttatcccattttttctgtttcctttactgttccaacttttctttcttttctcacctcctttatggaggaaaattgccgtctggggaagcatgatgctggggaagtaggttttgattgtccgatgattgtcaggtgagactattacacgtgttcagaccattgggtgtaagacattggtgcacattagctcctgctttgatataactgaggcccagtaacaacaaatttttgctcaaaaaaagaggcataagcagcgttgtgtgctttctttattttggcctaccctgcatgatggctttaagtattatcgggagaagaagcatacggattaacaaagatgtgtacttcactttccaagaacaggaatgttttgccctagtgagccttgaagattttttgttttgttttgttttgtttttttgagacggagtcttgctctgtcgcccaggctggagtgcagtggcacaacctcagctcactgcaagctccgcctcccgggttcacgccattctcctgcctcagcctcccaagtagctgggactacaggcacccgccaccacgcccagctaattttttgtatttttagtagagatggggtttcactgtgttagccaggatggtctcgatctcctgaccttgtgatccacccacctcggcctcgcaaagtgctgggattacaggcatgagccaccgtgcccggcctaaagattttttttataatgtgcatttttgtccatagattacaatcactgttgtttaggaactcagacggaaaatgtgactgagtcagagaagtaactgttaaaatacaactttgcttacaatatctgctttctgtacgtcaggcagatgaattgtattaaaatacttcctaggtctagtttggtggaaaccaaagatataactgtatttgcagggagattggagaatgagatagcgtttccacttacagaagcttgttttatcttacctagattaagttgaggcagaatgcatgtataaccagggcattctggtacgtagtcactcattcatctgctcatttattcagtagcactttgcttatttactatgctagttgctgaggattctaaatatgggccttccaggactcacagtttagttgtgagggaccgatataagtaattaggaaatagtgtagtaaaaatagccagcaatttttgttccctccccagaataaatgtgctgtgtgtgtgttagtttttatgaaatatgtatatgaagttttcttttgggaattagtgggaacatgatatgtatataaactcatcattaaaataatttgaatatcagctgggcacgttggctcataacgataatcccagcactttgggaggccgaggtgggcggcctataatcctagcactttgggagaccagtctgggcaacatggtgaaaccccttctctaccaaaaaaaccccacaaaaatttggtggcacgcacctgtggtctgagctactggggaggctgaggtgaaataatcacttgaacccgggaggtggaggttgcagtgagccaagatcgcgccactgcactccagcctatgtgacagagtgagaccctgtctcaaaacaacaacaataaaaagaatttgaatatgttcagactttccaccatacagtaccttagcaaggtacactgagattaggaataagttaaaatgcttgtctttggaagattaagtggatgttaatctaagcaaagtggattctgtaaaaccctgaaagaagtttttgagtttcacggtgtgaacagaacagagaacccttgatgagaacacatgcgtagctcctagcacagagtgtgcgacacagttaatgtccacgggaagagcttgacacaaacttaaataccaaacttagttcagaagcacttcgcattaagctcctgtgcctcagtggcctggcacttactggactgaaggacagaatcactaacctgggcttttactaccattgcagcccagtgccagtgacacttagggactcttccctgagcaccttcccaggtacccagaagtgtttgtaggaagaacaggagatggatttaatgtggatttatttacagtatatgagaatacatgatgtgaaggcaaacccttttcattagatcctttctgaggcatcataaaaatcatggttttatggtttttatgatttgagtctaagaaaacttagttacttagcctttctgcggagaataattgcttatttgacagggtgacacgatggtgtgtgagctcagttgcttttagccagcactacttgaagtcctcccgtcatataaaaggtaaaagtctgaatcatgcaggcctaggtttggttgtgaacttttacctcttactggtagtgtggccttgggcaagtcactttgatacccactttgtaggactgcggtaagaataatattgttattaatagagattccaggaacttgtagcttgattttggatgcagagagctgggctcctcccacacaggagcttctggtttgagaaccacagctagcaatggctttgttgaggagggtgttggtgtgactatcgaattgtcagtgccagtgtgttgctgccgtggctgttgcatttgaatgggctctggagacacctggggtgggtgggggctgcctgacacggagccagcctgcctggccacttcttcggctctgtgcttacttgggggcattcactgtgctaggtgtggagggttctataaaaacaaaccctaaaagattagtcatacatttactgttggtcatttctcaaagtgatgacagttaccttctgtaacctacacttagtttctgagtctttttggtgtgtgttgctcgaatatcactatacatcttcctgacttctgaatctaaaagagcaccactctttctctttgtttcttcagtcagaaaatacctactgggtgctggtgctgcgtttgtgaacagagcacacagaaatctgggcctgggggcgcttgcaggattctgcttgctttccttcctcccgtctctgcagtctgacgctgtgtgccatgcattagtcggttcgtcgtctgcctccactagagtgtcatggatgctcctgggggacagagcctttgttttcttcgccaccagatccccagtgcccagagcagtgcctgggacagaacttgttctcaataaatagtttgttattgttgttgtggggcttggatgcaagaggagtgagccccacatttgattatataataattaaaaccttaaaaacaagcatacgatggggatggctatctaagtttagaaggttctgtgaaaaggacaggagggtggtgtgaccccgttgggggaaggagctctgtgttgactggcaggagccctggtttgggagtgttggctttatccctgatcagctgcttgacttcaggcaactctttacatttgagtgaaaaaatgaatggggattctctgtatggtttctccaaacccgtactccttagacatttaaaacaggtggacggaaccaacttttcatttcacctgacttctcagtaaccacttattacactgagcaaactagtgtgaaaattttattttatttttaaattttttacagacagggtcttgctctgttacctagactggagtgcagatcatggcccactgcagcctcgacctcctggactcagtgatcctcctgccttgttctcccaagtagctggagctacaggtgtgcgctaacatgcctggctaattttttaaaacaattttttgtagagacggagtatcaccatattgcccagactggttttgaactcctgggctcaaacaatcagccttggcctcccatgccaggattacaggcatgagccaccacgcccagccccacctgtgtgaaaattgtaatcattcacctgtgcataaagttgcatcctgcattcagaataaagagaaccgtgagaggtcttcaatttagtcatctttactacaactttctttccttttttccttaatgctcttgatctttcttgtcacatctaaatggtttaatccattgtggctcgatgtgggagaggctcattcctgggatactcctggcttctacacaagcctgtgtactgctgcatgtggagaaattgtccaggttttttgttttgtttgagacagagtcttgctccatcatcaggctggagtgcagtggcatgatcttggctcactgcagccttgacctcctggactcaagctatcctcctacttcagcctcccatgtagctggggccacggtatatactaccacacccagctgattttttaatgtttttgtagagatggggtctgtgttgtccaggatggccttgaactcctgggctcatgcagtctgcctgccttagcctctaaaatgctgggattataggtgtgagccactgtggccagcctgtccagtaatatttttaattgaggagaaaggtcttcttcctgacagcagtctgtctgctcgtgagttttgacggcacaagctgcatggatctggtattggggtggcagcagctggaaatcctaatgaggatgaactcttcgctcctcaattaaggagactgacttgcccttcaccagaggctgctgtcttggaactgctcccagtccgcagatgcctagggagtcccagacggtccccggtcctcatttgcacgaggcgaatcagtttagcaatttgcctgcctaataggatattgccctcatggaccttattacctcatgcgctgctttcggtccatcgtctagctttttgatttgagtgcttctgtggatttgctcgctgcgtctgttattatagaagggtttttaaggcagccatgtggatgggcagtgggttccagggttcagatcctacctctgctgctcactagctcagatgtctttggtcctcagattcctcattctgaaatttgggaatgatactcagtcattaattaagtgaaacagcgtttagaaagcgcctaggctggtgccagacgcggagtaggtgttcagtgaatgcagaagctatttctgttattttttgcacttgctaacagttcctatccttagatagtctctgtctttaaacttcatgtgcctcgggtttaaaatctgctgctaaactcagctgatccaggaaactgccactttttggccctatttcccgctctcctcctctgccccccacactgataacctctttatgatgtatcctcccagctctcaggcataattatgctccacttatccagaggtcagacttttagcaacctctgccatctggaacatgtccaggaactggaagtcaacagaaaaggccttggagctcagctgtcctcgagtctgggacagacgctaggtggagaaggggtggctgatggaaggggggcggctgacagcagcaagagatggcaggtgacccagaagacgaactcagcagagcagggccatcagtgtggtggccagcagttctgcatcccacgctaaccacggaggccacgcaggcctgtgttccgagtgggaatctttggtgctcccaacaatactgagtatttaagccaaattatattcagcatttgttaataaaagaggaaaatacaaaatctgttttataaccaagatggtttttagaaaaccctttggtatcttggtgtcatttttttttttcttctgggtaattagtgtatgtgtagctctttatttttcaagcatggggaaaatgccagcgtagagaggatagaacacgggctttggagtcgcagtccagggtgtgcctcttgtttattctgccacctccttgctagttgaccccagtgagagtcagcgttttgggtctcggtttcttcctctgtaaaacctcagaggtgtgttcagaataaacacacctagaactaggcaagacgctgacggtgaggtcttagatacccaggccctggctgggcatgggaattcactgcttctactgtttactctgcttgtaactttcactcctatctaccagccatttggtaaatttccttacaccatttgacatgtaggttgtatatttcaattagatggcagttctttatggccagggaccctgtccctgaacctagttttttagtgtctctgaagtcttcctgatgtcgactctgatgtgagctcagtgttaggtggcaacgaggctggctctgtgtctacctgtcatggaagctctccatgtccccaaatccagaaggaggtaatttgtgtaaaataatgctgtcctttaacttgcgtaaattcctcccaacccgaatacataggatgctagaattttaggtctagaggagattttattttagcattctcctggacaaattgcatgttttgtggctgggctgggcatgtaggggctgagaggctgtcttgtggctgaggccacacagccagtctgtggtggagctaggctggccctcttggggcctccttagctccagtttctttcctctgtcagacagcaatggcctcatgtcttgttcttcctgctgcgagctttagcctcaaactccaccttgaatgtggagtgaacttggagtgaactttgtctgtggctcagcctgcccgtggcctgtctgtctgccccattctgccctcacgtctctagagaggacagcaatgccttccccatatatgttcatttctctgatgattgtagtgtctaatgggtttcattctgatgaacttgagcccctcacttgggcttgttctttgctctgatggggagtaatttgagggactctcatgacgccatgcctgctccagacaacccctaggagcttgcaaagattgccctgtaggaggaattgctgatgtcctgtgaataattcctgggaaggaaatgccaggctgacccatcacatagactgcatagccatgacttagcagggtggagcacccacactgtcgtgtggacagaaagttcacagcctgagtgagactgggcgctgggctgagattgctggcacgggtctcctggagctgcaggcaggcatgcccgggctggcgggggagctgcatgcactgccacccccagaggagggcagggccgtgtggggatactgcagaggatgaccgaggggcatgattagagagaggctaccctgaaaacactctgctaggcttccagatttttgttttgggctggtcctgctcaggatctgtgagaagtatgtaggaacattgggccaccgtctcctgcccatcaaaaggctacatgccatgtggaaggaaggcagggcttggggtcaaatctgggtatacaactcttcccttctttccattttcttacttggaatatttacttactcacttgagtttcagttttatcatctgtaacatgaggaaaataatacctacctcaattgctttgtagggtttcataaagctaaaataatacccatgatctccttgggggcagaaactgccaggatcatttttagcatttaacacgctgcctgacacaaagtggtcatgtaacatttgttggataaaactccacaaactgtaaggaatgttacacacatggtaattattactaataattcagcaaatggtatttgaccacagacttcctgcctaggcaccagggaaagaggggaaagaacacgacatgtgaatacacagctgtccctagggctcctggagttctcgcggtgccccaggtgccatgcatgactttaaagatgggagtggggatgcaggatgccagacatgtggcccttgggtgggaattgggaccccagatctttaatcacttaagccttgggaggtgtaaaagtgttttcccattccacagagggtacaaaaggatacagggcacattgcacggcccccagggcaaatgcagtgtggtgctctttcatttaagccgaggccacaagtaactatcggacaaggttggaagcagaaagcagtgagcacccagagaggaacaggagtaggctgtggagctcaggagctctgaatcagagccagggtggagcggaggtgtctcagcccctgagatgttgcagtcttcctgttaatctgccttgtggaattaagctatacctgcggggtcctagggatgtgattcagcacaggccaccatgggccatctgtgagcaaagtgctgagcccaccatggtggaaatacagaaatagacaagactcggggcttgctcccggggaacttaaaacagtgaactatgaaacgaggcgtggtgaaagtcaatttcttacagagataagatgggaacccggagtgggcaggctcaccaaggaggtggcatttgggtggatcttgaaaggtctgtagagtttgaattggagacagattagaggtgagaaaacacactgaggtgtggaaacccacaggttcttcagggaataagtggacgggagtggagcgtggagggctggtaaacagatcgcgaaggagattttgaaaggaggaacgtggccagagcgttgtcacatcaggagtttagtccgcaagtagaggtgggccctgtggctttccctctagtcacttgtcttacagagaaggggactgaggttgtgagggtggggctggcatttgacttcgtcccactccttcccatcttctgggctccatctgcttggtactcacgtgtaacagccttaggggacctgccctccctgtgggggcccagacctggggaatctggttgagtctggctgctcagtgggtctgggcgcaaagcatgtggagaaattgagaagctcgaagcagaacagctaatccttgatgtccatcgggtgggttttgtatgcttaataagtaaagataacgtgcattttacactttactaaaacgcattacctcatctgactttccttttccctccatcccagctggtgagttggggactcagtgacccttgggagaaggggaagggagcagctggggggcgcaccttgttgaattcatggggtctttcctggggaccttcggttttgtgatgaggaagtggagtggctggaggacatcagcgtggcaaatggaatgccttcaggaatgacgcaaggggaaggtggctgtggctgagggtgaggaacagctgccaggaaggaagactgaatgtgagtttcctggcagtgatggacggagcagagatgggcctgaggccactgacagggagctttaggaatgagaagcctgtgcccacattgcttttttttttctttccttaattttttttttttaattatcatctgtagctcattgaatttagttcatcagttatttgaaataaatcagatgtacttgggaagtactggccagtaggtgttagagtgttagcctgtacaaaaccttccctctgggaaatgctggaaggagagccttcgtgtcacaaaagccgttaacacacactgtgaggtgccttggagagaggtcactcaggccagggagggcaggcgtgcctgacaccagctgctaggactgcattggagtgaggccactcagccttgaaggtcaaagagcagatgacaactgagagtaattgatgaaccagggactgtaggaagagtcattttaaataaggcctttggggctgtgcgcagtggctcttgcctgtaatcccagcactttgagaggtcgagatgggtggatcacttttggccaggagttcaagaccaggctgggcaacatagcaaaaccccatctttactaaaaatacagaaaattagctgggcatggtggcacacgcccagctactcaggaggctacggcaggagaatcgcttaaacccaggaggtggaggttgcagtgtgctgagatcacaccactgcattccagcctgggcgacaaagtgagaccctattcccctaacacccccgccccccaaaaaaagccttcggaagacagttaaagaatttaggaacacggccgggtgcagtggctcacgcctgtaatcccagcacttagggaggttgaggcgggcagatcacgaggtcaggagatcgagaccatcctggctaacacggtgaaaccctgtctctactaaaaatacaaaaaaattagccaggcgtggtggcgggcgcctgtaatcccagctactcgggaggctgaggcaggagaatggcatgaacccaggaggcggagcttgcagtgagccgagatcgcgccactgcactccagcctcgcgacaaagtgagactccgtctcaaaaaaaaaaaaaaaaaagaatttaggaacacaagcagatagtgcgtgggcccaatcactggtcctacaccaagcatcttgactatttagttgttcactgcagccctcaaaagctgcccgtgcatccctaagcccaagccaatcccgaggcaacaaagaaacgaaagtcgttttttgttgttttttaaaaagtttttaaagtcagctgaattgaggtctactctgcaaacaataaaattcaccagtttttgtttttgtttttgtttttttaaacagtttcactcttgtcacccaggctggagtgcaatggcgcgatattggctcactgcaacctctgcttcctgggttcaagcgattctcgtgcgtcagcctcctgagtagctgggattacaggtgcccgccaccacacctggctaatttttgtatttttagtagagacagagattcaccatgttggccaggctggtctccaactcctgacctcaggtgatccgcccgcgttggcttcccaaagtgctgggattacaggcatgaaccactgtgcccggccaaaattcacgttttaaatgtgcagtttagtgggttttgtgaaatcgtctaagcaccctacagatgtaacgtagcagagtgccgtcacgcagaactcccctcttcagttggttcccccattcctgcctcctgtcatctctgcgctgctttctgtccttacaattttgcctttcttagaattccgtataaatggaatgatagggtatgtaaccttttgtgtatgattgcttttgcttgacctagtgccctggagattacaatgttacatgtatctttagaccactcctttgcattgctgaataatgttctgttgtatggatacagagtaagttcccccttagctgcattttactctccaaggtttcagttacctgaagtcatcccaggtccgaaaatagtacatacaacgagatattttgagaaagagaccacattcacataacttttattacagtatattgttggccgggcacggtggctcatgtctgtaatcccagcactttgggagggcgaggtgggtggatcacaaggttgggagttcgagaccagcctggccaatatagtgaaaccccgtctctactaaaaatacaaaaattagccgggcgtggtggcacgttcctgtagtcccagttactcaggaggctgaggcaggagaattgcttgaagccaggaggcagaggctgcagtgagcagagattgcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggggttttaccatgttggtcaggctggtctcgaactcctgaccccaagtgatctacccacctcagcctcccaaagtgctgggattacaggtttgagccaccgtccccggcctataaactaaactttatcagaggtatgtgtgtatagaaaaaaaaaacccagtatatacaggatttggtactgtctggtttcaggcatccactgggagtcttggaatgtattccctgaagataagcggtactacttgttatcagttcaccaagtgatgggcatttgggttctttccagtttttggctattatggataaagcttctatgaacatttgactacaagtctttgtgtaggtagacacgttttatattttgacttcgggaaatacctgagagtgcaattgccgtgttgtgtgctaagtgtgtgtttaactttatcaaatgctgccatcccattttccaaagtggctgcatcatttttcatttccactaaccacgtatgagagttccagttccttcacttcctcatcggtgcttggcattatcagccattttactgggtgtgtaatggaatcttattgtggtttaatttatatttccctggtaactaatgaaaccagaatcttggccattgtgtatcttctttgatgttatgtgtctatacttgtaccatgtaagttggttctcagatcatacaatgcatcatgagagtagagattctaatgagtattgaatgtctcttacctgaagggctgttcaggagaaatggactatttaagtaacaataatctgaaacaagattctgaaagatgtgctctgtggaataatattgcacatattcctagaagctgggataaatcattcacacagaaaaaactggaaggatctagcaatttacttaaattctcctatggaattttaaaaagatggcctcatattgccttgttactatggaatggttgatttgatgtaaatgcacactgcagcttaatgaagtagcctctctggttctgtgtgtccttgccgtggattcggcagatggtgtcgtcagagattatggagttcaagccacctagctttacagaggtgaagggaggtgcctgagttgatgaagggagtcgggggcagagctggtgccagcaccatgtggtgctccagaggttcttcaggggtctgcttgacctgtattgcttttatctttaaaatttccaacagttgttaaaaagttttctgaaaagatttatactctgatgtttgcatcacatagcagggaggtgatctcaccagaacattttgaagtcttggtaaacattgggctggggggcacaagatcgtctgatttatttgtatgcgtattggtaggtagcatgctaggcattgagggacttaagaactggggtttataagcaggttataaactacagtacctccagtgatctggctctatagcttagttgtttttaatgccctgttttgatgaaggaacctgtgtagacttaaagttgtagaatgaccagtgcgtcactatattttccctagtcattgacatatttgcacgttcagacattcatagaaatggcaggagaaaaactattctagggtcccctgcaaaaaaaaaaaaaaaaaaaagaaagcaagtaattctggcagcccaattaattcatttaatgaatatttattgagtgccaaccatgtgccagcttggggtgatgaagataaaaaattagcatgtcagtgggcgccaggatgttaaaagttggagtttagcacgagggtgtatatgcatgtgctgccttcacttaaatgtcaggcaaagcggcagtgtcaactgtgcataaagaaattagcgtttaacatgctgtgccaatgatgatgctgtccatgggctgagcagtcaatatatgtttcagatgcttcttgtctaacatatctgagataaggactgcaaggagatattagatgttgttagtggtagagagttgaaacaaatttcttactattccaaagcttttggattttgtttttaaaaaagaatgtggccatctgtttctatttacatgtgcaaatcagaattgtctctgtcttgtgtaactggaagagtattgaaatgaaagtgcaggccactggcatccaactgccaatttcaaatgaatgaaaacagcctcagtgttctcattgattccattttggggatgtgatggtatgcatttgagcaatttgtattccagcaagagacctttttaatccatttcctctgtgtgacagaggagttgggttttaaaaaagcactgaccgagagtcagtatgactgtctcttagccgcttgtcctgtccaccctcagtccttgttcctctccttcctgatcctcctgctgcagccaagggctgggagggggcagcacagctgatggactcattccaagtccttggctggagtgcctcctgcctgctaacagcctgtcactttcttcaggatgtgcctgtgttacctgctccagggtgtctttccctaacagcctgtcacagggcgtttggtagaaactaaagagcagcagaggatggtttcattcattccatgttcgtggagtgtttacacgtgtcgggcattccactggtgctggagattcaaaaatcagaaggtgcgggcccccatcctgaaggagtgacagtttgtccttgttccttagggttcagctaatgaagagtctcaattgccttgggaaatttgaagtctgaaagcagggactgttttatagtagtctcaaacagtggtaggaaggatatacctacttagtaagcattatggaatgaccataggtgcctaaaacttttccctgcaaaattaaaatagctttattttcttggtttattgtttcttaactttttaacaggagattaccttgaacaaactaatgaaccagtacatgatgtcggaaagaacaggctaggagaatgtgaaagtgtggttgttttgttttgtttttgagacaaggtttctctctgtcactcaggctggagtgcagtggcacgatctccattcacgtcaaccttcgtttcccaggttcaagctattctcctgcctcagcctcccgagtagctgggagtacaaactcacgccaccatgcccggctaatttttttgtatttttggtagagatggggtttcaccacattggctaggctggtcttgatctccttgtgacctcaagtgatccgcccgcctcggcctcccaaagtgctgggattacagatgtgagccacggtgcctggcctgaaagtggtttttaagcaaaaaaagagaatacaaaggtggcattttggtttatccttacctatgtggccttggaaaaatacctttgtgagtgttactttctatgttgttgcaataatattgcctgtgttaccaactgcccaggttggagagtcatgtgccataatctgtgtgaaagcacttttagaagtgctgtgcagttggaagcctgttattactgctacccccacaaccagtgctggtatcatcacatttgtaccctgactttggggtaggatatacggacatacacatttcatttctttccatctattttgagaaatctaagccagggaaatgcagtggaattcttcattaaaaattacctttggccaggtgtgggggctcacgcctggctgggtgacagagcgatacttcatctcaaaaaaaaaaaaaaatttctatgattaccagctatttatttgtaaagttgaaataaatgctattcacagtattgatagtaatcagtagttgttttttttttttttttttgagacttttggtcaggagtcttactttcctttaaaaaatacctcacatatgtttgaatgtaattgtaagatttccttcttggaaagataactaaaatgcaagctgttttaaaggtggtactttcatagaattttgtatctagaagctcagaggagaagtggctcacctaaggccccaatccgagtaggtgacagtctccatggtgcccccgccgccacactcatcttctcattttgcacaatgcatgattttcagtccccacaacaaatgcaaaccttcccgggtcctggggcagtgtggcttgagcaggcgaaacccccggaagctgctgactctcttgtggctgttgcaacttctttaggtctcttgaggaacagtaaatattccacagatcagcttcagagcagacagcattctggctgagaaacagatgatcttcacttttacttatttatttctctcgctctctctcctcttcacttctcaaactaaacatagcagcattacatgtagtctttgcttttaggactcagcattttagagtctgtaggtccatgctcctgattacagactggggtctgcagccctccagtgatattcctcggattgcagccagtttcgcggggccagaccaggaccctgggcctgctcttcggcctttctctgtggtgtctgcaggcctgactgtccccttagcagggaagggaattgctctgggccgtggtccagcccgtgggacggaggttcagcctcttccccttacttgctgctgcccagggagcccttcccctcgcttcctctcttgttctgttagctggggtttcaaattttcttttctttggatggaaaacaaacaaagaaagtaaaactaatgggctgaagcccttccttggggagaaacattcatccctcaacgctgagaataaatggcctttgctgaccctagcagcacagccaagggccgccatccctgcctgttgctgcacttcccctcccttctgcgccatcctgcagtggcagggaccctgcccttccttgcgtctgcccccgcttcctgcgccctgctctcctgccaggctgcccaggctggggtgcccctctctgcaggctcccacccctcagcctggcttgtacctctcaagtcctcctcttgtactcctgctccctggtaggtggatgctatcagagggcacagttttcagcccaaaaccttaaggaacaaaaatgaacagcaccatctgcatctctttggccctcgcctctgtctccaccttgctccttggcgctctcaggccccctgccccgaggctggaccgctgttgggagtgtggcaccagtgggtggactgctttccattgagggcagcagaacccagccttgtgtgtgtgttttagcgcagagatcttcagatgaactcatctgaggccgacaggcaaagtagccctgcacatctggggccagggatggaggccgatgctaaatgccccccatgtctcctcagctcccttgcaccctgatgagcccctgcagtgtcctgcatagtccttgggctaagtggagccgagtatggaacccaggtctaaaattgggaatggctgtccagtgtctgcgcatcgccccctcccctatctgggaaactctgtggttgaggaaccccacttacaaggccccaggcaggctggcctctccccgagtcaggcaccagtctgatggcctgatggctctgctatggaggtgggaggggaaaggtcctccaccaacctggggactctccaactgtcaaggcaacaatcactgtattgagtagctattactgcccgcattttaaggataggaacactgaggcccaggtgatcaagtaatttgtgtgtggagatgtgggaatgaaagctcatggtcttcatctgtagcagtgactcccgcagtaagcctgggtcatgaggatgaggtgggatccagaatctgctgctgggggcgggaaggatgcctggctgatccctgtgcaccttcgggccctccctcagctcattccccctctcccatcacctcactgcttggattgtagaaaaatgaaaggttcatgcctagagatgaccaattttggggtaggagctgcgggtggagcggggcccatgacctctgtgtgggagaagctggagaggggcacggggctggccaggctctaaaaggcacatgaccttgtttgcatcgtcacactccttttttagaaaacaatctctgctgcatacagaggttggctttgtgcagggccccagcaatcctggtggttccttcctgcctttcttctcccttccctattctgggtttttctcctccctgcttcccattctaccataggggaatggggtcaagtcttttggatgggaaacaggaactgagaagttgaagatggagaaatgaaagactaaagatagcagggttttaattttccctctgaaaagcccaggaagagccccggattgtgtaacctggacacatgcaaatgatgaccctgcccctactctatctgcttctccgccaccctggcccttcagaagattctgaaacaaggaattggttacccagggtggttaggggggttgtgcctgtgtccctggtgaactttagattcttgtgcccctggtgaacttcaaatgctagtgtgctgggagccgtatgacagccccttggggtggcaggagctggcttgtgtggaggagagccactggcagctttcttggtgaaggggtggacagcactcttggtgtggaagtagcagcccccttgcctgtagctgggctggggttagtggaacagggtttagagaaagcaggggtaatgccgggtggttattttccccaaatgttagagaaagccagcgcttctggctctggaagtgaggctgttgggaagtgggagggggagcacagctctggaagctgccttccgtcctccctccattggctggagctctcccagcatttcatcggttcaaagccaaacacatgattttggacaagtcacttaaactctttgagtcagtttcttctcctttaagctggggaaagaggtggtgatttcacaagtggttgtaaatattgcagtaaagataatggaagtaaaagtgctctgtggagtgtaaattgctgtatggtagttggagttgggccctaggtgtgattttagagtacacacctactgctgccttggtaacttaaaagtatttatctcaaatgctagtgagctgagctgagtggcacagtaggcctttctttccctgggagcactttgggagctttggaggttgcccagtgctgcccccaacctttaacagtgtggccgagtgtaggagggagggggcagagttccttctggctggactgccacatgcaggggagaggccccgctggtggtgtcccaggtgggagaggggcagacctggggttacctcagtcagggtaggtgaggaggggatgggtggacaccccggtggccactcctactcacccctgcacttaagacctggggtttcatgccctgctcctttaaccctcagtgttcaagagagaggccagttggaccagagcgcctcaccccaccatttgccatgtgcccctccccgtggggagtcagaaacacctgagcacaccaggaaaagttttgaaaaacaatgtttttagagacagggtgttgctacgttgcccaggctggactcaaactcctgggctcaagcgatcctcctgcctcagcctcctcagtagctgggaatgataggcgcgtgccatcatgcctgtatgaagttttgaaaaatttaaatgttgatggaaaaaaaaatgtattagtggaaatgaaaggctggtataagctgtaaagtctttttgttcttagagatttttttctcattctaaacattatcagacctgaaaagtatttgtcgtaatgactgagacggtcctggggtaacagcgtcttcttaacggccactttaattggcgtagtttacacctagcctctccgagaactggaggacactggtaatcactattagatattgagtgctgactgtatggcagacacataagcattggtgatctcctgtgaggcaggtattgttattcccaatttatagatgaagaaacagaagtcagtgaggtggagtccgtttttgaggtcacgcggctagtaattggagcctggtttagaaccaagtcagtctcattccagaatccagaaccagtgatttgtaactgatgcacttgtctccaaagggatccagcactgggttttctcatttttaatgcatccattccttaaagcctctgttcacagtcacaaggtgtactttttaaaggaacacagcacacaaatgtgaccgctagtggacagcagtggcagcccagttggatggcagagcctggcatgccgactgggacagaagccccagcacacggtgtgatgatggcgtctccaggctgacctccatggcctcaggaatcaaagtcctcagtctctttcacgcggggttcagaaagaaaactcggctatcttacatctcctctcccctgtttatttgactaaagtgaagttcatgtggcttgagcctcgtttcctggggaaatcagcctggcttaggattccattgtcttctgggactgggaagatgtggaaggctgacctcacgcccagctgaaggtcaccttcccagactctgagctcggctgccttctgcatcgccacggctggagggcctggcccaggccgtggctgcatgctggctttccactgtctcggtgtccctgctgcctgtcagtaatgtgcccagcaccttctggtgtcatgtcccctcttgtttgtgattcttttcctgagctagtccattttctacctcgagtctgctctcctgccattcccaggggccacagctcagtaatgtgggtgtcagggaaccccaggccaggcccccttgtgccactgtggctctccccaaagcagggcaccaggctggctgggggggtcctgcccagagctgccccacgctgccgtgtttgtgctgctgctgtgcagtggtgatcttgccaaaatgtggcttttcctttctcactcccccagagctcccagaaaagtctctaggacttttcttccccctaaataaaagtcaggatgtgaagccttttgacagaattggagtttactgtcatctgtttccgtttctctaagatagggatcctggcgaagcccatgaaagccatggggcgctcccaccgaagcctccgaggcacagacctcccgggagtgcctgtgggcgctgcttccttaaactgcaggaggctgcagcctctcgttgttcatgcgtcgttttttcatagtgtgtgtgggtttagagctacatgggttcttttctcacttatctgttcataccgcatgacaccgtccacttcaggcacagttgacggccgtctggaggtcatcagctgagggcacagtttgcctggttcttctataataggttaagtatttttttctccatttttttcccttttaaaagtactgctagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaataaaaaataataataataataataataaacacaagtactgctggaacttctttgcagaaacaacttgtggggaaggagggaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggagacagtgattcagcccagcaggctgtattcatgtgctgttcctctgtacacccagagctgtcttctcgctcatcatttattaatctttcccatgcaagtcatacgtgaatatatccttgtggtaaagttttcaggtgatagcgaaaactcagtctcctgtcaccgtcttctctcctcatctaggtgcgcgctataactaagtcctttgcctcttccagagtttttttctccctgtgtaccattggccctctgcacttgtgggttttgcatcctcgtgttcagtcacatagggtctcaaggggaaaatattcaagaaaaaatatccaataaaaactaatacagcaatttaaaaaatacaaattttggccagacacaatgccttatgcctctaatcctagcactttgggaggctgagacaggggaatcacttgagcccaggagtttgagaccagcctgggcaacatagggagacgtctctgcaaaaaatttgaaaattagccgggtgtggtggcatgtgcctgtgctcccagctactcaggacgctgaggcaagaggatcacttgagcccgggaggtggaggctgcagtgagccgtgatcacaccactgcacttcagcctgggggacaaagtgagatcctatctcaaaaaaataaataaataatgaaaaatacaaatttttaaaaatacagtgtaacaactgtttacatagcatttacattgcattagatataagtaatctagagatgatttaaagcatgtgggaggatgtgtgtaggttacatgcaaatatgacaacattctacattacgaattgagcatccttggattttggaattcaacggaatcccggaattaatcccccatggagaccgagggactacagttttgagtatttttgttttattgtttaatctgtccctttgacacatttttgtgctcagagttaaagacctcaataccctgcttgatgggaggagaagagaaaagggtaacaaagtataggatagtacttttcattttctttaattagaaaaaattatcaaataatgtattcatgttaatgatagtttaaaagtgggaaaacaaaaaattcctccaacttttcctaagacaacaatgattattttctttctgtatctttatatacagagttttaagtgtttgatatatcacttgtctatcctcttttataagtatttttttctttgcttttacaatttgtgtgtgtgtgtgtgtctgtgcgtgtaatggatttaataaacaagcttgtgattttcatttatgtatttatttttttgagacggagtttcactcttgttgccaaagctggagtgcaatggcacgatcttgactcactgcaacctccacctccccggttcaagtgattctcctgcctcagcctcccgagtagctgggattacaggcgcgtgccaccatgcccagctaattttttgtatttttagtagaagcggggtttcaccatgttagccaggctggtcttgaactcctgacctcaagtgatccacccccccaccccctgccttggcctcccaaagtgttgggattacaggtgtgagccaccacacccagcccataagcttgtaattttctatttctgaaattggaatttttataaaaacgattgcctttttatcttttttttttttttttggacacaggatctcactctgttgcccaggctagagttcagtggcacagtcatagcccactgcagcctcgacttcccagactcaagtgatcctcctgcttcagcctcaccagtaactgggaccacaggcacctaccaccacacccggctaatttttttactttttgtagagatggggtctcactgtgttgcctaggcctgtctgaaatgcttaggctcaagtggtctgcccacctcagccttccaaagtgttggggttacaagcatgagccactgtgccagttgccttttcatcttctgcagagctgccttacttgtgttttgtcctcagtgctgttcctgtgcgggtggtgggcgtctgcatgtacacaggccagcttccctcactgctggggggcctgcaggtctgggtgcaccttgttacccaggctagccttcctctgcagaggtgtgaactctgccaccaccccgttctagtcaagatgggaatggaatctcagaaaggaagccatctaggagaaaaatgaaagaagtgtttctcttatgtttgctgccgtcaaagttgctactttaggagctcagaaaaacagttatttgtaagatggattaagtaagtagtttagtaagattgcccaaaaccacctcccagagttagtgggaagcgcctgatgctggggagaaaagcccgaggcctgagctggccgacctgcattcagtttcctctgtctctagcttctctctgatggtttagaaatggtactaagggattcctaagtcccttttgcttcctgtggtcaaccaacatgctaggctaataaattactcctgaagttcactttcattttggcaacattttctggttctttcgccaactctaatttcttttctttaaaagatgctttaattttacttgtattcttaataatatatcttatatatacacacacatagcattaaaaattttttcaatgagatttttttaaaaaattcaacttttattttagatcggggggtacatgtgtaggtttgctacgtgggatatattgcatgatgctgagttttggggcatgattgatcccatcacccaggtactgagcatagtacccaacagttagtttttcagcctctctccacatctctccgctctctagtagtccccagtttctattgtttgtttctttatgtcatgagtactcaacatttagctcccacttataagtgagaacatgcagtgtttgtttttttgttcctgtgttgatttgcttaggattagggcctgcagctgcatccatgttgctgcagaggacatgatttagttcttttttatggctgcgtcatattccatggtgtatatgtaccacattttctttatccaatccactgttgatgggtacctgggttgattccatgtctttgctattgatacaaatgacatttaaagaatgattatgaaggccacgtgcagtttctcatgcctgtaatcccagcactttgggaggtcaaggtgggtggatcacttgaggccgggagttcgagaccaacctgcctaacatggtgaaacccccgtctctactaaaaatacagaaattagctgggcgtagtagtgcacacctgtagttccagctactcagaaggctgaggcctgagaatcgcttgaacccaggaggcagaggttgtagtgagtcgagaatgcaccactgtactccagcctgagcaacagagcaagactctatctcaaaaaaaaaaaaaaaaaaaaaaaaggaatgattataaagcctggttttggccagcactccaagcgcgccccgcaggcctgtcccatcgtaacgccctcagaagcttcccctgccctgactgcagccctcagcttgcctcagtttgtagtttgccaacaaggtgtatatccctaaacataaacaatttagtttggcctgtttttgaactttttatactgcatgtattcttttgctcaacatttttgtcaagttcacttgtgttgtggggtaagtttgttctcttccgttgctgtgtagcattctgttgtacgaatgtccatcatcagtttattcattttaccatcgacatttcggtttatccagttgggggctgttttgaggagtgttaggacagcctgtccatgtcttctgttgtggatgtatatttactctgagtaattttaattttttaagataataccaaaacacgcccttctcatctgtccttaggcacacactttcctcagctgtgacttagctcagacgtctatttgatcttaattcttagcgacacctgctattcttcaggcctggctttattcccacaaggggggaggttcgttattgctctggctttaaacggagcccacaggtcacagtgcaagtctacgcttcccaaaaggcttctggaaatatttgacactgtcattaatgctctctgttactttctgaagagtcgaatgcgtggtgagacaaagctgccatctgaatgtctgtctgactcttcttggcaaagccaccctgggggcacggacctgggtgtgttttgttttttgttttgtctactgtctttcagaaatgtcccttcttctcaggctggcctttcgtccgtggaacgaggggagaggagataggacgggagagcggagcatgctagggctgcctgagtgctgcaggcctctgctctccccagggcagcatcttcgggttctaagaaggaagccagcctcttcccacccctgctggttcgcattgagaactcagggtgctggggacaaaccggtgctgtgctgcctgcagtgtgggctccctgtcagggctgggaggagtggggtgcaggggccgctggtgctgtgggaggggcattttgcatggatccttgaggccagggctcagcaaaccttttctgtgaggggccagagatagtaaatattttaggtttggcgggcctcaaggcggtatgtaggtacttacataagagaggtgataaatatctacaaattttttattaatgaaattcaaaatataaaaataataatggagtacaattttttggtaatgcaggtctcctaaggggaagagaggaattattttgcgggggggagggggcgcgcataacatttatcttaattaatttgggttcagttggtctttcctgtgaccctgtccttgcattcattggaaatgttcgtctggaaacacccttagctcacggttggataaaagctgtcccgcaggccgtgtgtgcccaccctgagccaggtcatctcctcagatagtgggcttggcccgcaccattcagcctgtggtgacacaggatggaggccctgtagggttctgtgggggaccaagaagaggtagaggagcccccacatggaggagggtggccatggggtgatgttgatgctgagcccacgggggaaccatggccagggcctccgggtgaccccagaggtggtggcaccgccctcaggcggtacagtggggcccatgaacggaggaagagaagcatggggttggggacattcagaggccactgtgctgcctgggtggctgtagctcttgcagaaggtggcaaggcctgaggaactgaatttgaaatttgaatgaatctttatagaaacattcctctgtggctaccctgttggacagcacaggtgtggaaaatgagtgaacagctttgtggtggtctctcctgtggtggacttcccttacccacagtgtgcaccgtccccactgtccccacacactgtccccgtcccctgtcctggctccagctcagctgagcagcagagattggaagaggcccctcggtaacttgagaggaacctatagaagagtttgggaactccaaacagatgcttttaaagtggtttgaaacagtagttttcctcagaaatatttgggacacatccccctctctggtttttgtgataagttcactctgtaaaacttgtttgacaaactgaaggtcagcttccacctggcccctgagaattaatgaggtctggccaggcggcagctgcagtgcaggccctgctcctgtcttggggtctcttcggttcttgcctttgtttgtgttttttacacataagttcccgtgaaagttgcttttcccccgctctgagctggagtggagttttcgtttggggagcatggtagttgagagcctgggtctggttagaattctcagcctgatgggtagacatctttgcttcctcgagactcaagctttgttattttttgttgctctaagatttcagtattttttttttaatttttgattattgtgggtacgtggtatatatttttatggggtacatgggatattttgatacaggcatgcagtgcataataatcacattagggtaaatggggcttccatcacctcaaagcatttagccttcttttgtgttacatctcaattatactctcttagttatttttaaatgtacaataaattattgttgacctttgtcaccctgtttctatcaaatactagatcttattcattctgtccacctatatttttgtacccatttaccatccccacttccaccccacctacccttcccagcctctggtaaccatccttctactgtcagtctccatgagttcaattgttttcattttttttttttttttttttttttgagacggagtctcgctctgtcgcccaggctggagtgcagcggcgcgatctcggctcactgcaagccccgcctcccgggttcacgccattctcctgcctcagcctcccgagtagctgggactacaggtgcccgccactacgcccggctaatttttttgtatttttagtagagacggggtttcaccgtgttagccaggatagtctcgatctcgtgacctcgtgatccacccgcctcggcctcccaaagtgctgggattacaggcgtgagccaccgcgcccggccctgttttcatttttttttatggctcttttcagtttatttcatgaaggagttacactagtccaagttaaaagcggaccccaaatggttacattatacaagctgtgaggtttttaaacttgtgacaagggacagaagggaaattctactcattgcaaggaaatcctcacttaaactacagtgagccacaagcatttaaaccccatgaatcttcagctgatcgtccttagccagtccaagctctacgaggaactggcataatatatgttcttgcacctgtcaccctgtagctgaattacttctccatattctggatgctcaattacagtaccattgcaggcaaacttcttaaacgccttcactggtttctttttggtgtaatcatcagcgatcccttggacagtagtaagggccttcctgccgtttctctgttgaattcttatatggatataatcctcagtgccagcaggaagcaggtcatcacccttacttgcatcagcaaaggagtttaaatagtggaggttctggatagtggacatacgatccaatttctttttctcggtggaaatggtctgcggaagacggcgggcagagggtacggaaagtagggaagcgacggggcccaagggggaggctgctgagtcctcggcagtggctcagtgactggggtggttttaatttttttttttagctcccacaaataattgaaaacatggagtgtttgtctttctgtacgtggcttatttcccttaacataataacctctatttccatccacatcattgcagctgacaggatctcattcttttttatggctgaatagtactccattgtgtataggtaccacattttctttattcattcttctgttagtggacacttagattgtttccaaatcttggccattgtgaacagtgctgcagtaaacacgggagagcaggtacctctttagtatactgatttcctttcttttgggtatgtacacagcagtggaattgctggatcatatcatagctctatttttagttttttgaggaacctccatactgttctccatagtggttgtactaatttacattcccaccaatagtgtacaggggttcccttttctccacatccccacaagcatttgttattgcctgccttttgcctataaaccattttaactggggtgagattatatcattgtagttttgatttgcattgctcggatgatcaatgatgttgaacacctttttgtatgcctgtttgccatttgtatgtcttctttggagatatgtctatttatatcttttgccctttttaaaattggatcattagattttttcctatagagttgtttgagcttcttacatattttggttattaattccttgtcagatggatagtttgcaaatattttctcccattttgtgggttgtctcttcactttgttgattgtttcctttgctgtgcagaagctttttaacttgatatgatcccatttatctgtttttgctttggttgcctgtgcttgtggggcattactcaagaattctttgcccagaccagtgtcctgcagtttctccatttcttataggagtttcatagtttgaggtcatagatttaagtctttaatccattttggtttgatttttgtgtatggtgaaagatagaggtctagttttattcttctgagcatggatatttagtcttcccagcacaatttattgaaaaaattgtcctttccccagtgtatgttcttggcacatttgtaaaaaatgagttcactgtaaatgtatggatttatttctgggttctctattccattagtctatgtgtctgtttttatgccagtaccatactgttttggctactatagctctatagtataatttaagtaaggtaatgtggttcctccagttttgttctttttgcttagaatagctttggctattctgggtcttttgtggttctatataaatcttagggttattttttctatttctgtgaagaaaagcattggtattttgatagagattgcattgaatctgtaaatcgttctgggtagtatggacattttaacaatattgattcttccagtccacaaatatggaatatcttcattttttttggtgtcctcttcaatttcttacatcatcgttttatagttttcgctgtagagatcctgtacttctttggttaattcctaggtatttaattttatttgtagctattgtaaatgggattattttcttgattgctttttcagattgttcactgttggcatatagaaatgctactaatttttgtatgttgattttgtatcctgcaactttactgaatttatctatcagtgtaaccacccaatgggttcaccttgcccgctgctgcctagaccaagctgatttatcaagacaggggaactgcagtagaggaagagtaattcacgcagagccagctgtgcaggaaactggaattttattattattcgaatcagtctcctggagcattcggggatcagagtttttaaggataatttggtgggtcagggccagtgagttgggagtgctgattggttgggtcggagatgaactcataggcagtcaaaactgtcgttttgtgttgagtcagttcctgggtgggggccacaggaccagatgagccagtttattgatctgggtggtgtcagctgatccagtgaatacagggtctgcaaaatatctcaagtgctgatattatgttttacaatagtgatgttatgcagcctccagctgcatgactcctaaaccataatttctaaacttgtggctaatttattagtcctgcaaaggctgtctagtccccaggcaggaagaggggtttattttgggaaagggccattgtcatctttgtttcaaagctaaactgtaagttcctcccaaagttagttcagcctaggcccaggaatgaacaaggacagcttggaggttagaaacaggatggagtcagttatgtcagatctctttcactgtaataattatctcagttataatttttgcaaaggtagttttttcagttctgatagtttttatgatggcatctttaggtttttccaaatataagatcacatcatctgcaaacaaggctaattcaacttcatccttccaatttggaggccctttatttctttctcttgtctaatctctagctaggacttccagtgctgtttttatatatagttggcataagactgtttctagcattcaatcttttttttttttttttttttttgagacagagtctcattttgtcacccaagctggagtacagtggtgtgatctccgctcactgcaacctttgtcccccaggttcaagcgattctcctgcctcagcctcctgagtagctgggattatgggcatgcaccaccatgcccagctaatttttgtatttttagtagaatcggagttttaccatgttgtgcaggctggtctggaacttctgacttcaagtaatccggccatctcggcctcccaaagtgctgggattacaggcatgagccaccgcgtccagcctaacactcaatcttaaacaatcattctagcttctcgtcctgaccaagtttaattttaattgtctataaatatgcaccataatgaagggtgtgtttctgaatagggaggtaattgcttttcccacttgcaattttaattaaaaattacctcttccacctacctcacctttatttctaatctgtttaacagattgtagaaaagcaagtttatgcactcatccctgagttcaggaagcactacttcctctttggtaacaaaggtagaagattccatatggtgacctattttttcaagagttttatgcagtaaatgatcagggacgggtgtgtcccatgacataatatgggaggaaatttgtcagagttcaattgtgttattaaggtatgttgtctgtgagcagccttttacattgaagtttaccaccgcttccagtcccatgttttgttttttcatttgtctgttttttttttttttttaagagacagggtctgtctgtcacccaggctatagggcagtggcgcaatcatggttcgctgcagcctccaacttctggatttaagtgatcctccctcctcagcctgggattacaggtgcatgttcccatgcccggctaacttatttttattttttgtagagacagggtgtcactgttggccaggctggtctcaagctcctggtctcaaacattcttcccaccttggcctcccaaagcactggtattatagtaggtgtgagctaccgcatccagcctagtccttgtgttcttagcacggttgacccaaactcctgtagacacaagatcactctgtcatctgtgggagtatcagaggcaggagggctgaaatctggttgagagagacagcacagatctccctggctggcttttccagaacggctactgcccagctttagccctgaatggcttttgaaccatgggttccagccagttccctcttctttgcgtagcctctccctgaatgcacttcctgcctgccctgatccattaccctccctgtggcctgagtaaccttcaagcacagctcccgtttcccctctgggaagcactgttgcctggcacttgagcccctgcattttgggctcatcatcctttcctgagctgcttcttgagtcctgttctgtggcaagctctctggtaggcactggggatacaatgaacaaatatcagtgactgaccttagaggaaagcattaaaaaaactaaaaagaggcggtacgattaattttgttgatattttctataacctaagatgtccacaatattgttttaacgtggcacttagccacatttcaggtgctccgtagacacgtgctggtagctactgtagtggatagctgtggcctagaggcagagctggacaagttaaaaaagcagttctgtgcacgtagtaagtcctgggctcctgttttcatcgttaatttgtgtttctctaggtgattatcttttgtgagttgtgaattccaagaaggcacaggcattgccttgtcctgttttcctcaccattgtgtcagtaataccttgcaggtagaaggtgctcacaccattttatccaatgaaatgctaagcacagggcattatgggaaaagctgagatgagtacctgccaccctatcgtggaggtgggaaggcatcagaggccttctcaggagagaggagtgtgtgcacgggctgggaagacagcagggggagggggagccacaggtagctcattatgatggaagcttggggtacatgtgaaagtgatggagaatatgaggagctgatgccagagaagcaggcagagctcagatgatcagatttttaaagcttgctaaagatgttattctgagaacaccaggaagccttatagtgcctgggctgggacctgcccctcaagccttcctgtgtcgtcttttttttctcttttttttctttttgagacagagtctcaccctgttgcccaggctggagtgtagcggcacaatcttggctcactgcaacctccacctcccaggttcaagcgattcttttgcctcagcctcctgagtagctgggattacaggcacacccaccaacacgcccggctaatttttgtatttttagtagagacagggtttcaccatgttggctaggctggcctcgaactcctgacctcaagtgatcctcccacctcgacctctcaaagtgttgggattacaggcatgagccactgcgcatggtctctttcttctttattcgtgaggtgttttctccctttacacttgctggcccatggaaggtgcttagtaagaatggtggctgacttctaatgcttccagagagcctgacaggctgacatgggtgtcttccactgtctgtggggaggcttagaaagaggagtggcttttattaatattatgagtgtggatcagatcctgctggagccaatggcaaagcctggagccggcccagattctgcgagagtgctaggctgcacggtcacagatcaaatgtgcttttcaagaatggcccctctcctgggatggggaacttagagctctgaggagcaccgtgaactggcacctctatgtgtgagagctgtgctgtctgacatgtggtctaagcttcgcgaactggtgtttctggcacagccctgagcacaacctcagtctgcccactggtgctggctgagcctggcctaggtcccgcgagtctgcggctggaagactggggaggaaaagtgatgagactgcaagagaaagataatttaattatgattgtcctgagttatttactgtttccaagtccccttttgtatcttgaaggaaggtaggaatggatcagagataaccacttgggaaaatacgagttaactccatataagaaatcttgattatcttgtatcggtaactctctactctttagtatggcaggaaagaatgccttttttatttaaataaacatttttagttttaggttcacaacaaaattgaatggaaaatacagaaactttccaaatacccgttccccttgacatgcatagcctcctcctttgttaacatcccgcactacaagtggtatgctggtgaccctcagtgaaccgacagggacacatcactctcacctatatctttacttcaccttagggctcactcttgtacattccatgggcttggacaaatgtataatgacatgattataacttctctttgtattgcagccactctgtcaaatgtctggtgccttgtgatcatttttccatttaaaattgccagcactaatcatgtctgtttttagcatccaataaaattatcattgtggcattagaaccagggcttacgattctgctattgaaaactggttcaaaaggtgatttcaggaaggctggaagtccagaatccattgctctgaggagctgtgctgtgtttctgatgataggttgttgcaggtttttatgatctaaactcacatggggtaataatggacactcaatagcagtagttattatgtgccagtagctgtagggcagggtgcttcatttagttttgataggatagcctgtgattggcatcgctatcccagttcacaaatgttgtctccctccagtcacaagtcaccctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccaggaggcagaggctgcagtgagccaagatcgtgccactgcactctagcctgggtgacagagcgagaccccttctcaaaaaaaaaaaaaaaagaaaaagaacaaaggactttttacctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattattcaaccctgcaaagtgggtattgttcctgctggtttctggagaagaaatctgaggctcgggaagcaataggacccgtcttctaacacagcttacaagctaatgatatttgggtttttccaaatccagagtggggttgcctccaccttgttagggctctatagggggaaggggtgcaggcacgataggagtccctggcaggcaggggcatcctggagccttgctggtaaccaaggagaacggagggttcggctggagtaattcacttcgctgcagagggctcacgtccagcaggtgctgtgggcaggagacagcttgcatgctgcaggaggaggagttggttttcagtaattgccaacaaacttctgcttagtgccatttggaaaccagtcttccacaccacactgagggcttgtctcccagaaacaggtgccgagggacctggcagaggaggcttgtctcccagaaacaggtgcctagggacctggcagaggcaatcagagtggcactcaacgtggtgctcgctgctagcgtggtctcagcacaaacatggtttaatgactgtattctctacattttaggctttggacgtggaccggatggttctttacaaaatgaagaaatccgtgaaagcaatcaacagctctgggctgggtgagtatacatccttccctagaggtttctgtgtggaaaatgtcgcatttgaagtcctggtaccgtaatattgatgaccattaacaaatgagccagctagactcctttatcggggcatgcagatcacagaggtgagctgggatgtttctttttcagaagtatgttttgttttgccagtcgtctgattcaggtgtgggatttcgtcccctgtcatcccctgtcatcctccgtgctgtctgtcccacgttgcacttcctgttttctggagcatcgtcctgcacgtacccactttgtcagcctggctgatgggggcctggattcattcctgcctctgtcatttggtttttgctgttaattgtgtcacagtgccctttccgtttctcttttacccagtcttgccttttctagtataggaagaaaatgaataaatagacaaacataaagtaatatttgatctagatttacacatacatattttttacacatatatatttacacatacatattttttacacatatatattttttaaacccatgcaacttttggcttaaagatgacaagtaggtcacctgtagcataccttcccttgtacaaatcctacgagtgatacaaaatattttttaaaagtcattaagtgactatatagtttcattcagcaacaaaaaggtggcatccttgcagggctaggaactgtgaggagtccctgagagactgaaacagggctgatgggttgctcaggggagcttgcccgtgctcaggtgcagatagagtttgggtgacagggtgggaggaggaggggcctggggtctgctcccactgaagtagtcaggtcccttcatctatactgtgtcccctcaccctcgtggtgtctttctttagtgaaaggggtgattggaacaggaggacagggagtgccttagatggttgtggtgtcaggagggaaggggaagagcctggaagtacacattccacctgctcccccccaccgcccccaccagttacaatagggcgggcacaagctccagttgccgctcttgattctccccccatgagagctgtgcaagccacaatcgggaagaatctagcaggaaatcccaggtgcaggataatgttacagttgagcattgccaagtgtatttaggaacaaatttaacagaagacgcacaggaatcctacatcaacaagtacaaaacgctgctgaccaaaatgaaagaagacctaaatgagaaatatgtgatgcacaggggttagaagagtcaccactgttagtgtcaggcctccccaaactgatctgaagattcaccccaaccccagtcagaattacagcagcggaaattgacaggccttttctaaaactgatacagaaggtggccatccgtctctagcttttttacctggattaagtgtggggcagggagcaataatgatagttttgatttttttgaacacttactgtgtatcttgtgctttctgtacattgtgctaatcttgtcaacaactgattctccttatacaaatgagtaacctgcaaatcagagagttctgggtgttcccaagatgtctgtgcagctggagctcagaccctgatggtcttactgctgtgtcagggttgtgtgcagtgagtggcccactctgtttcaaagccaccatgccttcagtgtgtctgtcacacgggtgacatcttgaagacttcagtgagtcactaagaaatggtacgcccagtttcattgacaagcaccagatttcaaaaagtatcttggaagattttttttttttttttactgcgttcacttggactttttgagtttataacttgagggatatttgatattctggtcagactcaaaaatgattttatagtcatatgttgaaaaggttgctcttatcagaaataaaaatgaaataatctgtgtcttatgcaaacactggctgtgtagctgctgctcgtctggaggagagacttgtgtgactcccaaggctggcccagtggctggcagtacagcttataaacagccctgcatttgaagggagaaggcgctagtgcttcggtgtcaggaagctggcctgcaggaatttaacagcacctctgtctaatttgccatgctgacctatattgctgagcgtgtaccacaaacctcattcctatttctaaccacccccaagcgtcgtttgctaaaatgcaaccccactggtgttacttctctgcctaaaactctatagcattttttcatcaccctctttgaagttcgtggaagtcagttccagagcatgggagagagaaggaaggcctctgtgggcttcagaattttagggcaattgggataaagatggttctcttaccacagatccatccaaagattttaatgtgctagtaatgtggattgtgagtggttatcgttcttaaccctttcccaattcatttgtcgatgaaactgtcactgcctcccctgatcaccccactgtgagcctcaggtgagtaaatactgcagagcaccagatgagttccgagctcttgtgcattgcctggactcaggccacctgtcccgaccctccccacctggactcctctgtgcccttctttgaaataacttgcagttttccccagagagccacgttttatgccttcttccctctgctcatgctctgctgtttgcttaaaatagcatttgccactttatgaaagaaaactgaggtccaaggaagttgagaagtttgttcaaagtcacaaagctctacagtgacagggctgggattttaacgtagctccttgggctcatgtcctttttgaggccccgcacataacagcctggcatgtgaccttggagggggtctcctatttttgtcatcctttagccatctattatgtcatgccaagtttgagttattctaaggtcatgagtctgagtcctgaaaagtcctaagtcctaaaaccagagcctgatcctgaaatctttatttcggaacaagcgttgtctactgcaaagaagtcacctgaggaaacgtgatactttctcctgtcatgttgctgacatcattcacagtgtctttagaactctttagaactgcttttagtagcacgttcttttgcatatatttagtagagaagtctaaggatagattaaatttttttagaactagatgtcagaaataagtcaggcatattcaagaagggactgagtgccagcgaccacagttggcttcggtgcactgtaactacagtcatgggctctgaaggcagctggttccaaaggagaagtccccatagtgttttgatcacgagaataaaggccaaaggcaattcctgtataggaagagcgctcattttatgtacgattgaaagaacagtgagaataaattagcatttatgcttcatactgccatattccttgtcttgtctcatgtttcttaatttctttgggaccaagatttcctgcctgctttcctgatttgtcacagattggccccatttgacccatctctgtaccagtgtccctcactgcaggctgctggcctgtcactgcttcctgagtgtgtgccagctgtacttctgtgtctttgcacagccccacccagtctgtaaacggactcccccatcccagtcacctgcaggggacctgcccttgcttccccacccattttcatcaagccttagctctctttgacttcagcgtagccctctttgactctcttgtaatagattcttttttttttcctctctttttttgagatggtgcttcactctgttgcccaggctggagtgcagtggcatgatctcggctcactgcagcctccgcctcctgggttcaagtgattttcctgcctcagcctcccaagtagctgggattacaggtgtctaccaccacacccaactaatttttgtaattttagtggagatgggttttcatcatgctggctaggctgatctcgagcttctgacctcaagtgatccaccagcctcggcctccctgtaatagtttcttattgctgttgtaacaaattaccataaaatgagttggcttaaaatggcacaaagttatctttcagttcggccatgggaaacccgacatgggtctcactgggctaaaatgaagatgttaacagggctccttccctgaggcttcaggggaaatcggtgtccttttcctgctcctagaggccacctgcattccttagctcacggctcccttccatcttcaaagctggtcatggccggtggtgtctttctcacactgcattgctctgacacttagatggctcgggctgctataacaaaataccatagattggtgggttaaacaacagaaatttattttctcacaggcctgggggctgggaagtccaagatcagggtgtcagtgtggatgggttctggtgagggctctcctctccttcctggcttgcagacagctgccttctccctgtaccctcacatggcagcgagagaaagcaagatgtccactttctcctcttataaggaccctaatgccatcaggagggcctcacccacttgacctcatctaaacctaattattatgcttcccaatggccccatctccagacaccattgccttggggattagggctttaatatatgaatctgggggaagggacgcaattcagtcccatagcaaacactgactcttctgcctccctcttctacatataaggacccttgtgatgacattggcctcatccagataatccagataatctccccatctcaagttcagctgattagcaactgtatttcatccacaatttcaattcctctttgccaagtagcataacgtactcacaagttccagggattaggaggtgggcatctggtggtggaggagacgttattctgtctaccacacctctcctgaattcttaggatttggaggttgaatcagtttccactgttttgttcagctacaaattaaagggtacctaacatgcaggcactgttaacactttaaatattgctcctgattgttctctagtagttttgtatctgttgatcttttctcagttaattagaagcccttgaggtgaaagaccaattctgggagatggtgtcatttaggataaagaagacgtaggtattagaatccaagaacccttgattaaaagctagcaatgccactcaaaaagcctgtgacattaggacgattattttacctttctgagcctcaatttcctcatgtgtaaaatgggaatttaataggtcataggattgctagtgaagattaagtgagataacatgaaaaagtgccatgcatggttctggacatacacgtggtaagtgtgacagctgtgacatacctcctgtgtgttccttgcagtggctgccatgggtgtgggcgggtaataggtgcccagtaaatactgagtgtttatacattatcaggttcctgctgtatgtacttacactgctttcttagtgtaggaggggtgaacttacaattttagatgtaagtggtgtgtgttacgacaggccctgtattctattctttgaggatttatatggatttatgtagaaggaagatttaagatgccttacaatggaggctggaaaactgtggccagacacctgtgttttcacagcctgaaagctaagaatggtttcttaccatcgttacctgcacaataacctcagtattgcctcagcaacccacagtgtgatggtctctggagatggggcctttgggaagtaattagctttagatgagggcatgagagtggggccctcatgatggggttagtgccctgcttaaatatttactctctgactttctaggaaaaagtttttgaatccctgcattagagcagtggttataaactggagagagtatcagaataccccggggtcttgttaaaatagggattgagtttctggttcagcaggtcagggttggagcctgagtattttatttgctaattgaaaaagctcccaggtgacggcactggactttgagaatcctacctcagaaccccccatccccacttcaaacactgaactgggacaaaagggtatctgcatgtcccacgtgtatacaaaacagtagtcttcttccacaatagtcagtgcattatgtttgctcccagtcttcaaaatgatggcaacccagccagctgtattttctggagagtcttagcttgggtttccaaaagcagttgtcataatgatttatgagaaactgtttgccactcagtgatggattgcttatttattttaaactcttacttgtctaaaatttcccaagctctggctcagcccaaaggtgttccttccacaccccaggaagttgaagctaacatttttagctgtttgacatatcagtgggtggaaaaattcatctctatcaagaaggaagcaacagaagattttcattttcacttctctagaattattctgtcataaggacttgttagaacattcttatcgagagtgatattcctaccctcaatcagaatatcctagaaaattatcacattcttgaaagtacaaagaaatgctgattttccctcaaatccttaccatctcccacatacaaaagaaaatgagaatacaacaactttgtgtgtgtgttcctgcctgttgtttgcagtgttaattggaatatgatattaaaatacacttcaaattcatacagaaaactatttctattgtagatattatcaattagaacagggcagttcagaacaaatatatataatagttgaggaaatgaagtttcactgtgcattaagaagatactggctgggcacggtgactcacgcctgtaatcctagcactttgggaggctgaggcagatggatcgcttgagctcaggagttgaagaccagcctaggcaacatggcgaaaccctgcctctacaaaaaaatacaaaaattagctgggcatgatggtgtatgcctgtagtcccagctgtttgggagggtgaggcaggaagattacatgaacctgggaggttgaggctgcagtgagctgaaactgcaccactgcacttcatcctgggtgacagagtgagaccctgtctccaaaacagaaaaaaaggaaaaggattttttttaaaaaaggaaaaaaaaaaatatatatatatatactgtatctgatttctacctgttacatgagaaaataacaaaatcagaataatctttactgtttggcaagcttacagtaactagtactctgctccattgttgtggcactgaaaacatgcacgcagagtttctggaaagcagtttggtggtacacatcaagaaaaataacaatctttttgtggaaggagatccatgcacaaagatgttcactttgttgttgcactgcttatcaaagtgagaaattggatgcctcctatatatagctgaattaggatttagctgcttgctggaattatgtttatacagcaacaggaagagaaatgcttgtgatgaaatcttcagcaataaaattcaggatgcaaaatttatgtacaccgtgtgtgattaaaaaggaatagatgataaatgatgataaagaatatttttattgatattcacaaacgagggtagaagcatagtggtaataaatactcatgaggtatttgttagaatatttgtattataaagctaaataaaaactttatgtgaattccatccttacagccttgtgagttgggtcctgtccattgacagatgagctcacagaggcactgagtagtgatctgccagtgtcatctagccaacagttggaggagctgagattcaaaaccaggtgagcgtcccgtctctgcttctgactgctgcggcatgctgcctggtgctgaggcgggaagttgctgggggcacacggtggagaaaacaagcagcaacgtggggaacaccctacgtgccacctggctgagccatcgtagtccttctgaaaaattccaggtggttttggttgattacagggtcagtgtgagccagtacgtggcacatgccccaaaggtgagccacacatgacctcagtgaagtctttggtgcttataaataaggttgttgtttcattatttagttgtaagagcagcatttaaagaagaacctgaaaaccttagggatggagaaacctccttgtaggacggatatctgaaggacgcggggctcctggtttcggaaggggcaggagagggcgtacatgaagggctttctctggctgaggaaggtagacatagtatttgttcctctctagaggaggctttcacaagagcaagccttgactcagatatgagggagaggataactgggtgagcagactgagcggcgagctggtggttggaaggttcctgcagcgggtggacggcctctgtctctgaggaagttatagagggaggtgaggacgtgggctcgaaggccctggagatgtcttccagttgtgagactctggagtccagccttctccccgctgctggctaacaacaatgattggaatttagatggtgacttgtggaatcctgtccgcagtgaccactgcattagtcatggaaggagggtacctctgaaggaacacagaggtctgtgacttaactaacgtccaagtgttggcatgaatcatactttggttcagaggtatctgctatttaatttggctggcttttatagtcagccagtctgtgggccaacctgctggccgcatgcatctgtaagacatggggctgcagtttcatcagtggttctttaatcttttggttatcatagacatcagtaaaaataagaaggctgttttggatgatccctccaggaaaaggtacctttacataattttgcatacactgtttgggatgcccatacccccataaacctgtccgcaaacccaacctaccaagcaaaaaagctcagaccttgagcttaaatcttctaccaaatcaacacgatgacttcatctgtttcctcatctgtaaaatcctgcagagttgtaaggatgaaagatatttctacacgtatgtcatctccacagtgttcatggtagctactatctgaggctttagagaccatgtactttccaagggctgcttgtccctgagggtgaggctccaggatctcgtgaaaccacaggagtcagcttgcttcccaggggctgtgccctccatggagttgggtgggggcagcgtgtgtttttaagtcatcactgtggtgagcgtggggtcatggggtatgacgtggcaaaaatgaagggctgaaagctgcttaccctggcaaaatgcacattctgtaatgtagcgagtcagattgctttgccaacatgaactcttcctccattaaaggatgtgaatataattgggagtaaaatttctaatagcttgtactccccatacaacaaatgttgaattcacctcttggctttgaaccccagacaccttggggtagcctgtctccaggctaaaggagagccctgcaagttttttagtgaaacccccttcccaccacctccaacccccttctccttccctgatttggtctcagagcacccctaggagggaagcagctctctggttaaggagagtctagggtgagtcaagcagctggtagctcagttttaatctcatgccatactacattttcaatgaggaaattcctctaaatgtcatctgctccaagaagccttttctgttaccagcccccagaaaatgtactcctttccccatagagtgctgtgtttccacctcgtgtaatttacatcacagtggattgttttcgcatgtttatctttgtcttgctaagttgtgtgttggcaggtaccaaggtttattatctttcttgaatgcagatctcttagaagccttttggctgctctccgttacctgggatgaagttcctcatctctggctcctgcctgactctccagcccttccccatgctctggacacaccaagcgccttgaattccccagagctcattttgtttcttgcctttgtgtcgctgcactgaactgatgggctgagtctttctcacttattggatgcttgcttcttgagggtaggggctctgtttgatgaatctttgtgttcattagtgcttgctggagaatagactttcagtgtgattggattttattctttagtaaccagaaatattcttgacccgtaatggaagcacacaatgaatgaataaaagtaaatgcggatacattctgtactctaaagcctaaagggacagaaaccatcaacataaaaaaaaatatgcagtagcccagtctccactcttcaccctctcacctgccttccaagtgtactcctacaagcagtaggagcttcacagggaggtcattggggtgacgtttagttattcacacagactttgaactcatttgaacatcactggaaggatgggatcattaatataaggcaggatcaaagaggatgggatgatcatagacaacaggttttgtattttaatagcgcacaccttggcctgattagtgaactccattgctagctgcctgtgctgaacacaaccagactagatacatcctggggtaccatccacaaagactggctgtttcttgaggaatcacattccaagggacttcctaggaaagatgatggaaatgggtattgaaagtggaacaagcccggggtgttggagaaggcggaggaagtggcaggaagaagccggtgagaggcatccttccagttgctcatcctgcacgggagctctcaggggttatgaatagggaggacattcttgttcaaccccttctggttgtggctacttctgtcttgtcaaagatgatacaggtatactcagttccgaaggctgtgtccctcccgtcaccttgtccagggaaagctttgggagagaaagacatattctaatgttatttatttatttatttatttattttcttttgagatggagtctcgctgtgtcacccaggctggagtgcacagtggcacgatctcggctcactgcaacctctgcctcctgggttgaagtgattctcatgcctcagcctcctgaggagctgggattacagacacctgccaccactcctggctaatttttgtatttttattaaagattgggtttcgccctgttggccaggctggtcttgaactcctgacctcaagagatctgcccatctcggcctcccaaagtgctgggattacaggcgtgagccactgcacctggcctaatgttcttaataggcacaggcacagagcactgtaacaatctagccattagagctggtgcttcagatttctttttaaagttttatttattccttacgttgttattataaagctaagataagcttagtttagaaaatttggaaagttcagaaaagcactaaagcaagcaagtcttgagcctggcaggatctcagtatctttataaccagcagaggctcaggtgagcgctgggtctgaggcccactgcgacttggaacacagctctgcctcttagaagttgcaggatcctgggcttgttcacactctgacagtctgtttccttgtccactcagaggagaataaaataacatctagaaagcacttggcctgggacctagtatataacagccttgcatatgacagtttattgactgctagcaagtgctcagttttccccaccactgttagcattttgatgtattatcttttcaacctcctctctacatttcactttttgcaaaattgagactaaatatctaattttatgtcctcccttttttaaacttggctttctgctcctaccatattcctatatcatgattttaaaagccaacataatattccattttgtagaaatactgttaatttaaccattttcatattgttggaacttaacacattttaaattttcactctttataaatgttctgtacacacatctctgatcaccttgattatttccttaggatagatttctggaagtgggattatccagaagaatgatacacattagtaaattggaaatgaaaatatgttttcagccgtttagttgggatgattctagaaataaagttctgaaaatggttctctctcacgagatgtccactaagtagagaccctgttaagaaacagggatgatgtttgatttgaagaaattgcattcccatgagatcatgcgccacaagtgaggtcggaaacaggtggcatgtacagccgacagccggaggaaatggtctccactgtgcagagttgtgcacaacatcacaacattcgtgtcgtgacacacatttgagtagtaatcgtcatgtcatccgtctagggagagtctccaccaggctgctgccatagagaacatatgtctctccttaaacgctcccttcgccgagctgtctgcatggaaggttggaatgtggggtgtcagcaagtgcttttccctctgcctgattcccaagtggcctgtggtctggcctggagcaggggtttggagggtctttgttgggtcagcaaggaggctggggctgggtagccatgaggctggtgcaccctgccttcgttctgttatgctggtgacagcacttggtgttcaggttaatggtacatgcacttgactggaaggttgtacattgtcgctgtcttcagctcttagctcttatctaggctaagagctgaagatagcgacaatgtcattagcaaatgaagaaacggtttttgctgtgggaggaagagcactggactcagagtcaggaaacccgagttcttgttccagctctgctgcaaactcactgtgtgaccttgagcaagtcatcaccctctctgagctttggtttccatgtttagactaggtcatctttcaggatccatggaatgaaaggactcagcagtgagtatagcagccctgaggaggtggggacaatgagacctgtgctgccctgtggcgattttgagagttgagagctggatgcagacaggggctttaaaacagagaaagtaggctgggcgtggtggctttgggaggctgaggagggtggatcatgagatcaggagttcaagaccagcctggccaatatggtgaaaccccatctctactaaaaatacaaaaattagccagaagtggtggtgtgcgcctgtagtctcagctactcgggaggctgaggcaggagaatcacttgaacccaggagttggaggttgcagtgagccgagattgcaccactgcactctagtctgggtgacagagtgagattctatctcaaaacaaaaacaaaaacaaaagaaaaacagagaaagtattaacagtgggaacacataggactccctggtattcccctggggctaatgcctgtctgtttctgtgatctgctccttctctactcgacaagtcttacctgtccttggagccccagttcaatgtctccttgccatctgagtcctcagcgcctagcacattgcctgatgcattgtaagtgatcagtgcatagactgacatatctttccccaggcattcatcccagccatgagcatatgtgtccttgtatctcaccccagcataccgtcacatccctgttgccgggctggaaatagtaagttttatgtttgagatgaaaaaggaggtgattgaaggtgagttggctgggggacgcccatcctctggcagtgctgtgttggtggcttgcttcctcactgtgctgtgggccacactgacctgtcaagagccgtatctacatgtgtggcccgtagagggggcgcaaaggagccattcttgtcctttttgtatccagcaatttttgctgaaacaatttgcactgggccttctccttgataccagtttttttaaataacagaatccagtaaactaaaaagcacacaacaaaacctagtcattgcctctaaactctgtatgtacacatgcatgctggcttcatgatcgatttctctgccagagtctctcagttcatccttttgcagggattgatgggtttcgtgcagtgaggtgggggagataaaggggtgatggcttagaattgagaagaaacgaagtcttgtcctagcatggtctctgtgactcagattcttattttccaaagtccctcccaggtcagtgattattggatctggatcattaatgagaattagagtttaagatacatttgaacaagggggaggtgagagtgtgagctctttttagaagaacagctttcacaattctgtaaataaaagctgatagacccagtttgagatctttccagaaactttattcccaagctatttattttaggttcctgttttaaggttgtttttggcaaaagaaaaacaaaggcactgaatgattttctgttctctagtaggaaaatcttcaccttggggtgatctgcagcagtgggtcagtcagtgccatgttaatcatggagggatggctgttgtcgtggtgggcaccgtgctaggtgttagaggaagacacggggcttatgggcttcagcaggaagcttcaagttcatttgcaggatgaaaaatacatctaaaaatccccaactaggccagtgcacaaagattcccactgacctcaactggtacagtgtgagcatcagaagacagtgctgattgcagtggatgaaagcactgtaaacgtaaatccatgagatgatgatggtgatgatgagccaaagaactaattgatcaccttggggttgctggggatcaatacatcgtttagaagatgtataaggacaagaatttttttttttttttttttgagaatagagtcttgctcttttgcccaggctagagtgcagtggtgcgatctctgcccactgcaacctccgctttctaggttcaagtgattctcctgcctcagcctcccgagtagctggaattacaggcatgtgccaccatgcctggctaatttttgtatttttagtagagacagcgtttcatcatgttggccaggctggtctcaaactccagacctcaggtgatgcacctgtctcggcctcccaaagtgctgggattacaggtgtgagccaccgtgtccggccactaatttttttaaaaagaaaaaaacttaacctacaccaggtagtcagttgaggagcccagaaggagggatgataaggagtgcttttgtatttcttggtgctggaacataaagtctactatcagtgagaaggccggctcctctctcctaccaagggctggaggaccaagggctggaggcagcctgcgtggtccataaagtgcaccgatcctcctaccaactctatggtctggggcaggtgacatgactctctgaactgcacttgattcagaagaaaatagggataataatagccaactcttagtgctcaggttaaactgaacaaaagacttacaagccacctagtaggcgttgacctttatacgaagtcccttccctttgggtattcacttagagcaacactgaggtccagtcctcctcttggtttgagggacaccacgaggctgcatagagtcttcagcttctctcctgctgggctttgcattcattgcccagcaccgtgaaggaggacaccacggcccagctcccctcctttgtcatctcttgaaagacccatggctcagaaagcagcgagcgagggagtaagcaggaccatggaggttgcgttcctgtttctgtcatgcagtagacagtgtgtagtgacagatgcctgcctgtggccaccagcccccttcctgaacccaatgaaactaaactgcccatgtcttgaccgctaattttgagatagtttaaaaatagtatgtggtttgaaaggacctatccttcactgttaaccacactctagaattataaatagagtaaaacagaaggaattattgatccatctgtgaaactggattttaaaaatctaaaaattagatacttttgtttgacaaggtaaactttttaacgatgaaaacaaacatcgtgtagtagagtaggagagtggactttggaatcagaaaatttgggtttgaatcccagctctgccactttctgtgtttccttggatgaattatttgatctctttgagccctaattgcctaatagtgttatgagaaataatacatgtcttacgaagtttagaaaaaatatatgtgaagtttgtgctttgaataagtgacgcctgttgctgctgttacttttgttagtgttattggttatgcgccaagtgtggtaaactgagtctctttacctgattctttcattcttcctctgaccttgagagcatctcccagcaggtttttatcctttatgtagctgacgccgcaggcccagcgtcactgtgacttaccaaggtcatacagatatttacaggtggacataggactggaacctagatcttctgagggctcctgaggagctgcgtttgcgggtgtgtgtgtgtgcacatgtatgtttctgtcagaatttgtttgctgaatctggtctcagaaattcatttaatttatctagaactctcaggctctttactggaatgttaaaaaagaaaaaggactcaaacagtgaagtgagttttcttttgtgtctgctagatccccattagaaccctctagtcccccaaatgccactggaggtcaaagacatggtgcttcccccataggatgggtgagcagaccattcataggtcatagggattggctcagggtccaggactgccctccaggaacaaatgttccctcgttttcccacattgtcaggcccagcctagccattggcgttagctgacagtggtctcatttccccgagaaggaattcgggagctacagaggggctttcaggatctgtcccttggtggaggagctgcagcactaaggctgtctctggtggagttcacatccaggttcacaccgcaggtctggctgccctgttgtgcctgtaaatagttgtgttatatttccagttgaactgatgaaaacatagaaattaggtagccatgcagatagaagttgttttattatagactggctggtttcctttgaaagtgcctgacctagaagtgagggaattatattcaaccacattaatttaccagaatcacctgtgtcccctcccccattcctacccacggtttaaatcagaggtctgagatgggacggtggtgtctagagtttggtgaaaatccatgcatgcatttggcgtccagcagggattgagaaccactgtgccagagacccagagtccagattttcactctttcaggtgctactttgaggcctaatgatagtaaaatgccatgagatgtaagcacctggtatgttttttctgctcaaacaacatgtgtgttgtctaatatttcaggcacacgacttcgtcgaagatgaatacaacttagtctgtcaactctaagcacatccgatgtatggggaacacatttgccagactatttcaatataacatgctgagtgcaaggataggagaggtgccaatgaaatacccagggtgtagggcagagtcatggaaggcttcctggaggaagcatgagtctgtaggatgcagaggagtttgggagggaagggcccctgggtagaggctgcatcctgagcagaggcactggagctgcaaagaccactgctgttgctgtattaaaaggagaaggagctgctgtgtggggctctgaatcagagtcctgggctgcaggctagagaggaatggggcatctgtggttgagtttctgggagggggctgagtctggtgagttgtgccatcatttggtgaaggaagagtcctcggagaggtggaaatgttgtgtgtccttggccatctcatctgatatgctgaggaccactggacgtgggcaagggcttcccctcttgcataccacacttgttctttgggatctgttgccggcaccacgggttgttgttgggataacgaagctatttctgttcctggtgcagcttgacttttctcagatttttcttctgctgatgtgttcagtgttattcacaaccgagaagaacctggtggggagtgagggtggcatgcctgagactcacagcacctccgtcattctgttgcagctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctggtaagcagctctgtgtatgaaatgctgcggttacttcagttgggaaagtggctcagtagaggatagttatggtttgtttgataaactaggaatgcatttcatagttccttgggtacccaaaagaattatgtttttatacacattgggtcagtttggaataaagtttaaaattgtaatttttactttaacaagacttaaaattcagctctgcaatttaaatgtacacagctatgggacaaaatgggtaaatgcattcgtcttcttaagggcctctgacttgaatttttaacagtttctaaactgtgtagactactctccttctggtaattatagtaggcatttaagcttataatatttaataaatatgtttcaggcccatcttacacagcaaggtaacctgtaatcaaagcacagaaattaccatgaatatttaaaggccttttgtgctcccaagtgtagaacctaaaaaaaagcaggactgagagcaatgcctcggttttcagccgtgggaatgcggtgctggtgcctgctgcctgtggctgctgcttggtgctgtgggtgaattgcgcctttcttgtgcctggcagctctgtgctatcctcgtgatggggacaacattttgaagaagtgggcagcccaagagggctgtttgggaccctgcccgggtggaatggaccctgggatcgctccagcttttctttcctgtttttcttctccagtttctcctaaaggtcagggaaggccaggtcaagaactcagtaatgctttctctgtaggccacacacaacagcatctttttcgtgtcctctgttaggaagctcataacaagtgaaaaacatagctcattcctgagatggtgatgacagtggttttgggagaccggccttagaaggggagaaatgagggagcatcacatgtgagttcctaatgggaaggggaagagcaggagcactcgggcccttgctctttctccccgtcttcacttatgaacatttctgtaggaaatggtaaaagtaaaaaactgtttctctgctcgagcttttcacttagaggaatttgaaatcccctggggctttggtcaagctcatcccccttcatccttatcctagagtggcggcccacctgctcagcagtggagccctcgccctgcctcagccccatgccctggacactggcaggcatgcatggtggggtctcatcaccaggtcgggaaagagtggagattttttttaaactggagaaactgcatgggcccagggtaaagatccgtagatgctgccatggagggcgtctcctggtagaaaagtcagttggctgcctgctctccccgcacctgggtggataagccctttccatgcacacagagctgcctgttagcttcctggtgcctcacacttcagtacagatgagcagcctccagcatgagggagaccagaaatagcagaaaaatgaacgtacgggaagactgggatgcagcatgctatgaaagaaggccagggacacaactatggtaagaaaatataacattaaaaatccaacaggaagggctggagtagaggaaatctctcagaaaatagatcaaaaagaccaaaaagtgggaaatagataaaagacgaggattaattctcaaggcccagcatccaactggcaggtgttttagaaagagagaaggttgtcatcaatgcaacaaatctaaaggcaatttctaaaaatggaacggaagagtctccaagttgagaggctcacaagtacccagcgcaataagggaaaagacctaccctgaggcatccctgtgtgaacttgcaaaagatcttaaaagcttccagacagcagccggaggattcagaatcagaatggtggtgaacttctcagcagcagcactggaaacgttatggcatggagcaatgccattaaaatcgtgaggaaactaactcagcctggaatgatgcccagccaatcaaagacgagagtagaattaaagatattttcagacatgcaaggcttaaaaactttggctcccatgtgtcatttctctgaaactcctaaaggatgtgttttagtaaaatgaagggaaaagccaagaaagaagaaattgagagtcaggaaacaggacccaacacaggaaagcaagcagtggaagggaattccaagaggatcatggcgaagggaagtcccagcggggctgccaagcagggggcctagaaagcagccagcccaggacggctgacgacgtaggagacgggtggaggcccgggttctgcttctcactcccagactgcccttttacctttattcagctgatatctagacctggattgtctcagctgtaacatggagataataataccatacctgattgtgtggatagattatagccagccggtgactcttacacaggatagcttacttaattcttatgacaatcccataaggtcagtcaatgtcatccccactttacagattagataactgaggccctgaatggtttgaagagctaatatctggcccggcacagtggctcacatgtgtcatcccagcactttgggaggccaaggtgggcgggttgctttgaacccaggagttcaagaccagcctgggcaacatggggaacccctgtttctacaaaaaaatacaaaacttagccaggcgtggtggctcacggctgtagtccctgctactcgggaggctgaggctgaagaattgcttaagcccaggaagcggagattgcagtgagctgacatcacgcccctgtactccacctgggcgacagagagtgagaccctgtctcaaaaacaaaagaagcagcagctaatatctctctggaggggctcagagtccttgcctaggcaggcccacttggagcactccacaccatggaatccggacgaaactaacttgtctcagttaacaaaagggcagctgcatagttaaataaaaggaatccctccttctcctttataaaatttcctgcaaaagcagaaagcagagcagggcctgcatgttacagctggtacattgctcaccaccctgtggctttgccagtttttaatacttcacatatcactgcaggtcctagttgctgtccagctttctacagagagtaaaggtatcaataaaggtatctgtggcagtgatttgatgagcacccaccggtgtagcaatcactgggctatgcatgaaggatactctgtttcatttattcctcttggcagctgtgcaggatagtttgtatcaccatcctcttaaggcacacagtcacttacagggcccttagctagtgagggacagagttgggattcaaacccaggtattaacactccaaacccaagttgttgtcattgtgacatttaaaggaaccatggcctcttgtcaccttcttgactgatcataagggttcaagtttcaacttgcactttatggaagtcggattgttgatcctatttcctggcaaagatcaaagagagagaaaatttcttacatgagccaaaattagcactcaccatgcctggttttccaggccagcgccggtgtggaagctgcacagccagaggaaggcccagtggcggctcctgcaaagctgggcaaatggggagcggattatggcggaagtctccttttttggaattttgtgcaccattcttcttcctgtttttggtcacatctggcttatctcatatcttccaagccttgcttttgctttccctcgggcatttaaaacatttcagttctgtctggctaagactcacagtgctacctcttgtccagaaagaataacaattaccacctacctgcttggaggcgtgaaagaatgtttataaagcagttggaagatctccagagaaatgccagcttaatataaagcaagattttcttactaatgggtgagattctcacctgcagaagtctgtgaattttctctgcggtgatgcaggatgaaagggaaaaccagacggctccagaaatgtgacatgtgtgaaattaaagtgcttatgaagtcagcctagtttcaggggttcttttcctcttccccaatggatgtgagaatcctggaaagactccaagggccacctctgtgctgagaagtggctttctaatgaaaggctgcatttcagggcaggtttctgaaaggtttgttacagatatgtagtctctgtctccagtgttagaggattgttagtgaaagatgtcctcacggtctgcagaacccgctccacatgaagatcagcatccattgaaagcaggagccaatgggtgctgaggagaggacagagttgcagcatgagatctgaggtgaccctgggctaaggagttttccctcacccatgttgatagaggaaatggaaagctctaccaagcaacgtgtgtatccatcatctttttttttttttttttttttgagacggagtctcgttctgttgtccaggctggagtgcagtggcacaatctcagctctctgcaagctctgcctcccaggttcatgccattctcctgcctcagcctcacatgnnnnnnnnnnnnnnnnnnnncgcccggcctttttttttttttttttcccaaacacagatgatgtgagttagaagcctttttttttttttttttttttgagacggagtctcgctctgtcgcccaggctggagcgcagtggtgcagtcttggctcactgcagcctctgcctctcgcgttcaagcgatccttctgcctcagcctcccgagtagctgggactacaggcacgtgccaccatgcccagctaatttttatatttttagcagagacggagtttgactgtattggccaggctggtcttgaattcctgacctcgtgatctgcccacctcggcctcccaaagtgctaggattgcaggcatgagccaccatgcctggccaactttttttgtttgtttgtttgaaacagagtctcactgtgtcgcccaagctagagtgcagtggcacgatcttggctcactgcagcctccgcctcccgggttccagctattcttgtgcctcagcctcccaagtagctgggattataggcgcgagccaccacacccagctaagttttgtatttttagtacagacggggtttctccatgttggccaggctggtctcgaactcctgacctcaagtgatccacccgcctgggtctcccaaagtactgggattacaggtgtgagccaccacctgtaataccaaagtactgggattacaggtgtgagccaccacgcctggtcagaagacattatagctaaccttactagggaggtagtaaggttctgttgggacaagcagtagtttgtggctttctcatatgtgctgcacctggcagaggggcatcctggcttggctgcattggtactagtacagcaggactctgcccagtgctgtcaggcttaggttaagtgtgagctgattgtccatattagtaaggcttgtctcgtcactcaatatagacatcttgctaccagaggtcctcaccctcagtacttccatagactttctcctaacttcttgtattgcaaatgtcttagattcttaaatgtcttactttgttttttaattaaacaagagcaatgatcatagtatcatctttttgggaggaagatttaagtcactgttttagacataaactaatgaactatgctgaaatctagagacatccccagtggcttggggtacgtgggaatatccgcccttggattagtcctggactattattaggtgtccgtttctgacatttgctttttaatattctgacactttttctattggttgccctttttcctgctgtcagtgcttgggtgcctctaaggtctctgtttcacgatgctgcgagctgaagagcaaggtgacttggcttgttagacttgggtgcaaattaggagtccataggcttcgcttgaggagggcttgagggctagggctttgagtgaggaggggagagagagtaccttgatggacttgctgacagtcgctttgggcccctagaaacctctgccatttagattttggcatggcctcatttatagttggaaattccttatctaagacccaaaagacttcaacgctaagctatgttctatactcacaaatctctaaccaaaaacaaaagcacattgtttgatcgagacaatgaacaaataaggctggtgtcagatatctacattttggttgtggcatagccacataatagatttccattggacttggatactgtttctttttggggttgggagggaatgctgtgatacggtaacccccatacagagaaagtgggagaagccatattgggcaaagatagcatggtgaggccttgggcgtgggagggagaactcacagagacgaggactgggcacctgctgggtgctatccatgcgctggtgctgtatggggcggtgacctctggcaactcctgcctgggcaggggacacagatgcttttattagaagacatgtgccgggacagccactggcagcctgcggagccctgagggtacagcattggaagcagggagcagtgactccccgccctgagccctgggtccctgcttccctggatccctgagggtggaggggcactgcagtatggcacttgtccatctgcacacaagcctgcttgcaaggtttagaaatcagtttcttcacaattgtcaaatgtgtgtaggacatgctgtttctgtttgaaagtattaatgaacctaaaacagggtttgtttttgtttttgtcattgtgtgttttcttaattgctggctattaaagggacaactgccacgatgtaggtgacctcaaacttagaaaaaaattgtttgccaaatctacaaggtactgtgtggaatggctctagtggggatgtagatagggggtggaagggctgtagggggtgtagatatgcggtggaggggctgtagggggggtgtagatacaggtgggagggctgtagggggatgtacataggtgggagggctgtagttgtgggggtgtagatacagggtggagaggctgtagtcttgggagtatagatattggtggagaggctggagtagtggagtatagatattggtggaggggttgtagtattgaggtatagatattggtggagggggtgtaatagtggggtatagatattggtggaggggctggactagtggggtataggtattggtggagggggttgtaatagtggggtatagatattggtggaggggctggagtagtgaggtatagatattggtggaggggctggacgagtggggtgtagatattggtggaggaggttgtaatagtggggtatagatattggtggacaggctggagtagtggggtgtagatgttagtggagaggctggagtagtgaggtatagatattggcggagggggttgtaatagtggggtatagatattggtggacaagctggagtagtggggtaaagatattggtggaggggctagtgtagtgaggtatagatattggtggaggggccgtaatagtggggtatagatactggtgaggggctgtaatagtggggtacagatattggtggagggggttgtaatagtggggtatagatattggtggaggggctggagtagtgaggtatagatattggagggtctggagtagtgaggtatagatattggttgacaggctgcagtagtgggtatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccactcacacaatcatatcttcactcacacacaccctcacacaatcattcacattcacccccaactcacatccacacacacaccctcaaacacacacatgctccctcacacacctacacatactcacattctcacacacacatgtgcattcaccttatactcagtcacttacacccttacacacccacttacacccccacaatcacaccccacactcaaatccacacaatctctcacatccacaatcacactctcacacacccacacacccgtacacaatcacattcacgcactcacatccacaatcacacccacacacacccatacacacatttacacacttacacaatcactcacatccataatcacatcctgaaaccctcacacgcccacacacacccatacacaatcacattcacactcacatccacactcacactcacatccgtacacaatcacaccctcacacacccatacacaatcgcattcacacactcacacaatcacacccttagtcccttaacatgctccctcacacacctacacgatcactcatacccacattcactcacatacaccctcatgtgcattcactcttatactcaagcacagtcacacctttacacacccacaacaccctcactcagtcgtacacactcattgacacacactctccgtccccaacacacacacgtcttttctcattcgcacccagcattcgctcgtgtgcctttgcagcagacagaagactctgcctttgtttcccctgcttggagcttgctgtggagactggggcctggggcccagagcaccaaccccagtacagtccagcttatgggtggagccgtgattgagagtcagaagtgggggtttccttttattctaggctttcgacgtaattctgtcattgaatgttttgaaatattttttcttcactgcaatgattgtctctttacaaactttctagcataacaatataagattgttactgtgaaatatatacagacctagacttttcattagccctctattcatttgtaagatgaaattgttacaaagaatgtatgactgaataaggcacagtacatgcaccggccaggttttaggtggaggtgaatcattatcaaatgttctctctaatgtccttgctgtccttactttagattcacaaggaagctgaataagaatctcctttatgtttttgttttttagattcagaatatgaacaacataatctccttccctttggacagtttgctgaagggggacctgaaaggagtgaaaggggtatgacattgacactgtgacaccaggggcagcttttacaccatgtagagtcacagtagcttggcctgccgggcagcagccacgccagtacgttctcattgggacgataggatggctcttttatctcagcttcctctgatttgccatcttgggaccacctttcagccaaaaaggtggtgacttctggcctttctggccgtcctgttggcacaacaaagttggtgaggggaggagactgggaagggaaagaaaactgctattttggaaaaagtaaagagtttcggtctctccagggagcagggaaacctgtgggaggagtcgggctttctagctggcacgttgcccatttagcactgggaaaggatcctagcaagggtgtattttcctgctgggaaggtcgcagtcgtcaggcatgagccaactttgtctctctgtccttcagaggatgttggctgtttaggacatgcctagccaccataagcacgcaggccaggagctgtttaagggggcagcagacggggctggaggggcgtttgctcatgagcacgcaggccaggagctgtttcgggggcagcggacagggctagaggcgcgtttgccaggcagcgcgctgcccctgcgcatcgccagccctgacagacgtgcaccacggaagggacgtgattgtggctgccttctcgggagactcaaattctttggatctgcgcacgattcctgggtcccatcggggatgactggaaacccagtcttgacccatctccaggacctctacagaggcctctcagggtctccttcacagagtgtgcccggagagagctgttcagacacattccccatcgagccttcaggggcttggagaacaggtcagcggagttagcccaactcacgggcgggaaggcatcccaggcagaggaaaggcgcaggtgcgcacagggagcagggctcagtgctgcatgtcaggctgccagggtgcaggaggagccagttcgtgcagggacttgtgtgccaggctgtggcacttgggccttacctgaggccattgaaaagccaaaaagtagtcaacagcaacaacaaaaagatttctgtctccctgaagaacccctttgaagggagcataaataggtgaggaccattcaatagaatttccagtggctcagtagtttttgaggcaggctttaccagagtgtatgaagtcctgaattgcacacggaagagcagtaagagaccctaggaggatgtggcggcctttctatttctgtcgttgggcttaaagcagggttagatgtgatgagattcatctatcaattagagttcctttcttttagagagacatcctgaagtatttgcagatgaaaggttgtctttcaggatttactttcagattaggcccagggcagggagtagggcacaggtgacacaaggtggcccaagagtgtcataactgggtggcagcaccttgcttttgtgtacatttagtatattctatattattttaagagaaagaaaggaaatgccaccactggtctacttaaaagcatgtactcttggttctttatttttcgtgggattacatacgtcatttattgcagaaattaatgctcctttcagggctagtacagggataagtaagtttatcttgcacagaagtgaatgattagtcttgcctaatttattattctttgtttacaggatctgaaaaagccttttgataaagcttggaaggactatgaaacaaaaatgtgagtgttctcgtttttaaatttacgtataggtaatttgggatttcaaatttaaaccaacctcgtattgcttaaagggattgtccaaataaaccttaatccagaaaagaatgtttatcagccatgttgctgtggttcattttgatgacagatgtgtttggtgatgctgtcttcttcttctaatctgttttcttctgttcctttgtctaagatgtcatagtggttataggatgttattttcaggaaagttcattgagggaagttaagaccaatttctcttaggaggtatttctttctgtttttgtttttaaacactttgtccattccgttactgtttttgatagcagggcagttttcagacttcatcttcctggtgatttgtgaaagctgcttagctttgtatctgtgtttctctgaaataccagttcccttggttttagaaagagggttcaatacctgtctccttcagattcatctgccaaaaaataacctgaagaatggagaattgattcttggatgtgaactacggtttctacaagaagtagaattggtttcctgacccgaagtcaaccaatagacaagactctgttggttgacttcaggcagttgtaacttccccaatcacagtttctcatccctagagtagagagagtcgagctacagggaattgatcaagcaagtaattatggggggaataatggcttcaattattttaaatactggaaagatatgaaatgtggtgtttactttgtaatctctgtgtcttggagtgctctgaatggaaatagaaacttccatatgaagctatctgttaaactaaaaggtgttatgaggaagtcatttcaaatctaagtacaagtatttcattagattgtttaaaaaaaaaatagctcaggatatctttccagtggtgaaggatcacaaagctcaaatcagtgagccccacacctttgatactccttctatccatgggaatcttacatttccatacccgaggttgcttggccccgagttctggagtttcattgatggtgtacattcattcagaagcacaggcagagtgttgactagagaaccctgcaggtccattcagcccagggaggcccccacccaggatccctggtccgtcagcatcctttatttgtgtgccagttgggtgaaataaatgggaagggaccagcggattcctgctttgcagagggaaaaccaagagtcagtggtttctgcttgtcagccagtaagagtaattgagccaggccaggaagcagctttcccacttcactcagcctcccttgctgcccgtctctgtggctgataggaaatggtcctgtgtgtgactagaccaagggcagaaagggctttctgaagaagagtgcctgagagagtcatctggttctgaaaagaaaaggtttggaagaaggataacatcaaattctgtaaaatcgagacacacatgggtaggatggggacagaattcctcacaaaaccctagaatttaggaggagggagcagcaccctttaaacttgaagtaattgtaggataaataaaggaaataattctttattaatgtgggagattcatttatcccaagaggttttgtgatatgtaacaaccataataggttttagatgtctttaaaattcctgggcagtagtcccatacctgattattaagagaaatgaccagtgtctggacggtctcttgcctgtgaaggagtgtcagcgacaccttggagttgtataattctagtcccagggaccctccagtcacactcctttccggatgcatagactcattaaacaacaacatccctcccaaagggtctcctgtgtgtttatttttcactcattcactccttcaaattattgagaacctacacagtgcaggacacacagagaaatcacatttcttgcctcttcttaaacactctagtcctccttgccctaatgacagggagccctctggaaccctgagtagcccatttcatcactggatgcctttgaaagaacatgctacttgggtcttctggtgtctacttcaggctctacagaaagagctgcttcccttgtcttcatggcagccctttctgttttttgagtgctttctgttggttttgtttagtctccttttctccagaataaaaactcacggctatttcaagcccaccttagcagccacgattaccctggtggctcttctttggatgtgctcattggtcagtttttaccctgaactgcacactcgacatttaggtaatacaggttaggcacaagatgaatgtagaaaggataattaagccgacagcatggaaaggtggttggtcgtcttctacagtgatgagcggtgttgtaggtcaaggcagagagctggcctggcttcactgagtgaggaggtgatgacagagactagggaggaagtccaggaggagaaacagtgggtagggaagagtcagacggtgcccttgggttactagagggcaggaaggctctgaatgctgatgccaaaggagccctccaagccctgtgcagacttcctacctcctctgacccatacctgactcaaagcaggtgcctaggaaatacttgttgagtaagtgggaagacccggtttgacatcttcgtgaggacacccattttccttttgagggagttgagaggctgcctgtgctgaaacgtgtggtgagcgttggtctcgccaggctgggtactggggtggcttcaaggctgtcccgttgagttctgtgccaacaggcatcttgatgtatccttgctttcacacgtagaaccaagatagaaaaggagaaaaaggaacacgccaagctccatgggatgattcggactgaaataagcggagcggaaattgccgaagagatggaaaaggagaggcgcttcttccagctacagatgtgcgaggtaaggcggtggtgaaggcaggtcctacagcccaggctgtgccggctctgccctcacctgtgggagcatctcactggtaccagcggcttcagagaaaacaccacatgcattgctggactccctttgcccctgtgttgacatttcttttactagggaagcgttagcctcctggagggtagaattaggttactttaacaccaacattttcttaaaagtagagaaaaaccactaaatgtctagaatgttctttctggcttcacgtacgtactcttgctaaaatatttattccttgggtgtatttaaatgagatctctgagttcccttgtaccaatggagtcagtgactggcttgtgggagggtgagaagtcagctgaaaacaacatacagcgatgacagaccatggcctgtgtcagtgtctgtgagtggatgggaagtccagtcacctgttttgacttcctgctagacctcacctgctcaggcgggggcactcatctagcccgaaggcccaggtggcctggggagcgcctctctgctccactccattccacccgcagcctcagcccttcccttagtgaggcggagacagcaggatggacactctcagagcatttctctgagatcagagaccatggattatgaaggcctttgctcacagattttttatttttgtgccttgcttgccaggtacgtgtatacaaatggcacatggaaacagctgccacctctgcctggggttaattcctcctggcagtgccagcgaagctcccttgcactggatggtatttgtttccctctcatagcagtgcaaacttaggtttcaaatgtacacaatgtgtgggtgatgtttgtgacaggcactgaaactggcattggccagctcttaattccctctgagcaatcaacaacaaagctaatccagaaggcactttctgattttggaatgtatgtttgttaattgtagcaggagcttaacccttataaatacatatatcttagaaatgtatttaaatgagtttttattcccagagcagactcttaagtggtcagcagagaggaatcagtcccaggaatcagggtggcagttgaaagttaagtccattttgtctaatgttagaatatctacttatcttagcctgttttctgttgctataactgaatacctgagaatgggtaatttataaagaaaagaaatttcccagttctggaggctgccaagtccaaggttgaggggctgcatctggtgaggaccttcttgctggtgggcgctctgagagtcctaagtcagtgcaggacatcacatcggtgggggcctcacaagagacagccaaactggctttttaatagcagacacactcttctcataattgtaccactcccccagtaatccatgaatggattaatccactcatgcagtgacctcccaaaggttctaccactcaacactgctgcattggggaccagtttccaacatgtgaacttttaggggacacattgaaaccatatcaccactccagctcttttggttactatttgcacccttttacattcaacctgtgaatctgaagtgtatcacttatagataatatatatagctggatcatgtttttcttatcagtttgacaatctctgcctttcgattggattgtttaatccattaacgttgaatgttactattgatatgattggatttacttctgttattttacttttttttatgtctgtctcgtgtcttttgctccttgattcctcctttaccgccttgtttttcattgagagaatgtttagagatattcactagatgaaaaacaagcaaatatttttaaatattcacttgatgaaatgaattctcaagataaagcctttaattaaacttaaagggttcttatagacaggagaatggatgtttttatacacatttttttgtaaacacatatcatgtgtagtgtaagaggttgcattctcaaaagaaaagcacataccatgtataataccaccttcctggcctacctcatagagtggcagagaaatcagcgagacagcatgagacagggactaggaaactgctgtgtgttatacaagcacaaagtattggtttttgtttttgtttttctcaatcctgcttctgtaagggtattgtttctaattaagtactgtagtagcattttacaaacaatcagggtgaaattaagtagtagtgttttacaaagaatgaatttggaaaggggtgtttgtgttcaggtcatgctctttttggttagtaaagtagacatctatttacctaaacactttaagactacttaaaatgcgtactgaattttgacattcaagtagtatgtgaaggtcatagccatgacttgaggagtaattggttccccacttggctctgtcgttgcttcctgtggtatgcaccttgcactggttactacttctcttctgtatccaggtgaattgatcctgtgaactgactaagtcatttattttaatggaaatacactgtgtagatgatgcctctaagtcatagacttgagccatctttcgagcagtcctcaggtagtgctgggtcctggctctgcagagctggcacttggaggggtcaggcactaatgtttcacagttgagtgagagctgtactatatgcatgcataaaagcagaggtgggcttatctaacagtaaactcacagttttcacaggagaagacatctgatgaagagtgtagaagttggccagatagtcatgggccgtgaaggcctttctttccatgggtgagaaagatcatttgaaaaacagttccttgagaatccaactctgaagtgaattagattgcctgcattaaaatcatgttaaaaggccgggcagggtggctcacacctgcaatcccagcactttgggaggctgaggtgggaggattccttgagcccaggagttcaagaccagcctgggcaacatggtgagaccttgtctctacaaaaaaacaaaaacaaacaaacaaacaaacatgactttaaaattatttgactgtttccccaaactgaagttctcaagctttaagtgcttgctgttgtttaggtgtttaaaatttgagttgcccaggatctaatccagaagagtggctttcaggcttttattttaaagctatggagccctttcttcaaaattcatttaataaagaaattcagtatgtcaaataggtagtacagaccttctgtgagcggagaaggcgtgagaagatcctctgttgctgattgtaaaaatagtatatacttttaaagaaaattggttaatataagaaaatatatataaaaggaattaaaaatcgcccccaaattttacttatccaaagataaccactttgacatttaagtaaacatctttatatgtccctatgtatacattcaaaaaaaatcgtataagtagatctttcgctgctgatgctttataacctattttcactctctagtatgttgatgtccatgtcagaaattttgggttttattggcttagtggccgcacagtattttctgtatggatgcaccatatgttaatttcccactcattaggtttggactgttgccattgtttacttttataaacaggatagcagtgtatcttcttttctgttcatctttgtaaacttttgtggttatcttcttagaataaattcctgggagtagaatttctaggtcaaaatgtacatacgtttaaaaatttgatacattaccaaatatttaatatcaaaaagaaagagggaaagaaggacctataggtggttgttacaggcagaaggacaatttgtagcttacagtttcacagcagctttccacctcctccttgggctgcagagagacctcagccagcaactgaacttgggtacccctaccccacccccgcccatcctttacagctgagagccagggcatgaatcagcagcttttccaggggacattccatttcagagatcatcttctgacagcggaggggatggggactcatgaagtccttctatttcctgacactggttttgtagctccctgaggctttctgatagcttcgtggtcactaatgaattctccaagttaaaaatagctttaattcatttcaattaaactttgtttttttccaacaatcacattattttccttgtaagggaaatgtctcaggacgagagacatgatgccaagcatctcagctacaatacgttagcagttattgttcctaaagtaagggaccttgggcaggagtgtgtttgagatggttagaaatcccatttatttgaaccatccatagtcttccatgtagctagagtgaagatttctcctagcaggccaggatagactgtcttattattaggagtttttggcacttcaatatttaattatctgactgtcagataattcatatggccccaaaataaagaaacggttacggaatccaggcgatactaagtgtcgatcatgcactctacgcattgtaaaagatgccaaagaagtagaagaaatcatctcagtcctcagaagctccttttaaactcgtattctgcttacttccatgacatttccttttcattgttcaacagtatctgctgaaggtcaacgaaatcaagattaaaaagggagtagatttacttcagaatctgatcaaatactttcatgcccaatgcaagtaagttcttctctgttatgttatcttaaatgtttgttcatgtgtggcaacttctggtagatctatagatagctcataggaaataaacaccacttagaagtctatagtaaagggaatgaggtgctgactcatgcgacaacacgggtaaacattgagaacacgttcaatgaaggaagccagacacaagaggccatgtactgtatgatcccatttatttggaaggtcaggaataagtacatccacagagacagaaagcaggtgagtgattgccgcagcttggaggaagaaggaaatgggaaatggctgctaacgggtatagggtttctttgtgggatattgaaaatattccagaagtgagtgctaatgattgcacaactttgtgaatttactaaaaatcactttaaaaggatgaattttatggctttatggcttagggattatatcttaattaaaaataaaagcatatatacaacataaaaaatctgtagtaattgccagatatatttatttttggctctttttgtagagggacaaactcatttgacctattccgcaactctcagatgtttgttaaaagagaaatgatacgatgttaatgcagtgttttaaaataagaaaacacttttatatattatcctgtggagccaatgactgtgatgagcaaaggaagatgttagtagaggagaaggagaggattccacgtgcaggggctgctcaagtactcagctttgccatctgtgtcagtacttcagtctgacccacgtctctgacctggcttctgctcctcgacccccagtcactgatatagacaggcctctggctccttcactcacccacccaacacacatgtcaggtgctggaccagaggcgagagacacagtgatgtacagtgctggcatagttcctactcaaagagtcaagtagggaagttagactgaaagagacaaatttctaattagatgtttacaaaattgttttaaagtataggaatctaagaaagaatataatacagggacctgatttagataaagatttagggtagagttttttgttttttgtttttctattttgttccctgatacagtctccaacagccagcacacagtgcccggaacacagtaggtactcggctgtttcttgaatgagctgcaggcctctctgaggagacatggatctgagatctaaagtatgagtaggagccggcagataaggagtgggggaagaacattccaggcagggtctaggtcttaaggcaggaaaaaggccaaggtgacataagctcagtgaaaaaggagagtggcgtgaaacgaaactgcatggaaaagccttagggatgtggatggccccagacatcttgcaaaagtttttagattttatcccaaatatgttgggaagctcttgaagaaattgaagcagaggaccatttgtatgcactcctgtgatctgccaggcgctattaggggttttggtgatgcagtaaggaggaaaacaaagttcttgccttcacggaccctggggtctcatgggggaggcaagtaggaaacacgagccaatatttaactgagtttatgaaaaggcaaaacagtgatggggagagagacagtggtgttggttagaagcagcttcaggaagcttctcggctgtaacaagattactctgtgtgttgtggagaaggaaccaaacaggacaagggtggatgtgggcaattgcttgtgtacacagctcctgtccctgtgcagaccagagatgacgatggcccacctggcttcgtgacagcgggagtggaaggtgtggactgacaagaaatcttttccttgtggaattgccatgcctgtctgcttaccttcccagagcaggctgtgccaccagcagcctacctttgtacagaattgtttcttttcctagaaggcctctttcctttgtgccctccctgtcttctgttcctcctaggacccagcttatggatcattcctgctttgcgatgcttcttccttttggaattccttttcttcctcctgtgttgccaccacaccgtctgcttgtctccatgatgacatcttccttgtgtctctgtgccactgaactatatgctcttaaggaaggggccatgccatttatttgttttatatctacagtgtgtggcacatttacctggcacgtatttgcagcagtgaattgcactgtggaattgaactgagctctgctttggaattcttaatacagctttgatgatgttgcatttctaaagcacttgaggtcaggcggcaaaggaggatgtgctgagtggttcatccaaagttaaaagagagcttcagccatttaaaaaaaagaagagtgaaatcatgtcttttgcagcaatagggatagaactgaaagtcattatcttaagtgaaacaagccagccgcagaaagacaaatatcgcatgttcccactcctaagtgggtgctaagaaaggcatacccatggatgtagagagtagagtgacagcagagtctcaggagggtgaagggagtggggatgatgagaaattattaatacttagtaggtacaatgtatgttattctggtgatggataccctaaaagccctaagttgaccaccaggcctataacaaaactgcacttgtaccccatgaatttatattaaaaaatataaaaagagagctcatctctacttggtggaaaagaccttgcaattatatagttttcaagatgaattattttatggagactcaaaattcttactttgtgatgagcatgcaaattacttctacagttcttatgtcaggcaatttaggaagtgggtcgcttccttgctgatattttatttttaagaagaagctattctgggatttccttcccccgcccctttattttgcccaaaccagtcagttgggtagcaacagaccacttgtggaaaagtgaagtagttggccttttatggacatgatctcagtaacctttaaaaatatgaatcttccattacttcgtttttggatatgagagagagtgtgtacgctgcctgctcttcaaatcagtcaggcagctttgactttctcaattcacattctggagggtacaacgtggagctcgagcaactcagctgcagagtaagagctcgcagccgtgcgtgtttccacgtgtgggagcgcctctcattcccccaccacacacgcccagtttccgcttctcgcccccaagggcacagctttgcctgctgggtgctgtgccctgctgggcacacgcgggcctctgcacactgctgtgctccgccagggtgaagaggccactgtgtaaaccagattccagggctcaggtttggctgttgacccttggaactacgtagatatgcgttattttgctttttcttctcgctttaagtgttcttaaagaatacttcgtgttcttttatttttatttcatttaaggaaggaattttcatctctacctctttcctggaatatcttgaaaacttgtcttattagtctttgctcctgaacattgaagatcctgtactctagcggaatctagaagtagggcattataacattataaaataaagacagccatggtttggcaaggcatggtggctcatgcctgaaatcccagcactttgggaggccaaggggggcggatcacctgaggtcaggagttcaagaccagcctggccaacatggtgaaacctggtctctactaaaaatacaaaaattagccggatgcggtagtgcacacctgtagtcccggctactcgggagactgaggctggagaatcacttgaacccaagaggcggaggttgcagtgagctgagatcatgctgctgcaccccagcctgggcgacagagcgatttttttttttcaaaaaaaatacaaccatggtttgaaaggtggtgatgaatgttgaattgacttgttctttgagccaatacctgctggaaaccactgtgaccagctgttgctcagtgaacttggaatgcatggtcaagataaggctcagccccggatgctgcagaagcttgcagaggagggaggggcgggtgtcacagacagaccccatcagcagacaccgcattggaatgtggtggcgtgaaggctgcaggaggggccctggcacggtgtgtggggcccagagaagaaaggagctactctgcttggtgggtttgataattgcctctaagtgggtgtattttaaaggatagaaatacaccccttctagcctggtgaggcaggctagaaaatgtttaatagacaacaaaatttgattgggtaatgttgatggtaaaagttctgtgaagcttggaaaagtgttaatgggctcaacttaagaaaattttctggggctatgtagttaggactgtcatagggacagcagccagcggagaaggaatagtgttccttttcttgaagcttctcctgacgccagggctgactgcactttgaaggggcgtctgggtgccaagacacacctcaaggagggtacgggaaggtcagcactttgaaaaatcagagggaggagattttccaggtaggtggatggtgaagattggctgggctattacagagatgaaatctaaatctaaatccaaattcatattgttattccaagtacaccattcatcgtcatgctggaaacagcatcctgacgagaagtctctgagcacttgattccactacggggctcatgctcacgcgctctcactctcgctctctgtctgaccgtagggagaattgccaggtcgcaaagattcttggagctgtacacctgctccctctccctgggtggttttgcatttatcacctgtaatatttttcctactccttatcttagatcttagagatctctgtcctcctatctatttcacaagaatttgaaatgattaagaaaatagttacataaagaaaaacacgtaaataaaatacaagaattagatgagttcagaaacatattctatattcagaaaaaaacgtattaaaatacaggaacaagagtataaaataaagaatgatgtgtctgtctaaaggtgaatgaaaacattctagcatcctgacctctgtgactcctaataaacactggtcagagttcatgccccacggcctgtgtgtccctctccttcctccttggagttgctgcattaaaggccacgctgcagtgttttcacggcgccttctgtgtgtgacgcatttggtctgagaaacacccatagagctactgctgagtttaaaagaagtaaacatcacctcacatgacatatgtgaaacccagatcactttttaaagatagtctccttggtatctaataaactggctaaagttggtgacagtccatccttcattaagttattcattcaataaatggcatgtgcttgaaatacaccaaactttgcgggtactttgtgtctcctagaacttcatatctaatgagggaattctgttttaaacaatcacactaatgaatacataattgcagttacagcaagtgttttgaagcaaaatacaaaatgctctgagaaagtataagaaggcctcttataggggaataacttgtaggggattatggaaggcctcactaaccggggatgtttaacctaaaacttgaagaatgagtgggaatcagccaggtgaagcagacacaccttaggagaaggctttagagagaagaaacagaatgcagagggccaggggcaggagaacttggtggtcatggaggaagggagaaaaggccggtatgtctggaactgagtgaatgaagagggtggaatggtgtggattgaggctggagctgcatcaggcctcattacaggttagaactttctccttagctcgtggaaatgcccgttcttcattcctctcaaaagggttacacacagcaccctccagaggcagcactgaacaccagcccatggctccagcagaaaaacttgtccagcctctgttgtatttcctgaatcacttgttataggtgacctcacagcattgagttctcagccttaaaataaaaaattcctcttgatatttgatctcaagttctctacccacggtttcctaccccgcagacacagtgtggccaccaaagctgcttggttggttcttttctgcattatttctctctctctctgtctctgtctttctcccttttttttttttttttttttttttgggagacagtctcactctgtcgccaggccagaatgcagtggcatgatctcggctcactgcaacctccacctcctgggttcaaacaattcttgtgcctcagcctcccgagtagtagctttttgtatttttgtatttgttttttttttttttgtatttttaatagagtatttttaggggttttgctatgttggccagctggtctggaactcctggtctctagtgatcctcccaccttggcctccccaagtccctcaccctgggattataggcatgagccacagcacccggcctctgcattccttttcttttccatgtcgcggtcgcctgttgcggcacattcttcagtgtcttccacttgcgccccatggcctttctggcttcagatgcagaacctctcccgttataaactgaaactcaaggcctcattttatatgggtcgagaaaaatctcaaatacttaagcttattgcatttccttttctgttcgctcctgctaattttgagtgtcattttattcttggtttgcctgatattttaaggttctgttcatacagtcttttcccccaggagttacataatgacttcagtcactttaaagaagtttttaatctgtctgacaaaattattttttcctttgtgaaatgtcatctctgtttcttctttttcctgctagtttttttcaggatggactcaaagccgtggaaagcctcaaaccttccattgaaacgctgtctacggatcttcacacggtgagtagcttccctcccactgtggtttaaaaccatcttaatgcaacagacattttcatctaaatgtcacttctgtgtaatcctgtgttttcatgccgtgccgcccacgtggagtgtggcgttcccacgcctgtcctctgtcttggtgggagggaaggtttgaccagcgagggaggcagttgtcgcattgtgtggaaatggccccatgagcaccaacgtttcactgtacctcagtcttaattttctgattggttctgttgtgtgtgtgtgtttttaaagatcaaacaggcccaggatgaagaaagaaggcagttgatacagcttcgagatattttgaaatccgcattgcaggttgaacagaaagaggtgaggggatttaattttgaaagattgcagttttcaccccattcttggaggctttgggtctgaagaacatgaagttcatgtcttctaggagctcacagttcactcgggctgtgtcaggcaccagtaaaacatttaatgtattcttgcaatttagttctataaaaccatcttttaaaatatgtttatttcaggaggaagcatttactacatgcatggccttaatggcggtgtataaaccctgtgctctgtcagttgctagataaggagctctcagtggcttcgtcacagagaccatgtgtcatttgtgctatttatcctgtacctggccctgtgtcatttccctaccctgacatacgtggactctgcccctttaggcctaggcacgtagcaggggaccagctggggctctgccagccctgagattgtgttctataaaatatgaggcatgagcttttcttacagctgcctccatcatgacaggcagaaatccttagttctcttacttcccctctttctgtaatgacgtctctgtgtgctaacacgtcagcagggacagtttgtgttgtggggacttgtttttaaaaagccattaaaaagtaagttttaaagataattttactatattttcactacaatgtgggtatcataatgtgaatttagtataaatccatttccttgttaataaaaggaatgtatctaaacatatatctagtgattttagagaaattgctaaactacttgacagcataaagttccctgttggcagtttggtgagctctattttattgtaagttcttgtactataactgaatattgttgtttttctcccaaatgcgtttaccttttgtgaccgaagtctaggagagtaagtagttcagtattttaataaattgcagaattttgcatgttttattcgtgaacatacatatatatattccttttatatattaatggttagtagcattttttattttaacccctcacctttcattgttgtagactttattaaaggctgaagagtttgcataaatattagggaagtggacattttctgggtttacagtttacacttttgctgctgttcctttatgaagatgaagcaggtccctccctccctccctttctctcccctgagtggctgaattctacacatctctctagtccctctgaagccccacctctggagcgctgcctctgatcaccccagcccacagtgatctgagttcacagagcacatcctgtttgaatgccccatttgaatcacagcctattcctctttttgagtgttggttgtgccttaagtgcacagatggcttttcaccagctggacctcgagcagcctgaggatgccaccctgccttctgagccattcttccatcacactgtagtgccacagcgctcatttagtaggattttggtaaacatgggtcaactaagtgagacactggcagagcaaggttatatttagtgctagaaaggacctacaacatggtgacttcctcctagtctagagaatgtaggccctgacgctttgatattcccaataagcaaaaaaaggaaaaaaaacttggcgtaaggagaaaatagtgggctagcggtaacgaggaggaggtagtgcgagggcaggagccagaatgccgtccaaggtggctgctccccagcgcaccgttggaaatgatcgagaactgcctttgtctaagaaggaagatccaacccatgaagcaaagctcaggtttaaaataaggcagagcagctgctggggccaaatggccctctgggcacagtgcaaaggctgtgtttgctttgcctgtgcagaattaggaggtttgggaaaacgggctgttgtgagagaactggttatttacagcttcgcaggaaagtaataacaaatttaccagcacagaccagaagttctttatagtttgttgttttttgttaaccagcccatctgcccctgattgcacagagggatcaaatgaacctcctttactattcttctttggctgtctgcccagttggctccttgtcaagacctaactcaacagtctcctagttgtgggcgtgttgtgttttctgtgtatcatgctctgcgttgcttttaggtgatggcattcagcaagttggacaatctttgaacacagttgcaagtaataagcagatgtgaaaatgctaaattttctgttttaaaatgatttttatgatgggggttccatcttgtatacctcaaatttgcaataagaattgatcatttggtcattattgtttaggccgtcattccctttggttggattttcttctgtgacttagacaactgaaggtgttaagaggatttttattcagtgttataaaaattctaaccctccctgtgtaataacagttgatagaaattaagtaacatgccccaaagaaactgccttgatggttggtagaagccagtgctcctcattctcttcctgtaaatcccaagcatcagttattgaaggaatgaagagtggccattccagtgtggtagcttcgtgctgctgtttccttgtgaccctgcagctttgttttagtgtggagcttgtgccgttctggtcccggtgacctcacacctcccaatcactggccattcatgttttgttcttgatattttctgctctctgtaaggagaatactactctttggtatttccattatttttctttgtgaaggttttcatacttggagaaaagttgaaaaattgtgcagtgaccacccatagtgcaatattatacaatgaggatcgaactatgtaccatagtgtttgatttttggagaagatcctatttacacagttaaactcgttggcactgctcatctttggttgagctctctccccgtcagcctcgcctcctgccttccccatcccacgtcgtccatccgatggtgttctgccaggatggaccctgttggggtgctggcggagtcccaaagcctcatcacttgtgtgcaggctctctctgctgtttgatgtggagaacccagacttgtgtgcttctatggggaggatcaggctctggggcatggtctcacaggtctgagtgctgaaaccaccatggttttccactctgcagatctcaagtatggttgctctctctctctctctctgtctgtctgtgtctgtctatctctctctgtctgtctctatctctctctctctctctttctcttgctccctctttttcaagcatcctgtctagtaggatgtgatagaacagtttgtgccacccaggcagccaaggtccaccacagccataattttcttctgcctctgggttcgcgtatcttacatgcccaaatctggccttcatcacagagatctctgccaggggccacctgcctgcctctcctgccaagctgctaggtagcctggctctggcctccatgtcaccctcagtggaggactcgtttgttgattcacacatccagctaccctttcttccactgttaccctaagccagcactccacaaacacaacagaacaagatggatcaggttatcatctcttcaggggatcatgctctgggggtggggacagagaagcaattggggtgcagtgtaatgagagcactcgtggacatcagctccaggaagcagtgtctgcccagtgcgggctgggcaggtgccatcagggatgacttcccaaaggctgtgatacctgggatggagcttagaaggatgattaggagttggcaggccaggcatggtggctcacagctatagtcccagcactttgggaggccaaggcaggtggattgcttgagtccaggagttcaagaccatcctggccaacatagtgagattccatctctaccaaaagtcaaaaaaattggccagttgtagtgacatgcacgtgtagtcccagctacccgggaggctgaggtgagaggatcccttgagcctgggaggtggaggttgcagtgagccaaaatcgcactgctgcactccagcctgggcagcagagcatgacctcatctccaaaacaaaaacaaaaaactggggacggggcaggagttagcagagtcccagcaggtgaggctggtggagaggacagcttctgactaggacggggttgcctggggagctgtctagcagagcagaagagcatggatcttggcatttgaatcctgggtctcccacttcctaccctgccctgtgacactgggcaggttcctggacctctccatgtcatggtctccccgtctgtcaaataggaataatacagccaacctcagagttttcaggagatctaagagataatttctgtagagcacttaccatattatcttaataatagtaaaattatttattaataatcttaataaatattaataaactatcttaatagttcattcaacaaatactgagctcctaggtggtaaagataccgtagtgaccaaattcccttccctcatggtgtcgcgctcttagaggttcaacaggaatggatactgctgctgtcgttgtgtgtgacatatcccttagcctccttgttggtccgtcctctggccctatgtcttcatggctcttgcccctcttccttcttcactatctgactcaagatgctgtcatacccagctctaggcttctcctcttactcctgacccaggccttccagcctcacctgcctctcacccacctctctgtgtccagcctgcgtcacattccacattcactctaggggaggagggacctgttcctatccattgcagggcatttcctgtttacctcacttttcaggttttccaggcactttacaagtgtggccaacgatccttacaagccactttacagggtaggcaatgtttgcccatgtctgcagctttttgtttgtttgtttgagacagaatctccctctgtcgtctaggctggagtgcagtggtgcaatcttggctcactgtaacctctgcctcctgggttcaagtgattcttctgtctcagcctcccaattagctgggattacaggtacgcgccaccacgcctggctaatttttgtagttttagtagagacggggtttcaccatgttggccaggctggtctcgagctcctgacctcgtgatctgcccgcctccgcctcccaaagtgctgggattacaggcatgagccaccgcgcccggccagccatgtctgcaactttattctgtgagagagagaggataagtgcccttgctgggctcacacagtggcatcagagccaggatttgaccctgatctattccatgtcaaactggttctccggagtcttttaaaaattacccttaaataatggagaataggtggtaacgatatttgaaagcattgttcttagaccatggctcagtgcttggctcagcaaggcttccagctcccagttgtgcccatgtgggtggacatacctgtcatatcttcagaagatgggggaatgaattggacatcacagccctcctgggcagagaaattttaagcttccaaaaatgactcctcgacaagcttgtcaatcacaggaattgtctggacactgactttctaagaagtgggcaaaatgtcagtttttaagctatcctagagtctttagagtcttagacagctcaaggattctactggtcatctgggcagattctgtgttggccagacccaatggctaatacttcatagggccacagaaaagttaagatcaaggatgatgcctgagctctgagaacttgtctgggtgtcacaggacagaggatgttggacactgatagaatttcatgaaagccttttgaggttccaccaagtgcccacctaccctgcatactcaggcacacaaacagtccctgcacgttgaggctttgtcagtcgagtttaggttgtcttcgtctctcttaggaaagtggagagtacattggagtctccaggaattggggcaacatggaccgccctggcctctcttactttttatgttattcttctctccagaaggagaggttctttttccttgcatagtattctaaaagtcagaaccttggtcatgtgaaagggccggttttctctgtcaggccttcacctggtcaggcgttttgtacaggctaacaaaggctattgttacggggtcgcctgggagtcacctagaggatactgaagtaattcgcactaaaacagtttcaattttatgttaaacagattatattcctcttttttacaaatgtgaagtttaataggccagcttaattcagatttgcctgcatgcttcaattggcctaaagaaaagaataaaacagggtgatttcattgtcaccttctggcatagggtctgattctgttgagaagaatgtcccttatcctgttcgtgagacctgaaaatcgctctgattaatatgcgcggcacgaacagtgttagcggtgttgtcacatgatttcaccacttactttgtgcagggctttttttctcccccaaatcaatagacgtatttcttggttgtgcagttgagtctcctgacaggtttatttttagtctttcacagagacgctgtacaggtgagcagtatttctccacattccttccacagcattgttctcagcaacgttgaaagctggatttgctctaaattttggtgccgatgttccgcccttctgagaaaatgtggaagctgggaccatcctcatcccatgaatgcgtgtgtgccctagtttatccagaggctcaagtgctgtgtgaactttctgtggaaatgagttcatttctcccctcctgggctctgcttgtttcagggttggttgtcagttcagtaatggagagtgcctccgcatgttactgattgctcacgtggagttttttggtttttcttttttggcagagtttaaaaagtcagtgctagacactcatgtgcatgggttggaagacttattgtgaagataacagtactcccctaattgatctacacattcagtgcagtccccatcagaaatcccagctgcctttgtgcagaaattgacaagctgatcctgaagttcatgtggaaacgcaaaggacccagaatcgtcaaaacaatcctgaaaaagaagaacaaagttggaggattcacatttcctgatttctgaacttaccacaaagctgtaataatcaagacagtgtggtactggcataaggagagacatatagaccaatgaaatagagctgagagtccagaaataaatccttacatttagagatgatttatttttaacaagggtgccaaggcaatggagaaggagtagtcttttcaacaaattgtgctggggcagctggatagccacaagcaaagaaggaacttggtcccttacctcacaccataatcacaattaattcaaaatgagtcaaagagctaaatgagagctgagactataaacctcttggaagagatttataagtataaatcttcatgaccttggattaggcaatagtttcttagatagcacccttacagtacaagtgacaaatgaaacagtaggtaaatgggacttcattaaaattaaaaagttttgtgcttcagaatcttttttcaaactcagaaatccaagaggctgcctgtgccttgggatgcagtcgaaactctgactccagcccgtcttgtccacccctgggccttactgcctcagatgcagtatttgtctagcttccctgggtgctgaccacgtgaccgtgacctccctgtgtcttctgtgtactatccactttgccttgaagatcctaccctgattctgtgccagttcttgccttcatgtttaaaactcgctttttcctgtgcttttctccctttgactcttcagttcctgagtgctcttgttctcagcttccatcacactgattttcctgcgttagttctttcatcgtttggggatgtgcttcgttctccaaggatggtgagctgctcagtggcaatgatgagagtggccctagactctgaggatgttctgtggggaaagaagatggtgtaatggaaggagcctcagagtggaaggcaggattccattccactctctgctcttgctttaaggagctctgcacctggagcaaaccacttattttcattgtgtccctgtttctcccattatggaatgaactggataggcgttctcattaaacacctacgagcagccctcggccctttcctggttgacctgtgaacacttggttcacatcttgctcccctctcgtttcctttaagtctcagggaaatagaatttcctgcactggcactggtggcctctcctactctcaactcagagtgtctgctactgtttgttttgtttggtttttgcttttttgagacaaggtctcgctctgtcactgaggttggagtgcagtggtgctatcatgactcactgcaacctcgatctcccaggctcaagcagtcctcctgcttcagcctcccgcatacctgggactaccagcgcctgccaccatacctagctaatttttgtattttttgtagaaacgaggtcttgctatgttgcctaagctggtcttgaactcctgggctcaagccatccgcccaccttggtctccccagatgttgggattacaggcataagccactgcgcccagcctgatatcatttgttaaacaccagttgagccacctgttggatgccagacactggacttgggccctgggtgttcattgctagtcctcgcttaccctaagaagctgataggctggaatttcccaactgtggtagattcaatcagattctcagctgaccatgtggatggtttacctatgattaagctcccttggtcagggtcagaccccccttactcaagattggtggagggaggaagtgaagatttttgcaatacttgttgatgttcacatgtgtgatcctattgagtccttactgtttattggccttactgggtattcttttcttattgcccaagaagggaactgaggctgagagcttatgtgatggttctgtagtaagggacagaaagctggttttgtcgttttgcttggaaacccctgcctttccactcactgcatcacctccctcctcgagggctactgtggccgtagtgggagcctcatgtcattgtcagggggttaaggctcgtaatgaaataaaacctggaaacttccagggctcattccttcagccagtttgggaatattggtttcctgacatttccttctccagcctgatagatggcatttatcagttcctagagcagaatctgatgtcccttttttgctgtgttgagaaagggaaatttttccaatttttgttgttgttaaaaaacacattaggcataagtttcctttgtgtactgcttttctaaaaattaggacctggacaagattaaaaacacactcttcaccattttttaggactcccaaattcgtcagagcacagcttatagcttacatcagcctcagggaaacaaggaacatgggaccgagcggaacggcagcctctacaagaagagtgacgggtacgtgagggggtgtggctagagtttaaatgtacgttcgttatcttgtgtccaaaatgtctaaactcttattgtttctcccacttatccacaaggatccgaaaagtgtggcagaaaaggaaatgttcagttaaaaatggttttctgaccatatcccatggtaccgtaagtattctcttttaatccatggtgtctgctgtattaggtgaggttggtgttggaggactttctgaagttagagggcaggagttgttctccgtgtgtgatggtattaaggatgtgtcttagagaatttccctgtcagaaacgcttgctggcctccgtcttgatttggtgcacctgcagcctgtttatgttttttttttttaattttaattttaatttttattttttattttagccagatggagtcttgtccttgttatcttccactccctagcagagtcaggagtaactgataagccaggttgtctttatttagaagcctgtgactccagaaagcacagaacagcaaactgctcccccagctctctttgtctctggaaatcaaacatctcacttaggaagatttctacttttccattaagagaaaaaaatgggcaggactctggggaccagaaatccatgagaaaagacatctcagtaattttattattgaaatcttaacatatggtgcccaactttaaggcctctttccatcatcctgtttatcagagtctatgcaagaaaaaacggagccctctatgttgagcttatgaaaagccggtcaggataaagttccttaccaatctagctttcagaggccaggaacttggatcacagacacagccctgcacaccacactgttctttccatggcagcgttatacatactattgcctcacctggcatgactagagctggtgataaccacatgggctggtagacagctttggtaacatctcaaggccgaggtcgttgcctttttgttgctagagagatgctgagggttgtttgcattcccattccccaagcagaggcctagtagtgcatgcaatccagcagccttgggcgtgtgagtggatgatggtaaccgtctttcctgccccttgtccctccagtccctggtgaaggcagagctgggcaggagctcagaggggcttttctggcccctatagaaatgtcatcactcaacatggggtccagagaaacggccctgaggttcataagggaatagagtaaaaccccagccgaagcatgtcacagcagcaaggattgtgttcctctgggggtgcctttgtttttgccaacttcgatttagaaagggagagaggagctagaatagtatatacccagtggagggattctcggtgacctctggtctaggggtttgaatgtgtctctgaacttggaaatgaaggtcattttctattttcaaaacccagctttcactggtcatgtgatcaccaccgtactccccctgcccccgcgaccccagggccatgcagtatggatcttaatgggacattatgggcaggtgcagtggctcaagcctgtaatcctagcgcttagggaggccgaggcgggcagatcagctgaggtcaggttcgaggccagcctggccaacatggcaaaaatcctgtctttactaaaaatgcaaaaattagccaggcatggtggtgcatgcctgtatcccagcaacttgggaggagagaattgcttgaggcaggagaattgcttaaacgcaggaggcagagtttgtggtgagccgatatcacgccactgcactccagcctgggagacagagcaagactccatctcaaaaaaaaaaaaaaaagccattctttccatgcgtggatgtgagggtatgagttctgtagaccaagggaagcaaatttatccagctatcactgtctttaatattaggaatgttagattagatgagactaggcacccttctaaataccttccagatctcaacacctgtggttctgtggtttgctttcgaattggtgtccactcgctgtttgtttgaactccgattgactgcctcagtgcagaaactgtcatacaactaagttctagttcatgcttttacagctctgaagtcaaggggcatatttgcttcattgagagttcccctagatccaggcctcagcttaagccagtgagtggctctttccatggcagctggaaaacaggtctggtaatcctttgctgacagcataaacttcacttcgagtcacttccatagcttgagcttcctctcaaaagatgtggaggcttagttgtctttaaatttggatgggttgccccagtttttggtagatagtacggttataaccggcattactgggatgctgagaactcagcttgtcacacagcgtgtgcatatttaataggtgctttgtgtttggaggggaaaaccctctccagggaatctccacttccagaggtctcctgcctttagcagccatcgccgcctacatcctgcaggggtggcaggtggggctgtcttgattcacttcctcgctgccatgcagaaaaataaagtagttttccagccctccgttcagtggctgagtgttccttttctcaccttttccctatttccctgcgtgctctggaagtcagaatccagaggacccctctgtatgactgcgtctacagagaggttgcatgtggggaagtgagttcacccataccaagaaagagaattgagagatgcccttttggtttggtttggttttgacttgatttcttgtgcagctcacctgtttggccagcagctcctgagtgtgctcgtttacagtcaggaaaaaagggcacatttccaaagacttgattaagtggaagtctaagagcagagcctggcacatagctgcgaagtaggtctttaagaaatggaagcacacagggtgtatttacactggtaggaaaacccttcccaggaagctggcagcctctgggaaatgaagttgttgtattctgattggagcagaggattgaggataacatccgggagattcgttcaaagcccgagttgaatttccttcttagccaagtctgttttctggccctaggaagaagtgatccttgagacaaaataactctaattagatatcctctttgccagattcgcaggattgccacaccactgagggctggggactgtgttacactggaaggaatgtccactggctcttacacaatctaaaattttaaaaaatgatcagtcatgaagaaagaagaaaacagcttccttctaaaagcctgacaaatcgggaaaaaatagaacggcacgattagaatggagaatcactgataatctctgcctgcatggcaaactctaaagctgttgcatcttttttttaccattccttcccaagttttctactaaactagggcttctcaaattaaattctcaagaaaatactggtattttgtgaattagatgaaaccgttctatatctcaattaactgatgacacttttttgtttgtttgtttgtttgtttgtttgtttttttctttttgagacggagtctcgctgtgttgcccaggctggatggctcactgtgacctctgcctcctgggttcaagcagttctcctgcctcagcctcccaagtagctgggactgcaggtgcatgccaccatgcccagctaatttttgtatttttagtagagactaaaaatctctactaaatcagccaggtcaggctgatctggaactcctgatctcaggtgatctacctgcctcagcctcccaaagtgctgggattacaggcgtgagctactgcgcccaggtgacactgtatttttccaaattgcaacagggaaggattttaatggatagaattttctcccataaatttttctaatagctttactgtttgctaatacttaatctgtgtacttaatatttaacctgaatagcaaacagttattaatgtaaaacagaactgctggtgatattgcttaagatcaacttgtgtgttttgtggacccattcttatggttgtcattttttaatatgtaggcacatttatgtcttcataaattattcctacttcaaacaaaggtgctgaatatttttctctattttgtggtatgctgcgaagtgagaaatctatctttgatagtagttaagaacgaacacctttccccgtatcacagggaaaaaggaagactgcaaggtggaggtggggagggagaatgagttgtagtaatttaagttgtggttctttgctgctcttaaagataagtccaggcaagcgaccgccttccatggatacccacgtcgaggacagggagggtggcagttgagccccgagccctggagccagcctgacttgttggaatcctagcttccccgctccctagctgtataacctcaaccagattatttggtctgtccgggccagtgtctttagctacaaaattggtgtagttcctacctcaaagggcagttaggaaaattaaatgaattatttcatgaaaaatgtttagaacagtgcctgccttgtataggtatataataaaaatagctgagtaaatgtagctattgttattcaaagtcattattttgtccatgaaggtgcttctgtatttatcaaagcacacaaaccttagatataggagttattcctatatctaagaccccacaatttggaagtagccctaaaatttgcacatgtacagttgtgtcatcacagggaggtaacagaatagacacaggctacgtatgggtgggtgtacacccgtgttaaagtacttggttgcatacatgttttgtaaccatgtttctagaaatagatcatttgctgtattggttcctggataagttaggtaatccgattggtaacaatccacgatcagtggtgctttcacttgaaagtgtccagatttacaagattaggcagagcttggtatcttctaatactgatttctgacgatccaggaattctctgagatatctacagattatggagaatatctgactaacctgtagaggaaaagaccaacacagccacgaaccaggagagtctagtacaaccctgtttatctgactttatctgactttcactagtccaaacttacatttattaacccaaatccttcacgctgcaaggatgggttcaactctcccaccctaactctgtagacttactggaaggaagctgctgggcctgtaagtgcttgagggtttcacaggtctgtccaggtgtagatgcatatgtgtatgtatctggattaatcccaaattcaggtttttttcatcttgaagtgaccggtgggcaagggaagtggggcccaagaacgatggaagtttaagacattcttatttgatctttcctttagcagcttggtaggtgggtaagataagcccactcccatttggatattcctccaagatttctaagaggtattctgctgttcgaaatttttgtttctgaaattatcttcttaccctcagtcctttgctttcttggactaagtatgatcttttttttgaaactgtaataaaatagccatttttcatacacctctgatgaaagtatgttgtgatcgcttggtgtcgtgtgtgggggagagggtttgggggttacagatgtgaatgaagtatgttttgttgaaacttaagtgacagtgatggttggcatttaggaatgtgagtctgttatctgtcaccacttcaaacagtaggaaaataatttctctgccatttttgtactgtgaaattaccttcactggaagtgaggtttatgctaagaaaaaacgcttttaagatcaccagaaattgagctgggtgcccaagttacctggcaaatcaactgtgttgtcggtaggaatcagaactgaatgttttgggcttagccatgcaatatcttgatctgaaggcacccactgccagcagcctcaaagctggcatcgcttgtcctcttgtccaggtgggtttgtgtagaccaccaaggtgcccttgcagggaggcagttgccctctgtggagatgaagttcaaaggcctctgtaacttgtcccagtcaagccttcctctgtcaagtctgaaggccacctttgcaaactagtgaagagcttgctgttgctgtatctcgtgaggattgatactgtatgattttccattccttccacccaaccccaaccttttttgttgttttttgcttttaaacaggctaaccggcctcctgcaaagctcaacctgctaacctgccaggtgaagaccaaccctgaggagaagaagtgctttgaccttatttcacgtaaggctccctctgagatgccgcgccatagagacgttgtcttatgctctcctctggggcgtccttcacatttcaaacactgcattcggaagaattggtttttgaagagacataccctttttctagtgatatgcgtgctttgtgttccattagtaactgctggcttgccagcctttctagttgagagtttgactttgagggctggccctgctccttgggggcactgtagtcctgagacattacctggctctctgagcctcagcattcctgttcctaaatagggagatcctacaagagaagcccacaagcctaaaactccttcacttgaaaaagagagaaggaggacaattctgttttcaagaacttacataatttgggtgatgttagaaatgctaaaatgagggtcttcaacaggtcccttgaaacttcagtgtttgaaattgtttttcttcctcaccacaggaatagtctttctgcttctctgtgcttttcctttttgtggcgttcacaaaagaatccccacagaaccatccattgtggtgaatgtttactcagcaccccttaaattaaagggcccatgatgtctaaaagaaaataagataaaccttttttcctaggtagttctgtgtggcagggttagagtccaggggaagaaagggccagtctcccctttgaagaggcagtcactagggatttgggtgcaagagttacatttgcagaggaccacgccggactgtgtactgtaggaaggcggtgctgttctctgtgcctcagtacccctgagtgggagatggctaccttttcaaatgtcagttgacctgtattattgagggctaggaagtcacttgttatgtgattcagcgctcccagcaaactgcgggtaattatcactccacctcacccacaatggcttgctcttatcctccctgttccccttctcataccctctgtgtgaatctctggggagggttgagcactgtgatatgtgcagagggttccagtaccatttattctgttcttcagactctagactgatttgtaaaataaaatggactttatcctgtgtcaaacacccatcctgactcagtctagtaaggtccacagattctcatcaaagcttgcctttcattcatacaagatgttataaaatgctgagtactggccagagtttaaaatgtgattgcaagccaggtgtggtggtgtgatcctgtagtcccagctactcgggaggctgaggtaggaggatcacccaagctcaggagtagacgtccagccttggtaacatagcaagaccctaactctttaaaacacacacaaacacacacacacacacacacacaaacacacacaccactgctgggatacctgtgtctagctagcaaaaaaggcttgaattgaagagtttcagaaaacctgatggtgtaatctgatgtctgccagtggctggggctaactcagggttttaggcctttctgttttctgaactagtaacacacaagaagccatgcgttaaaatgcccatccttaactcataagcaataatagtgaacctatcacctggaggtgggtgtagggacttcttccctcaactgccctaggcccctccagcatgctccacagggagaccctgctagatgccatatgtgcagaagcacttgctccaatgtattcccagcctccacctttttacaacacagcaggcagcagggaggatcagtagacggcaagtgtgcatgcctcccttctgggtgtgagttactgcagcccttacacgtgtgggaatgcagtcctctgtgaatctggccacacacaagctctgtggccaactgatatttaccaagatcctgccagtgtctttgctgcagcctgatgcattgaaacatcttcaggaaggacttgtagcctgtgatgcccagacaggtttgctgagcccagttgggggcagtgtcgtgagtttgctagagtccattgtcatctttgaaaagagctctcatccctcctccttccttgcttgtcttccagtgggtaaaatgaattccagtcctgcaaattcttcatcctcagtgagttttcaaaaggtgccttcctatgagtatctgtagtgaaaatggtttgtgcaggggtatgtgggtttgggttgaaaactggccagataccccagagagtcatcacaggaaacctggctgcagtataagccgtgatttgatgaacatcctgagaaggtgagggacatggggtcaagacctgattctggctgattgaggagcatctgtcttcacccctctcagattcctcctctacttcctcaccagcctcatgggatgagtatcaccaagatgcttttgaactctcaagatgcttttgaactgcctgggtgggccaggcagtggctcatgcctgtaatgcaagcactttgggaggccaaggtgggaggattgcttgaggtcaggagttcgagaccagactgggcaacatagcaagacctacaaaaaatttaaaaatagtgcagtatggtgacatgtgcctttggtcccagctactcagggagctgagatgggaggatcgcttgagttcaggaggttgaggttgcagtgagttgtgttcgtgccattgcactccagcttggacaacacagcaagactgtctaaaaaaaaaaaaagacatttgggcagttggggaagtcaagtggaggcacatgcattgaggcagtgagggtgatattttctgtgtgcatctgccaggcactccatggtcacccattcctcctcttcctcatctggtcagttcatcttggaatctgcccagagaactcagaagagcaatagactggctggctggttgcagttacttcctacaagatgttcctttaccatccttgctcctaaacaggggcttcccattctcatgaaggtggaattggggccaggggcagtggctcacacctatagtccaagctacttgggaggctgaggtggggggatcacttgagtccaggagtttgaggctgcagtgagctgtgattgtgccactgcactgtagcctgggtaatagagggagaccttgtctctttaaaaaaagaaaaagatgtaaatgagcatgggcttttctaggaggatggttctgtggcaaggccggcccttctgggagctcatctaatccattgcctgcagaccgaccccactcatagcaaattcaagtcctgagccattatccgcgaaccccataggcaccctgggagggatggaaggaacagtagaattgtgaggtgacccaagtgagtcccctgagtaggatggagccagagggagtcaatgaccttccaggtccacatggcaggttagcggccagtagagccagagccctggccacaagctgcccttcactggccaccagcacctgagtgctccgatcgccccctctgtctcctcctgctcttctccctcacggctgaagctctggaagccgtccgcttatttgtagcatctttaaagagagtgtagtggaggggattcttgcttgaagtttttcctcagaggtttgcctcctgcttgtgcagtttttacacgtcagaatgcagaaattggccaggtgcggtggcccacgcctgtcatctcagtactttgggaggctgaggtgggaagatcgcttgagcctgggagattgaggctgcagcgagctgtgcactgcacgtttgcaccactccactccaacctgggcagcagagtgagactccgtctcaaaaaaaaaaaaaaaagaaaaagaaaaagatgccatggtgttgtagaaagtggtcgggccagaagtccaggaaccaagttctgctgctggctatgcttgttttttgcagcttagcctctctaggcttcagccctcacccagtcacttaccaagagttgttctaagaaccaacgtgctttcaggagtaaacaccactacagagaggtggcgtgtccactcacttttaggagcacagatgttcgttgtgtttccctaagaagagaattggtacttgtcatcattctgccatctgcaaaagctggattcccctgcccctgcttttctttattaaatataattttattttttgctttggttttagactgcttttagacagagaatatccatatatccctcccctagctttcccttctgttaacatcttaatacagttatccagtagtccgtggtacatgttatccaatcatatttatgtagttatcaaaaccaggaaacattggtttgatgctattaactaaaaatcttactcagattttaccagttttcccccaaatgtccttttttctgttccagaattctatccagaaccccatgttacatttagttgtgattttatcctggtctcttgcagtctgtatcggttctgtagtctcacttgtttttcatgatgccttcttaaagagtattgacctgttttttggtcagactccccttaatttggatttctctagtgttttctcatgagtggattgaggttatatgtttttggcaagagcagcacagaatgatgctgccacatcccacacagccgcctccctgctgcacacacacacaggtccacagcctggcaaaacacttgtaaaactgtgctgacaccagcagtatgtaagtgtaggattttatattcgaccattatttaacacactcctcttgatttagctacatttctagtatttgattctcaaagcatattattcttagaatttctcatactaatctttttctgagaaagccagaaaacttctaagatattctttttaaaaaaggtttttattattcaaagggcttgaacaattactttttgggggccaactctgtagtgagttaaaatgaagctattgagaggatagtgatggttttcattgaatagcttcagtttttagaagcggcgtcttttaaaacttgaatgagggaaagggcaggtttattttgcattagaatgccaccgttggtgaaggcagacatttggaggatatgagggagtgcctgattttatacaaatcagtaatttcgtaacagagagctaagattattccagaggctaattagaaactattttcttttggaattgtgtatggattgctgtctgggctcacagttgaaattcctcttgctatgcagatgacagaacttaccactttcaagctgaagatgaacaggaatgtcaaatgtaagttacatggtggtgggactttgggctggactcagccgttgtttgtggaatttaacacagcgtcgctcttgtttttctagatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccaggtgacccagggaccccacccgaccctgggctctaggacatttcaatcccattctgattcacagaatccgttcattgattttcactttcatttcaaacacgaaattaagtgcagctcagcctgagttcatcccattacacaaatgcttaatgaactgtgcagaccgcggcaggggagaggggcgggaagatgtttgcctgccgggccccagagcaggactgagtaaagagggtttgacagagctgcaaagtttgaaatgctttttgagaaatgaaaactgaagggtacagtgagagtgaactcaaggtcatgtgggctgagaggctgcatgtggatgggcttccttgcttggaatctgctctcttctccctttatcctactttgcagaacttctgaagtagctttaagccgctgtctggctctgtgaccctgggagagccacttgctttgttaaacatcgattttcctgtctgtaaagtgaagggacaggaccctttcagctgacacattctgtgaaataagattttatttttacattttgataaagcatattaggggctttatagtaggatgtgatttaaggaatttgcttattctaattgagacacaatggtggggagtgggggtcggggactacacaggtgcattttctgaacatttataaaatgaaaaagatggaggcttggctagaatggttaatccccttttcattcctctaattctatgacaatttttcttaaaaaaccaaacacaaccaaaataagagtggacagttgagaattacctttaggttcccatgaccctgaagactgtatttggccttggatccattaaaaaaaaaaaaagaataccgactgggtgcagtgactcatgcctgtaatcccggcactttggaagactgaggcgggcggatcacttgaggtcaggagttcaagaccagcctggccaacatggtgaaaactcgtctctattaaaaataccataattagcccggcgtggtagtgcgcacatgtagtcccagctacataggaggctgaggcaggagaatcactcgaatccaggtggcagaggttgcagtgagctgagatcacgccactgcactccagcctgggcaacagaacgagactgtatttaaaacaaacaaacaaaaaacccgaaaatacgtttttggcaggagatgaggtagggggtgataagtagtgaatcatggtctttcttgagaaagggtaaagacagtctatgatttgggtgtttcatacgctttgataaagaactcaaaggtatgtactcattattttaaaatgccaagacagtgtgggtaatataaaaatgatgtagagtcacctaaatggatgcttgtacctccgcaaagcacaaatacagtggagtcgtcctacacaagtgcagacacagacgccaagaaggttttccaacatggataacatttttaataacttgaacatttaaaaaataacttcatgatttcctactgactaaagttgcgatatttacctgccgtgagtttctcagggcaacaaacagttctgaagagaattgtatttatgggttgtgatgatgtactcaaggacatcttatttttaatttcccatttttagcaaattccacattcatctgtcaagcattttgtgggtccctatcatctgctaaatgtatggtaggtcatgttagtgagtagccgagctgtgaggggaaaacgtggctttgaactcaggtagaggcagggccacagtctgctctgcactccctggcgacctcgagcctgagcatcgcaaagctgtctctgccatatagtgagataaaaatccctgccctggtcatctcatggaactcttagatttgatacaaaagtgctctgtgattgctgaagctcttaacaacacaaactgttattgctactaccagcatgctgaacacagcatatcttatgtacatagtacgttctctgttattatcagcatctgtagatgcatatgttttaagcctattccccttttacaagtagactttggctggtctcattgttttcctcttgctccattctgctagtgtgaccaagttggtgatgggcatggtgtgttttcaccaccagccattgaggagcccttggtcactggagtgtgtcctgtttatttttgcacacacagcacctgtcacatgaatggaaggatggggagatggagagagagggaagaagagggagagtagatgtgtgcatatttgggtattgcatgtaaattggtggtaattatggacaaagtttccagctgtgttaaggatcagaaaatgctcatgctcagaactgcttgttcagtaactatgcaggaagaaagatgtgactcctgaccctcttttttactggaagctcaaatctgccctgttctctttggcagatcctacatggctttccaccaacctgggcatcctgacctgcatcgagtgttccggaatccaccgagagctgggggttcattattccaggatgcagtccctgaccttagatgtactgggaacatctgagctgctggtaatttttaaatccttgatttcagattggaaacaaatgagctgtaagctaaattttacttttggcattctaatccattttggtaagctagtggttgttgatatgttgccagattggtttggataattagaaactcattgataattcttcatttttagctacttgtggttgagggcacttcttgttgcaaaactttattcttaaatgaataaaggggagtgaaaccaaaacaggagcattgagagtggtgtgagattctacagaaatggagtaagatggtgacatagaccagctcaccccatccattagacagatgtggaatgcaacgtctaaagacaggaaagtacttgttttcccttatcaccagcgatttctgacaaggctgtggtgacaacttgcctcaagcctccgacttctccctaccccagattgtcccccatggggggagatattggtcttcatttttactgcctttgtttcttaagtctttcattcttggttcagtggtaacacttaagccatgtgatagagataggaggagacagaagcattttctgtgaagtggctttcaagagtatcgagactgtagtcccacaaggtccatcagacagggtgcttctggccacctaatacatgagctttcatgactgtcttccctagaaagcagttcttgaattctctcctgggatagctggatgttgacagtaaacagtaagtagatagtgattggcattgattttaatgttgaatttaaaagtttacatgtagggaatttaacgtcaagagcaatagtcttgacagaaaatcaatagttgtggaccatgttcctctcaaggggccatcagtcttattgatgacttcgaatccagtgtgtctgaacttcgaatgcattttgaactctcttgtcaaacctttccagtctttctaggaattcctttatggtcttgaaagacagagttgggagaaactacagtggatcctggcagcctagttagtaacatccttagttacttacagtttaaaactaagctagactcacttaaaatgtaaaactaaggaactccaaacagtgccttcctggttacatacagcaattattgttcatgtaataatgcacgtaacctacagcttagagaggtgcacaggtgtacatgtggtatctcttggataactgatgatggcatagattggaggttgtcatggtacattttcaaagaagcacaaagtacttttcagtaaacactggtgaactatggcagttgtttcttttactgattttcttaaaacaatggaaagtgttaagtgattcaagatgatgtaataattgtttattttgtactatgtattttgcaggccactttatatatactaggctcatttgatctccagtaacaacctgatgaccttggtatattatccccattttacagaggaggaaactgaggcttagaatgtttcagtatgcctagggttatgaagcttttaaggtgacagatctggggtgtgggcctctttaatctgataccagacctcacacttaaacctttgacgagcctgggacacaaattggcattttagtgggttgtcttgctagatgataaacatttaaacatctctactgtccttccctatcaccgtccccaacaaatgtttaacagtcaactctggagaaaaaagaaccctggtttgcaacctgcctgttctcatggtgtaaatactcccacaatggccaatttcaagctacctaagtgaattactcaatgtgaagttggaaaaagatgttcattatatagtacattcactatgcaaacacagtggatgtaaataacttcatgaacatggacaatagtaaaatgcagtataattaggaagtgatgagttttgagtatatacttgttattaatgtaacataattatgagtttatatagcataatttttaatagtagcagtgcttaacagttggcttgcaaaattcctgaaattttaacagttgactcatatgagctggtaggagcccgaccccaccatctgttataattttttaaatgtgtctcagaaatttcatgttcttcatgagactgagttgcctactaaagaagaaaatgccaaagaaaggtgaaaggaatatgttgttctgtcttgatgaaacgatgaggtgacttctaatgcctggttaaattctccatttctgtctcccagagcctccatctgcattcttgtaggagtttaaagtttggttggctgtcacccacaatgagaaatcagccagtgcctgcttaatcaatgtctgcagatattttcaaaatctaattgcttccagagttttaaactctcccttacccaagtcttttttcctcagtggttatcaggaaaagtagagacagcagtgaattgtgtaggatttactcccttcaaccctgctttccctgagctctggctggtcctctgtggttcacaggaggtggacatctccccacggctcccccaatccattttttgtatgctaggagtgtggtcatggtgtcgtggctctaaaccttattccttagcccttcagttaagcagtacgtagggtgtcaggtgttagtattcattggcaaagcttggaaatttcaaggcttctttctttcttttcttttcttttttctttctttctttccttcctttcttttcttttccttttccttttctttttttgacagggtctcactccatgacccaggctggagtccagtagcacaatcttagctcactgcaacctctgcctcctgggttcaagcaatcctcccacctcagcctcctcagtagctgagactacaggcaagtgctaccacgcctggctaagttttgcatttttggtagagatggtctttcgccatgtccaggctggtctcgaactcctggacccaagtgatcctcctgctttggcctcccaaaatgctgggattacaggtgtgagccactgcgcttggcctcaagccttttaaaagtatccagattgttttattttgcttagacaatcaggtactgggatgaaggatttcctgaagtctttttacctctttatcttatctctttctctgcgtgtgtgtgtgtgtgtgtgtgtgtgtgtgtgtgtgtgtatttagaattatgtctgacacaccgttaagaaccataaagtattagttatcattgttatctcctttaacaaaatcctttcagaaaaatggtccccatgtgctagcatgtgaacccccagggaggccatgcatggtctgtctggttgtctgttcttacgaacctttccaattcagagttgcatgccatgcagggcctcggctgacttgcttattgaagtatgttttattgtatagtgagtgttcattaggccccttggtgccttgtgaaaggagagtggtgggtgcagcctggacaggttctctcacaggagtagcatctctcctcttttgggtaaatagaacagcctctgtttcagggtgacatgctgtgacagcaaaggattttatttttttaattaattttttattgcatgtatttatagtgtacaacatgatgttttagtatgttgtatacattgggtgtgactaaatcaagctagttaacatatctgtcacctcacatgcttatgttttgtggtgagaacacttaaaatctactctcttgagcctggtgtggtggccggcgcctgtaatcccagtactttgggaggctgaggtgagaagattgtttgagtctgggagttcaagaccagcctgaccaacatagggagacctccatctctacaaataattttttaaaactagctgggagtggtggcaagtacctgtggtcccagctacttgggaggctgaggcaggaggatcacctgagcacccaggaagttgaggctacagtgaactgtgatcttgccactgcactccagcctgggcaacagagtgagactgtctcaaaacaaaatttttaagtatacagtacgttattattaagtagagtcactgtgttgtacactagatccctagactttattcatcctaactgaaattttgcatgctttgaccaacatgcccacccccaacccctggtaaccatagttctgctctctacttctatgagttcagcttttttagattttgcatataaatgagatcttgcaggatttgtctttctttgcctggcttatttcacttagtataatgtccttcaggttcatccatgttgtcacaaatgacagaatgtcctttttttcaggtcgaatagtattccattatgtatatataccacatttttaaaatccattcgtccattggtggcatttaggttgattccctatctcgactattgtgaatagtgctgcagtaaacaagatggtgaagacgtgtcttcaacaaactgatttcagatcttttgggtaaatacccagaagtgggttatatggtggttctagtttttcgaggaacctccataaccattttctataatggttgtattataataatttacattcccacccagtgtgcaagccttcccttttctccacatccctgccaacacttgctatcttttgtctttttgataaaagccattctaacaggtgtgagatgatcgtggttttaatttgcatttccctgatgatttgtatgattaatgctgtgtactttttcatacatatacctgttggtcatttgtaggtcttctctttctcttttttttgacaggttcttgctctgtcgcccaggctggagtgcagtggtgccatctcggttcagtgcagcctctacctcccaggctcatgcaatccttctgggtagctgggactataggcatgtgccaccatgcccagctaattttttaaaatttttccatagagacagggtctcactatattggccaggctaatctggaattcctgggcttaagtggtcttccagcctcggcttcccaaagtgctgggattataggcatgaaccgcctgcagcctagcattacttcttttccaatggaatggaagttgcataattgaattattaattagttctggggaatcatgtcatcttaactactttagcacacaccagcttaatatctttagattctaaagcaaacctactttgggaaaaactttctggtaaacacagattttaaaaagataaatttccttcttaatgtagaagatcatgatttcagctttgatttttcaggtcatatgaaaaacagtatcactggtactagggtactactatcatgatcaatttcactatcatacatgaagttaataaaggaattcttgatattctgaaattgaatttgagtcagtcatttaaaaatcttatgagaccaggcgcagtggttcacacctatagctccagcactttgggaggctgaggcaggcagatcacttgagcccatgagttcaagaccaacctgggccacatggcaaaaccccatctctacaaaaaaaaaaaagttagctgagtatggtagtacatgcctgtggtcctagctatcagggaggctgaggtgggagaatcacctgagcccaggaggttggctatagtgaactgagattgtgccactgctctccagcctgggtgacagagtaagaccctgtctcaaaacaaaaaaacatcaaattaaaaaacaggcatcaagagcattaccaaatatttactgactcagctttctgtttcttgactttcttctatttctgttctcatacggttgttaataagctgtcaaatgttaaagcgggtcaacacacagtctgatctgaaagagagcatgtggagaggaaagctcctcaaagacgaagaacttaacgacttacaactgtcttctaagttcacctaggactgaaatgtgccacccagatactaaaagcaattgcttagggcaacaggaaattgactatcagtggtcatttacggaggaactgttatgctccaggcattgttgtaggtgttctacgtacactgtattatctaacctaaatggagagctccatttttaaaaaaagaccagagaggttaagaaacttacccagtgcaggatttacattccaactatcagactccagagcctgtgttttagcctttttttttaaagccaagattctgaacattttttaaaccacaaagtctatcagaaaaaattgagcaccaaagcatgtacttacttacatatgatgtacctacacttactaagaaatacatactttgtaaactacatcaaaaatagagcttttaaagggtcaggtaaagacatcatatgtaaactttttccctgcacaccagagtgtccttttgtgctctttgctttggaggcagcagtttggtcaagccccttcccttgtctgggcctttaccctctgtactttagagctggactgcactcttcaggccctccacccttcggggatccaaggggcccagttaacatcagggaggagctgaccttggggtctcctgagctcagcggtcagggaagtctggtttctctcacttgcctgttctctcctggggtgagtcagagaagaatgtcacagcaattgttgtccttcctcatggagacatgaaaacaggacaggaggtttccctgccccaccccaaactctcaaaacaatgtccagataaaacctaaagcttcattttggctcagtgggccctgctcaggtaggtgctaaggacgtacaggtgtgtgattctgtgtctctgtcctgggtgtggccatcagggagggagatgcccacacacagacgactcccccgtatggtgagtgccaagaaaaggggcctcctggccaagggactgctctgctcatctgggcctggtgccgctgtcctcatagtgttcaggatgaacttcttttccagggcttcttattgactcatcgctaccttgttgaagtgagctgccatagagcaggagggtgcctcatgcctcatgcccagcacagacgaggggctcagagtgtgctcctgaggccacaggaagggcgacggactgggctgagctaccctgggtgatacagaacttaaacactccctcctctcctccatccagtctggctcaatttctgcctcagtgcagcccacaaattccttctgggtgccagtgagaagcaggagatgccagggctcaggtcgacagccaccttcctgcccccttggtttctgcctgcctgtcctgctggcacctgcagcctccatttgcaaatgctttgcttttgtcgatgggtctggaggggttctctatgggctgaaacgtaaactggaacttggcagaactgcaaggtagcacgtttctctagcattggatgagtgtgacacatggatgcggtggctccctggaccagctgtctctcagttaaccagccaagtccaagcagaagggaagcagctcttcgattcctggggaattctcctcctcccatctccccacccccatctgcttaacacaaactaggaggcatcagggtggttggcccctggctcatagagggggccacagtgatttttgtcactcaacttgggaaaaccattgtgctcacctggggacagtgtcctgcttggattgtatgctgcctggctataaaccaggcgctctgacattggggttcagtcctggatctgacaccagctgcctgagaaacccttcacagggcattagcttcctggtgcataggtacctgtcaccttaagtggtgtgccacctgaccattctgttgtccctgggaaaattgcaacgcagcctctaggcttttgcctcctgactgatggcttgaggtcccagagccaggactgagcaaggaggtggagttggttaatgttttatgctttgggccgcctagaaaaagctttttccacgtgtcaagggccgggttgaattaggaaagctcatcatccagctattaggctaccccacataattcttctgtttttaaaaaattgcgtctgcatcctccactagcccactagcccatttcaccgtttgatgttatttgccgccaggaagttccagtgtatctaacccagacctcttgggctctccttcagtcagttccctacaagagatagacccgatttcaggctgcagcagcctctcccaaagcatgtttgttaactcctttgcctgcataattttttttttttttttttgtagagatggagtctcactctgtcgcccaggctggagtccagtggtgtgatctcggctcactgcaatcttcacctcctggattcaagcaattctcctgtctcagcctcctgagtagctgggactacaggtgcacgccgccatgcctggctaatttcttttgtattttagtagagatggggtttcaccttgttgcccaggctagtctcgaactcctgagctcagccgatccacccgcctcggcctcccaaagtggtaggaatacaggtgtgagccaccatgcctggcctgcctgcataatcaatagagagcagaaatatcacaagcgtcactgactccccagcagaacatggaaatgaaaatatgttttctcaaagcactgagcttggtgctcccttttggtattatttcattaaacgtttaagaatctgacctggccaggcgcagcggctcacgcctgtaatcccagcactttgggaggctgaggtggccggattgcatgagcccaggagttcgagaccagcctgggcaacatggtgaaaccccatctctacaaacaatacaaaaatcagctgggcgtggtggcgtgtgcctatagtccccgctgcttgggaacctgaggtaggagggtcacctgagcctggggagggcaaggttgcattaagccatgatcatgccactgcacttcggcctgggcaacagagcaagacactgtctcaaaaaaaagaatgtgttaatttaatgtttaacatgtcagaagattgattggcaagtaaagaccttacatctggagctaatatattacatttttagtgtttcagtttactgttttcacctaaattttatcaacccagaagtataggtatcatcccattttactgatgaaaactctgccgctcagggaaactgacttgcctgtggtcacacagccggtaatggagctgtgatttgaacctgagtcttagctttcctggctcagtgccgcttcactctaccagaactacctcatagctggcataagtaaaggttgtttgaggatgtgaaatagattcactttggttgaggcacaggtcattgggaggagtgggtaaggatggaaattcacattggaccaagttactggttctccctgtctctgtctgtactctatccagagcgcgttttatgacaatgcgtctctgtaataggcatgccgcttcttatctttaattttatgggtacctttgggctttgggttttgtccatcttcattaaaggcaaaccactttattgctctatttcttagtggccattaaataaatcatcagatggggatgggtaatgtgtagcagtagaatgtattaataattgagtatcctgaaatagactttcatttttgcagctcgccaagaatattgggaatgcaggctttaatgagatcatggaatgttgcctaccagctgaggactcagtcaaacccaacccaggcagcgacatgtaagtatgggactggctattctcatttgctgagtaaaggtttgcctttgcccgagccccgggaggcaggggaataagaagttttgggtgcatccatcgttgcttctttagggaataaatcagcctatgttgggttttcttagtcactttaaccttttgggtgaccaaatagaaatttttttaggaagaagccaaaagcaggcaggtttcgcagatgctgtgcgtgtgtgcagcgggtatgtagagagcctcactcgccactggtgggtggaagaccctggacttttcacctgtgctgtctgttctgttgagtcacttccccgtcttggtctctctgcataatcctgagccaccgagatggctggttgtggtagatatgtgattatgtagcgtccttcttgccaacgtccttgcctccttgcaaatgtggaatgtgttacttccttcaaaaaatgtttgtgtttgtgttattgttgatacacaacttgacggagaagcttttttttttttttctgggagacggagtttcactcttgttacccaggctggagtgcagtggcacgatctcggctcactgcaacctctgcctcccaggttcaagcgattcttctgcctcagcctcccaagtagctgggattataggcacatgccaccacgcctggctaatttttatatttttagtagagacagagtttcaccatgttggccaggctggactcgaactcctgacctcaggtgatccactcgctgcagcctcccaaagtgctgggattacaggcgtgaggcaccgtgcctggccagcggagaagcttttgtgtctactggtgcagagctgacaacagggaatgttcttgcccatcttatcagagtgtcagtggccatgtcacactagtcttcgagaagaggtggacagggagacccatgggttcgggcagtgggtgtccggctcgccttagacttcagctctgtttagtattatggctcttatgtctatagggggacatgggtggtttacctgttttgttgtgatgcaaagtgaaacagacggaaggaaggagagaggctactgggccagttaacagagcacctgcatttgagtggtgaggctgggtcagcgtgtcctggcaggacagagaaaaatgaaaaatatgtgataagaaaaagtatttaaaaattcatttacagaaacagcattttctgtggaataagcctgaagtagaattaatgacacgagtcttcccaaaggacagtgagcaacagtgaacaatgtctttaagggtggtttcacaaataggtggtagtgtatggaccctttgtaaagggagagaatttagatttttttttccccttcaagacctcttgcccaggctggagtgcaatgatgtgatctcggctcactgcagcatccgcctcctgggttcgagtgattctcctgcctcagcctcctgagtagctgggacaggcacatgccaccacacccagctaattttttgtatctttagtagagatggggtttcaccatgttggtcaggctggtcttgaactcctgacctcgtgatctgccccccttggcctcccaaagtgctgggattacagacatgagccactgtacctggcctagattttttttaaccattttgtgtggcatgtctttgagaaacggagattgcaggacctgtattctttctgcgttttgctgatgtaacttgatacagtgaaagagccagaacattgcgagggagtgaacagggaccatgtgcattacagtctttcaggtatcaggtatctcaggtgagcgatttagttgttgttggattaaagtcagtttatgtttgaatcctgtaacaagtgtttgtggtgtcgcatttccttgagaattggataacgtgtggttttacataccaggcatgaggttgacaatgtgatcatcctctcttgatgaggatctaagtttcaaatctatatttttacccaaacctagagaggcagtagggacatagatatctcagtccttatctgagccatgggacaccggcagattgtttaacttctctgagcctaagctctgtaataaaaaaagggagataacgttccccctcacagaggcattgggggcatgagcgggatgatggggtcagacatgtggtgcttagttttagtgcctggttgacattagctgccctgcttgctcttcttcctgtgggtgacagaagtcacatctgtaccctgcattgattccatacaccctgaaaatgaggttcctctccagttaagtttcagtggagagttactcaaggtgaaggagctcttcctgggcgagcctgagggtcccgcttggtgaaggaaacgtcgtgaatccagcatggcgaggtcatctcctgctgtgcagttgacacctgctctttcagctgcttcatctcacactgacggtaccagcaccctgtaatgctgtcatatcggtcagttctgaacaaagtgtgtgtcgtttcttccaagcaccaggggtacctaacgaaagcagggcatttggttgttctggggctaggcgattctaaaaaatgaacactgtcaatgtggaacccttcagtatgaacgttctgtctgcactgtagccctcctccagccttggcactgttgaaaaagaaatttacatcccccaaccccgggcttttttcaaaatgagggcggatgacccgtgtgatggcgaaacatcagctacttccattccttctcaactgaaattactttcttggctctgtgctcctatagcatttggctctattttaaaacatttcatcccacttcatagtatactcaggcatttacatatatttttctgatgaattacttcttactcattttggtttttcccaccgtaatatgttgcttctggtgaaccagtgactatttaatgaatcagcgagtcaaacaagtactcccagctctgtgcctgcttaaataagctagtattttacttccagatgaaaaggaatacactgcttctagctttatttcagaacagcacaccatctgcagataaatctgttgaaggggaaaccaaggacaccctctagtggcctgtgaatcccaagacggatcttgggggtgtcagggacgtgtaactgggggaggtggagcagggaagctaggcttgtatttgctcacaggagccagaactgtttctccctgtgacttgggaccattatacacaccctgtccttgagaagtgtaaggagagcccctcctctgaacaccaaatgtatcattatgttaattgtttttctgcaaaagcctgtcattaaaaaaaagagggagggccgggcgcggtggctcacgcctgtaatcccagcactttgggaggccgaggtgggcggatcacgaggtcaggagatcgagaccatcctggctaacacggtgaaaccccatctgagggatcacattagcaaagcaaacctccttcacaaaaccagggggcatgtgtggagttaaacagacctgtgcccatgtttgtgtaggagctgccttcggggcctccaagccctgggcagatgagtaaatacattaaaaaacaagtaaaggaagtccactttctctctatccctttcctgtggaggtcgcagtaatgattgtcccacagtgatgattgaaagtgcatgaaactggacaactgtccagtctaactgcctgtcagaagaggcatttacatcattaaatgggctgcccaccatgacactcgccaggccaggaatggagcatctccctgggtgtcacactgtgctggaggccctaagaggagaacctgcaggaataaaatgggtcttcccttgtaggcccaccagctgcctgaggaaacagaatccagtttccctttatggacttcagtgtacagtaaatcctgaatgttccagaaactcaaaggtttctggaaacctgtgactttaagcaaaatgatgtataagaaaccagttttaccctatgccaattgatgtaaaccagagttcagttcctaccatgtatttctgatcatgagaacatcaccaaacttttgaataaaggcccagaacacttctaatattaaacattgaaatatgagcgatgcatacatttaagaaagattctggctactaagtgggataaagaaagatcataaaaaccagtaagataatgattcacccacttattccagttcagggtcagaggtggctggagcatgtcctggcagctgaagtccagggtgggaacaagccctgaacaggaccccgtcccactgtgggacgcagtcacacccacgtccacactcagtcgcagtggggcctttgagacacagcagttagccgaacgtgcacagctttgggatgtgggggaaaccggagtgcccagagaaaacccaggtggactccacacagacagggaccctgcctgggaattgatttttttcttaacattataacaaaatgctgttattcgagggcctgttgtgcctacaggtggagatgaaaactcatggcactgttgagggaacccactgagaccacgtatctcacacacaagtcagccagcaccgcagtgagctcagtgcacgggttagcgctgtgtggacggggagcatgtgccgggggacgttgaggcacccgccttaacctaggccctgtagagcgggcagaactggagccggagcaggagggaggcagtgtgataaaagtgccagagcacaagttcaccaggtgcccctggaagtccttcctgggctgtgaagcatgctgcctgctcaggtggaacgggcaccctggggcgtgatttcctctccagctgcaccagccagcctcacgctgcggcgtgtccaggagccacatgcacccaaggacaagcagatttgaggcctggcagacgctggcaagagacctctgcccactcagttccgtctgggtgctgtgggagtaatggcttctcatcttaggctggcccatcttcaagggaccccagggtagacaggatctctactccctgcctccagtggcatgtccagggagctcaggctccccttctggggggccagttgttccacggggatttagggcaggtacagaaaagtcaacaactgctccagcagccatggccccttgccatagtcagctgagtgagagagcggaggtcaggagggaaccgtgcggggactccagctcgaaggggagcagccgcatttgtcctcagattgtaggcagtgctgtgttacaaatggatgcaactgatctgcccctgcctggctcttgcctgattctcaagattcaaagagtccctgggcagtgaccctcaaccttcagaattgggattgtaaaatgcatgtactctgtgaccagtgagctgctgtttcgctctccctcttgtaagttcactgggtctttccaaggcccgggacccactgtgtgtgctgcaggtgtgttgacgcacatacgtctcatggtgctactgtgaggatgtattgtgtgcattttcgcaagtcagacttacaagtctagagagatgaaatacttattcaagttcaaagcagcagtgtgtggtgggagtgggatttgaactcaggcttctttggcccccttttgttcctgcttctgtaggctctttggatggggcggagtctgagcatgttgccacataaaggccagaaagtagaacacaaagaggactgccatttcatttcagttcatctgatagtgcctttcataccaggcatggtgcctacaaaaaagaggtcatagtccatgccccaaggagctcatgggcctgtcgggcagtgaggcaggcaggccttcatgtagagaatgttggaacagaggttggccagggctgcatggagggcaggggcagggccttcctgggggaggaggcgcagggcatgcggattggaaggacctgaataagaagggcgtggaggtgacgagggcgacagtgaggtcagatcacagaacttaggagtgaggggagggagacaaggcagagaggcgggtgggctgagagaacatggggagttgtccccctggccagttcccaggaggtcgcagtgaagaccagtgcagccgtagaaccacatggcggccactcccgctttgtgtttcggggccagcggtgcttaccagggacatggcgcaggaaccgttaacatggccttagacaaagggaggccggacggcgggtagaagcccttcatgatttgcaaggcaattacgtttggtttcaggaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgtaagagtgtgggttgttgctactttaaaaaaaaaaaaaaggccggccacggtggctcatgcctgggatccagtactttacttcaggaggccaaggcggaggatcctttgagctcaggagtttgagatcagcctgggcaccatagggaggccccatctctacaaaaaaaaaaaaaaaaaaaagtaaaattggccaggcatggtggtgtacatttgtagtcccagctactcaggaggctggggtgagaggaatcggttgagcccagaaatttgaaactccagtgagccgtgattgtgccactggactccagcctggccgacagagtgagaccttgtctcaaaaaaaaaggaaaactggggcactgtggcaggtctgtggaatcagcagtactgaccaaagctgggtaattctccagaggaagacggcacggagaggggtactggggtagaataaactaggggtttttcttttcagtagaaaaataattgtatctatgttcatggggtatgctgtgatgtttttgatctatgtttacatcatggaatgattacatcaagctagctaacatatccattacctcacaggctcatccatttttaatggagagcacatttaaaatcgactcagttttgaaatagacgctatgtagtcttacctggagtcaccaggctttgtagtagatctgcaggatttattctccttgtctaaaactttgtacccacctagtggtttattcttacaccaaaaatgtaatgccagctctggaaagaaaacccatctccaggtggaggagaagacatctcagaagctaggcagcctgagagggacccctcatctgcaagcaggtttaacctgagcttcatgctaacgagagaagctctctgagaggggcggttccctggaacccacaccccactgtgctccccctcagagggaatagagtaggagcaagacccctcctttcctgggggagctgtcttgagagggtgggcatccagctggagtgggtttgcagtaacataccagcacccaagtggggtggcatgtgtccagattctggtccacaaataccctgtagatgcacatttggtcccctggaacctcctgacctcaggactgggctggctgcctatcagcaaggatgcctcacggctgcagcatctttctcttggtaacaggcatgtccgtgcaggctctgagctggtcccactctctccccatccccagaaagaactcatgcccaccaatgcagtgtggagggtgcccagcactgagctgtgctgccgccagagggcccagcaggcagggcaggcggcctgggaagcaccttcctttgccctcacctcctgtcttctgtatctgtccttctcctctggttctctcacccacccacctgctgaaacaatccttgttcatctcttctcccccacctgccaggtgtactttcagaaaaggcagtggagttggggaatccccagtatgagttggagacagtgcagttattagcattcgtagccttgtctgtaagtgtagaacgcaaaactttaagcctgcttaagaaacatatgtttctactcaaggagcaggtaaagagattggattgtaggtggcctgggggaccttcctggatcctttgaacaagattcttgcttgcaggcagggatctgccttgtggtgctgatgcagggatggggacaggtcgattgagaggacttagaaatgaaactcctgaacttctcatttatttcccatggagtcaggagaaacaggacgaatctccaaattgcacgttcccaagggcaaagagcttgtgtagagattaaagagactctatgtaagagataagtttctcgaagggaaagataaaagacttttggaagagttgtacacgatttcaccggtgttggacacagaattgaatgctcccattagaattctggaatgcctttgtttggtttttcaggagccggatgaaacggccctccaccttgcagtcagatccgtggatcgaacctctcttcacattgtagactttttagttcagaacaggtaggtgttctgaaattaagggaggcactcgttttctccttggtatttctggggaaggaatcggacgctgcctcatcgcttctgatgtgttgtcaggagaaccttcccagttctaaacatgaattaaagacagaaaaaggactgccaggtgtgaggtactccatggcaatcctttaaaaaagcactagaaactcttttgtggtaattgcagggtccaacttctagtgtctggtactcagggagacaccaagtagatatggctactgaacttggggaccccatgaccaccctctgtgcacaggggccgtcctcgcctcatcctgtgagccaggtcatcgtactgcgcaagcagtgtcctgagcagtagggaggtagcaggcaaggagggatccacacattagccatggtctgagccagagattagaaaccagagcactggattatgggtgttttgtttgggtcgagaagttgtttttatgctttgattagaaatggcctttagagatgtgcacaggcagtttaccacagatctgggagtccccgtggtttggggcatattgcttcagtcatgtgttacctgcctggcagctgaaggctggacttcaagacccctcaacgtgtattttgactccctgatcgtggtttgagccatgtgtgtactggaggaggaggaggtgctgttaaaagccacagaaattgctccaaaggaaatggaaaattccaaaatgcaaaagccatgggatagtttgcattttgtgtcctctgctttttcctcccatttctgagcagaggagtgaagaaatggccagaaagtaggggagtgtggggtggtcaaccccaagacctgcagcttcttcctgaggaggctgagttcactggactcgtggtggaagctgccctgatgccccatctctgagtgccagcccggctcctagaacgcagcaggggtttcgtaaacatttggttgatagctgcgtgatgcctctccctccatgcacattttcagggggcaggagagggaaggtcccagtttctttttttccagagtggaaggaggacaaaagtgggggagaattctgaaaatgaaacacaccccccgctccccatgcccacaatttggtgaaaaagaaactccttttttgatattgaaaatgtaattggtttccttctcatggaagcagcaggtgccacttcctgagatcgcctttctgtctccactttgtgcaggggcacaaagctcactgcccctcctcagaatgtgacagtggccatgtttgctaggattgagggcctgtcccatgtctgccaagcctgagcaccttttgtgggtgacctggtcttgtgatatgttggaagaacttttgaaaatctcaagattcccctttagcctgttttcagagggtattcccagggcaaacaggccgaggagcctggggactctgggctttgggaaagtgacttttccctttcctggagggaatatcaaataatgatagagaaaagctcagcctccgtcctcccgtgggacaggatggatgagtcacacaggcatccagaggccctgcatccagcacagctggccggcctagcacagcagcctcggcgcagccagtgggacgtgagaaggacgctgggctctaggttcaccccggtagtgcactgccccaccttggccccacatgctcagcaacaacagggatgcccccctccccttttgacctcttctgccatcatcgtgttatttccctgatgaccttctgctaaggcttccccagccatgtaggcagggacggtgccaggtcccaccaccttggcgatgatttacagaaaccgttcactcggggactgtctgcctttcctgtgcccgtagcccaggctccctgccgggcagtccctggtcgtccagcctgtgacacactatgctctctctctgttcctgttctcgggcagtgggaacctggataaacagacagggaaaggcagcacagccctgcactactgctgcctgaccgacaatgccgagtgcctcaagttgctcctgcgggggaaggcctccatcgagataggtgagtgggcccgggccccgggggtgggctcagctgcaccctggcctctgcctcctgtctgccatccaagcgctgctcttggaaacagggccaaccctgtgggctcttgttagtgccaaagagaaggagaacctaccgctaatgagaaagagcctctccctgcctgttccacgaggccgcattcaccatctgttacttagactttgggcgcgtttacaggcattttacagatcataagacaagcaaagggtgggtcttgcagctctcacggatgccaggtgaatttggacaaggttggggaattttgacctgttcacataccctgagtctactcacccccacctgaggccacacttggcccctttcttggctctgggtttagacggattacagggggagatgctgtttactgccctctcctttcatttgcaccactgcttcctccatgaagggccctggttgttacttggccccggtccctccctctctcgaggaccccgacatgccaacagccaaggcacagttgtgccttgagagcatccagctgttgtcccctcaggaggaagtatttttgaaggactgttaaataaagaggaaagaatagaaaaaagacacacatctgcctgagagccgtgcttatcattaaaaaactaataatcagacctcattgactgaggcttatttagaagaaattataggccgggtgcagtggctcacgaggtcaagagatcgagaccatctggccaacatggtgaaaccctgtctccactaaaaatacaaaaattagccgggtatggtggcgcgcacctgtaggcccagctacttgggaggctgaggcaggagaatcacttgaacccgggaggcggaggttgcagtgagctgagattgcaccattgcactccagcctggcaacagagcaagactccatctcaaaaaaaaaaaaaaaaataaagtatatactttcagggtttatagactgcttgagagaaggtttaaaagtttgttatattgcagtgcatggaaataggtgagcagtgcttttcgttagaggtttatgatgaatcgctttattcaatgagttacagtttggatgtggattttaattaggtggctgcttcaacagtttttgtttttgtttttgttttttgttttttttgaggcagagtctcgctctgtcaccaaggctagagtgcagtggcacaatctcggctcactgcaacctctgcctcccaggttcaagcgattcttctgcctcagcctcctgagtagctgggaccacaggcatgtgccaccacgcctggctaatctttatatttttagtagagacggggtttcaccatgttggccaggctggtctcgaactcctgacctcaaatgatccacccacctctgcctcccaaagtgctgggattacaggcgtgagccactgcgcctggccagttttagtttcttgattagttcaaacttcatcttttaaagttttaccttctgtatttagctgtagttctatacaattacaagatacattcagcctcgactaggtcaaactcactgtggatttcattaaccaggcccaatttaatttagtgctgcctttctgttccttttaaaaattgtcctggatgtcaggcctttgctgggttttgccttaacgcctcctttgctcgcccttgaattttagcaaacgagtcaggagagactccgctggacattgccaagcgcctcaagcacgagcactgtgaggagctggtgagtctcccaccacaaggacggggtggggcacctgtcacgggacagggagccaagcctgtcctccttgggcagggtttgctgtgaaccagtgtcctgagcagagctcagtgtttctgatgggatgagccgagaatcagcctgccttggagaaggtatgctagggagtctacagggaaacctagggggacccacccctcgcagtgagacttggggtgtgagtcagtgtttgctggttggccgtgttggtaacatcactgctgtggtgggacaactggaacagaggcccgaggccaccacaagggcctgctctctggcctccgtaagctgtttacttgctactttgcaggacatcaaggccaacctcctttctttgttcctcagccccagatcatgtgggttgctcaataccatcttttcctgttctggaagaaaagacaatgtagacagtagaaagagcccaccaggccaggcagccctggccttgccgggggctccccagcttggcttgggaaggaaactctcttaggctgtttccttatttctacagtgcagtcagttataccagtatataaggttgttgtgagaattattatcaaatgctgtaaagcagttgacacacagcgctcagtaaatagattaaggccaggcacagtgactcacgccttgtaatcccaaagctttgggaggctaaggcaggggatgatggcttgaggccaggaattcgagatcagcctggcaacatagtgagactctgtctctgcaaatgatttaaaaactagcaacgcatggtggagcatgcctgtagccccagttacccaggaggctaaggtaggaggatcactttgagaccaggagttcaaagctacagtgagccataatggtgtcactgcactccagcctgggcaacagagcaacacgccatctccacaaaaacgtttcgaattagctgggtgtggtggcacgcacctgcagtcccagctactggggaagttgaggtgggagaatggacttgagcttaggagttcaagactacagtgagccatgattatgccaatgcgcaccagcctgggggagaaaaaaaagaactattaataataaatgctatacaagtgtaagataagtaacaggtcctctttctaagcactgtacatccacgagctcatttaatcttttttttttttttttttttgagatggagtcttactctgtcacccaggctggagtgcagtgacatgatctctgttcactgcaacctccgcctcccaggtttaagcaattcttctgcctcagcctcctgagtaactcggattacaggcacctgccaccacgcccagctaatttttatatttttaatagagacggggtttcaccatattggtcaggctggtcttgaactcctgacctcaagcaatccacccgccttggcctcccaaagtgctgggattataggcgtgagccaccacacctgacctgtctcatttaatcttcatagctaccttatgacatagtttctgctgttgtcctcattttacagatgaggacacaggcacaggaaagttaagtgacttggccagggtcatgtagctactatctggttatgggggaaattaagccctgaggtcctgagacacccatagtgtgtaacgaattaacttctcttctgcacatgtagaacggaactagctatctaccttccttgagagaactgagaaaatagccacacagatcattttctacagcgtttaattctctcatcctggttgaaaaggctgggtttacagtgaatgagcacattcattctcctggggttgagctttctcccatatggagtatggatacttgcaggctgatcagcatcctttagatctcaaatatcctttgcctgttgttttggggaaaactctagccctgttttttctgtacggttacactgttgtcacaacaagcaatacagaagcagactgctgtgaccaaaggtgtggggttctcccccgaccccatacaccaattgtagtcgcctgacaggttcttcttgcctgctgcatagattaaacccaattcatgagacagtgtgattgcagcagagaaagagtttaattatggcaagctggctgagcggtgggaggacaggaattattactcaactgtgtccccacaaaggctcagaggttagggtttttcaaggatggttggatgggcaagagggctaggaaatgggtgctgctgattggttgggagtgaaatcataagagtatgagaaacagcccttgtccactgcatatcatctcgggggggccacgggactgtttgagtcatgagtcaggttcagtggagtcagttggtcaccaggatgcaaaagtctgaaaaaatatctcaaaagatcagtcttaggatatgttatctataggatcaattggggaagtcacaagtatcgtggcctctggtgcagtaaacaatttttttaaaaaaagacagtgtctctctgttgcccaggttggagtgcaatggcgtgcttgtggacagcctcaaactcctgagctcaagcgatcctctcacctcagcctcccgagtagctgagactacagatgcatgccaccacgcctggctaaaaaagtttttaaattttttgtagtgatggggtctcgctatgttgcctgggctggtctcaaactcctggctcaagcagtcctcctgcctcagcttcccaaaatgctgggattacaggtgtgagccactccactggatggtaaacaattacattaatagagaggcaagctgcacctacattttagcagaattcagacccttcccataatcctaatcttgaggcctttcattagtcttccaaaggcactttcaagttccctaacaagaacagagtcagttttcacatgcacacgtatgtttattgcggcactattcacaatagcagagagacttggaaccaacccaaatgtctgtcagtgatagactggattaagaaaatgtggcacatatacaccgtgcaatactgtgcagccataaaaaaggatgagttcatgtcctttgtagggacatgaatgaaactggaaaccatcattctgagcaaattattgcaaggacagaaaaccaaacaccgcacgttctcactcataggtgggaactgaacagtgagaacacttggacacagggcggggaacatcacaaaccggggcctgtcatggggtggggagacgggggagggatagcatcaggagatatacttaatgtaaatgatgagttaatgggtgcagcacaccaacatggcacatttgtacgtatgtaacaaatctgcacgttgtgcacatgtaccctagaacttaaagtataataaaaaaataaattaattaaaaagaaaagaacagagtcagttttagggagggactattaccatccttgattcaaacttacaccacaaactaaattcttcccatggttagcttggcctgtgcccaggaataagggaggacagccagcctgtgaggccagaagcaagatggagtcagccatgctagacttttttcactaccatgttcttgtaaaggcggtttcacaagcagcagacaccagctggctgtcctccagttcaattagacactatctacttggaggtagtgttagatcccacaggctgggggctcagtccccaagactgtcttccaccccagacaccagtcacaaatcaacctccagaacttctgaccaaccggcttcaagttggggttcccacagccccctctttgggtttgaataatttgctggagtggctcatagaactcagggagacacttgtgtttactggtttattataaaggatattgcaaagcatacagatagagaggtgcgtagggcaaggtgtgggggaggggacatgggggttccatgccctccctgggtgccaccctccaggaccctctgtgtggtttgccatcctgaagctcgagaaccagtcctctttgatttttatggaagcttcttggtgtcagcatctcttcccccagggtacagggtgagaccctctctggggagggccttaagacccacagtcagaaaagtgggggacgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggcttcacctgagacccagagatttccatgcatttgccttggactagaaggcaggcctcctgcctgcacacttcagtgggtccagatgcatggccgagtgtatgagcaacagcactgaccatccctctgttctctcagctgacccaagccttatctggaagatttaattctcacgttcacgttgaatatgaatggcgactactccacgaagacctggatgaaagtgatgacgacatggatgagaaattgcaggtctgtgccaggttgctaaccattaagagttttgatcagcttcatccagaacagtgtgggtcctaatctgtaattaaggcagaaagctgttttatagaaatgaaaatgtagcttactttatgctttcattgatctcagtaggctcttggttttacccttcccactaccatctcctgtctcccagctcctgcacccattaatttaaaggaatggctaattatgtacttataggcagccttttgctacaaaggaaaggtgtgtgtggcgggggggttgattccagtggatttagaggaaggtctcttgctatggagtcatgtcataaagagccagatttcccccagtctaggtgatcacattctcctggttgatcttataaaaacatcaactgaaatcatcagacgacctttagagctcactgggtccaaccccttcctttatcagtttgggatattgaagcctcaagagaaaagttgacttggccaaagtgaagcagctatttagaggcaggcttgggactgcacgaaggctcttgcctcctcctccagctcccttcttaccatcctcactgcttcatacgcaggggtgagccccaggaaggttgctgccttcacgcaggacttggagctgagagtcagacttaggccttgtgacccaaagccctggctcctagccgcgacccacttccatctgtccttcagcatggtgcttcgaggcatgtctggaatgtgctctgtgctgaattagtggcaaatgccacattaaacacattttcatggtttggcttttttttttttctgtaatgcattaatgttctgatgtgtattgaggatatctaattagatggatggataggtcagtaggtaaccagatggcatttctgaaacctgttggactgtctgctcatggagttaacatccatacttaactgcttcttagaatacagaataagaaattacttcactgagttagctacaaaacactgtcaaagtgagaagagttgactgatttcatacttaacctgccttaaaaaaaaaaagctggaagcagtctgccccagcctgcctcttcatcaagcggtcagatgccacattcccatttgatgagcagtgatgaagcaggttgcatagtccaaggaaaagcacaagagcaggggctggtgtggagtcctaagactcatccacgctgctcacctgattctcagcagacagcagccgtgggctttgcaatttagaaatatgtgtgaagaaccactgggtgcttagttctgcacacctgagctgggtttgaaccattggtttgtccagaacctagaaagggttggtggtcctgtgagggagaggcagggctgccacagttcatactgagcacctgctaagcacctggcattgtgctagaaaagcactcgtcatatccagtgaacagacaagaatgtggtcagcaaggttgagtcatttgctcacaatcatacctagtttaatgaagctggcatttgaaatagaagttaggtctaagttacctgagtcatcattccatgcattcacttccaagaaagcacatgaccggccgagcgcgggggctcacgcctgtaatcccagcactttgggaggctgaggcgggcggatcacgaggtcaggagattgagaccatcttggctaacacggtgaaaccccgtctctactaaaaaatacaaaaaaattagccgggcttggtggtgggggggggggcgcctgtagtcccagctactcaggaggctgaggcaggagaatggcgtaaacccgggaggcggagcttgcagtgagctgggattgcgccactgcattccagcctgggcaacagagagagactctgtctcaaaaaaaaaaaaaaccatataaccttcaggggggagcaggggtggccaaactcttaaagggccagatagtaaatattttaagctctacgggcctaaagcgtcacagtccatgttaacaattactcagctctgccaggatggctcaaaagcagccttagacagtatctaaatgacaggacatggctatgttccaataaaactttactgacaaaaaacaggtggtagtccataggccactgtttgctaaccctaatttggaggaatctcaggagctcctgttcatatgggaggaaaacatcgatctctgctgaatgagccatatagctgttggagattgagtgcagcgggctggccagagctggccaccctgtggggtagcataagaaggcatgtttgggaaggggaacttcagggaaaatgctgacttaggttgagataacttcgactcataagataaatagcttatattttaaatccatcacagaatggagaattttaacctgtaattaacagattttttggtatgtgtgtgtttactagtcagttcttacactgctgtaaagaaatacctgagactgggtagtttataaaagaaagaggtctaattcactcacacctccacatggctgggaaacatacaatcatggcagaaggggaagcaggcacctcttcacagggtggcaggagagagagcaagcgagagcagggaaaactgccttataaaaccattaggtcttgtgagaactcactatcccaagaacagcagaggggaaccgctgccatgatccagtcacctccttccctcgacaagtgaagattacaattcgaggtgagatttgggtggggacacaaagccaaaccatatcagtgtgtgtttccttcacgagacacaaggaggagtgaattttcactcttgcagctctcacgcaacttgtagctctcaggcaacagttgagagctcaaatggtaccaggcccagcagagttggtgtcagtgaggttttcacccctgtgttgaatgttatcaccaggagcagttcatatttgtctcacacgcctctgccccaatgttctcctgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaaggtatgaagctgtccgtcatccctgtgaatatatagagggtcttgttttgtggtttgggaagtttgcagctgccctgcctccaactcagtgacctttgggctcttttgttttgtagttattttctgtttgcttcctaaagggattccatcattcttatcaggccagatggtggtagagtctcttgatttgactcttattctgggcagagttgtggcatctgcctggcttgggtaacatgggaactcccccagggcagcctgaggtggccaactgggctcccggggctgggccaaaagacacactccttcaggtctcccctctgcacccttctgtttacctttctccactccttcccaggccttcattcttcctttttatttctcttctgccttcatctggtccagctcatggcccctgcgattacttcttacccatgatccccataaaagatattggggaacgatgctcggcctaattgtaaaatacaaaaccagccctgtgggcctaccagtgtcttagggcaaaaagcatgcttttcttacctcagctgtaacctggaggttttgactcaacaggtgacactttctgtttttagaaatacgcaaaccaaagctctcagaagttaagtaatttgttcattcctgaagagcagctggctacggtgcttcttgaaggcaggtccggcgagtgacccactcagctctgggctgagctccagtcgtggccatggccttcagagggtttcccacatgaaggaggctgctgagactttgatgcggggcggggggcccaggaaggacaagagtctgcacagagcatgtatccaggcattgtggccgctgtgagccgctgatggagtggagcccacgtccccaaatacatcccaaactgtccttatgtggtagctgctagctgggcaggctgggtcggtgcgtgagggtggctgaggccgggagacctggcccagggctgagcagacggctgcagctttgtgctgcacgtacactcggctgtgctgctgggcccatcttccctgccgtcctgggtgtctcacagaccctcacacggctctgcccctgtcattcagggaggcccagagaagtgacagtgaacctgtcatgtgagtcactgagtcataccccgaagaacaaacctgctgagagcagaccttcccccaggcaggcccagaagccagctgcttgctgtccccacacagcccacatcccagaccgcgtccatccctggcttgatgaggacgtccctgagcacagaaggcagctacaagatgaagccacacagtcgcatctcctccctgtcaaacccccaggctggctggtcggggcccagggtgggtgcggctttctccccgcctctcccagatcctgcaggcaggcatcaattttctacggcccacaatcaagatgattttgatcatcctccttcccagcagtggcttttgctgactgtgtgtgtcacgggaggaaagattttattttgttccactgggtcatggaggggtaaactcttaatctcctggtttcccgaagtcttggaattcaagggttttgattttttttcctttttctttttgccgttcctgtccctagcatcatttcttcttccagtaatgtaggtcataccccttacctgccatctccaccattctctgtgtagcccacatgtggtcttggatggaattctcacatgcagataaatagcaaatggagttgacagtgtcagccttgcatttggggcggacctggctccccaggggaggagctcgaaggcttcctctggacccagtggcctggcccatttctaggcctagcctttgccctacaggccgtgcacagcctccaacatggggtcacacctagcacctgggccctgtgcacctgagcttggaggtttgtgaggcagaagaagggcttgtgacctggaaaatgccatctcttgtgggtcacctgaacctgattggtgtcatctgtgtctgcttccagccagaaatatgtttgcgggagggagggagagagagcccctcctctagtgtctgatttgcactctgcccccaacctgtgccagctgggcacacggtgttcctcttcacatggtggtgactcccacagcccatgggaaggagtcggtgggagggtggagaggagcagaagttccagaagctccaagtgcagtgttcgcaagagaacattgtgactgtttatttccttcttcaaatgatactgatatttgataaataaactcaggaattttaaatttcatggattgagaaaacctgctgagaatagtccttggagcctcttcggtttcgcgagtatcagtgtctatcttccacatgccggagacaggagtaaaagcattgagggttctaggtagaagggtcatactgaccgtttcataagggggaggatcaataacgcagtgttctgtttctgtttttgttcgtgtgtgcacgtgtatgtgtgcgtgcatgcgtctgtgtgcatgcgtgtgggttcagttcagacagcctcctctgctaacaccctgtggaagacaaactctgtaagtgtggacggtggaagccggcagcgatcttcgtcagatccgccagctgtccatccaccgctgccccctcttcgcgtgacatctaccagtacgtttttttcctttttcctttcttgcccgtgggctttgtagatctggatggcggggggtgctctctggagccacacagctgccagcacagacacgtgccaagtgccccgtgttgtatggctccctgtggctcttgtgcagggctctcagctcccccagcctccttcgtcacagctgcaaacccctgcctgtccccacactgcaccaccaagtagcttcctcactcccttcctctgtcttccaaagcatttcagcaacatttcctcctttacacagtaccccagggtttctttttcctttggccatttggtgattttcaatattttggggacagtcacttggattagaatctggctttttgtttttcttttctttttctttttttttttttttttgagacagagtctcactccatcgcccaggctggatgcaatggcacaatcttggcttgctgcaacctctgcctcccgggttcaagagatcgtcctgcctcagcctcccaggtagctgggattacaggagcctgccaccatgctcagctattttttttttttttttgtatttttagtagagatggggtttcaccatgttggccagcctggtctcgaactcctgacctcaggtgatccacctgcctcagcctcccagagttctgggattacaggcatgatccatggtgcccagccttgtttttctttttaagacagggtctctctttgtcccccaggctggagtgcagtggcacaatcatggctcactgcagcctccaactcctgggttcaagggatcctcctgccttagcctcctgagtagctgggattattggtgcaagcgtattttttgtagagacagggttttgctatgttgcccaggctcgaattcctgggctcaagtgatccacccgccttgtcctcccaaagtgctgggattacaggtgtgggccaccacgcccagcctggcatgttttctttaatatcaacatgtggttgaaagtcctgaaaaccttgggtaaagaagcgggaggaggtttttaggaagaagtttttctccagtgtacagaactaaagtcttttttcactggatcagagaagcgagccctggatgctgccctgtctcctgctgcagcagccctggagtggggagtccagcatctctgggcttcattgcttccagagcatgagaattctagagccgaggtgctcgtgacttccttagagtaagttaaaattaaaagcagcccagccccagctagagtcagtgccatgtgtgcacatgccggcagcagagccgggagcagtgggtctgggagggtcttcagaggtttccaaggcgaacacaccaaaggccagaaggaaccactttcctgcctctccgtctggtggtccaggggctgcatttgtgtgctagagtcagacttttgagttttcctttaaattggaaaaaggaaacaataatgataaaaagaaagatcataagctggatcccttcatgtttccccacgccagtttcctctctgtgtagctgaaggcctcattcttcctggcttttcctggcagagggaaacccagcgccttatgtgttacccatcctgaggcccagtatgataagcccgacatttagagagggcttaatgcctatcaagggaggagagacggaggaaggagacttggactcacagcctccctccaggtcttaccagctctgccacccttgacgagagctcttcccctccgtgggcctcagcctccttgtctgtaaaacgtagacactaagaaagctcttcacccacccactccggagactgaggagccgttactaagttagtagctcccatctctcctcagatccaccctgcccagcagcccgatgaagtgggtagggcctcatccctttggccacaggtcagtcgatgtgcaaagcaggccctgcttccccgggcagagctgagggccccggcctcctgctgttgggtctttgagtggagagcaggaaactgctggctttcccccagggagttctagctgagaaaatactcactcacaggctgatagaaaaattgtcatcctaactttaggctcccagcttccttattagtttggaaaggactccctgcttcctccctgtgaatggttttctgaaaactggcaaggaaatagcagcaggtttttccttaggaaatagcaataaaaaactgaagcccttctcagaaaagcctccagtgaggaggcctgagtgggaagcctggcggctgaccctctgcacgtctctccctgtcctccgcagatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccggggtaagccacccccagccagctcggccatccgtgctcctgccctctgacctcacctgcccagggctctgcaggaatgtttgcaatccccagggctcctactccagcgtgggcgccacataactaattcatcggggctgaagggtcttaaaaataactggaggatttttagactgtaaaaatgtcttacaaatgtacattttaagtccacagaatgaattcagacaaagtgtcctcaacacacaaggcttctgggttctatttgctgctcaccccccaggtggtctctgtttctgttttctattttcccaaggttgttttgaacacatagaccctctgtggtgtgaggcgtggatttcccacaaacaaggacattgtcctacctcacacaataccacctgcaaaatcaggaaattaacacggatgtagaaacaccacccaatccttagacccaggtcaagcttagctgtttgtccaaataatgccccttgttgcagatgggtctagtttgtggcttttttttttttttttttttttgagactgagtctagctctgtcacccaggctggagtgcagtggcgtgatctcggctcactgcaagctctgcctccagggttcttgccattctcctgcctgagcctcccgagtagctgggactacaggtgcctcccaccacgcctggctaattttttgtatttctagtagagacgaggtttcgccgtgttagccaggatggtctcgatctcctgacctcgtgatccacctgcctcggcctcccaaagtgctgggattacaggcgtgagccactgcaccaggccccagttcgtggctcttaatctggatctttatggtgggaaatggttccttttagtggaaatgatatttagaggccaagttctgggggctaggtggagagtcactgctcccacacaggccctctgagctgttagaacttggaaatatacgcacatgtacatggatacatacatacaccacttatctctctattccgtatatttctgtattgaaatccatgagttcacattgacatctctgatttcagttgttctagtaacaaaccacaccagactgacagacatgaggcacagccagtttattctgctgacagattgtcaggaatttggatggtactgtggggtcttcgtcttttctccacagtgtctggagccttcgctgaaaggactcgaagcctgggggtggttggacacaggaggtgactcgttggctgggggttacggtcagagtctcttcacgccccccgtggtagctgacgctgcctgtcagccagagcctcagctgggctgtgaccagaacacctacatgtccctggcatgggcttcctcatatcacggtggctgggtccacggacaggtccccagagagaggcctggccctggaagctggcacggaatgacttccgccatacgtcactgctcagttacaagctcagacacagtcggggcagagaggactgtggagtggcacaaggaagtcatcagttccacctctcaataaagaatttggggccaggcgccatggctcacgcctgtaatcccagtactttgggagaccaaggtgggcggatcacctgaggtccagagtttgagaccagcctggccaacatggcaaaaccccacctctactaaaaatacaaaaaaattagctgggcatggtggcatgcacctgtaatcccagctactcaggaggctgaggcaggagaatcccttgaacccaggaggcggaggttgcagggagctgagatcacgtcattgtactccagcctgggcaacaagaatgaaactccatctcaaaaataaaaaaataaagaatttggagactaggcaccatggcccacatctgtaatccctgcactactgtgtttttgtttttttgttttgttttgttttgtttttcttgtgttttttttcttttttttttttttttttttttttttttttttgagatggagtcttgctctgtcgc

SEQ ID NO: 712 - DNA, 32177 bp, Human
  misc_feature (1)...(32177): n = A,T,C or G
ataaaataagggtatggctgggcatgggtggctcatgcctgtaatcccaacactttgggaggctgaggcaggaggatcactggagcctaggagttcaagaccagcctgggcaaaacagtgagaccccatctctttttttttttttttcctttgagacagagtctccctttgtcacccaggctggagtgcgatctcagctcactgcaacctccacctcctgaattcaagcgatttttctgcctcagcctcccaagtagctgggattacaggcacctgccaccaagcctggctaatttttgtatttttagtagagacgaggtttcatcatgttggccaggctggtctggaactcttgacctcaagtgagtgatctgcccacctctacctctcaaagtgttgggattacaggcgtgagccactgcacccagccagtgagaccccatctgtacaaaaaataataataaataaaataaaataaggttaaggaatcattatgaatcttcctgtaaacatcaaatgaggccatacaccctaagaatacagctcacaggtccctactgaatgtgacagtttagtccagatgggagttccctgagggcaggaacggagtttcagcaactggtccccatggcaggttggagtatgcactaacctaacatttactgaaatttcaaaatgtgctgggtaaggctgggcgcggtggctcacgcctgcaatcccagcactttgggaggcgggggttgcagtgagcagagatcgcgccactgcactccaccctgggaaacagagcaaaaactccggctccaaaaagaaaaagaagtgggagggctaggcccggcgtggtggctcacgcctgtaatcccagcactttgggaggccgaggcaggcgggtcacgaggtcaggagatcgggaccatcctggctaatacggtgaaacccccgtctttactaaaaatacaaaaaaaaattagccgggcgtggtggcaggcgcctgtagtcccagctactcaggaggctgaggcaggagaatggcgtgaatccgggaggcggagcttgcagtgagccgagatcgcgccactgcactgcagcctgggcgacagagcgagactccgtctcaaaaaaaaaaaaaaaaagaggtaggagagcttaatatcgggctgggaggatggggtggagtagggtgagcgaggcgtcaagttcgattcctaaaaagagtaaaaggggagcctcagtgaggttggggagcaggcctcggctccaagatgaaccagcaccctcccgacccccggcagcaccccagccccaggagtcctggcagccccaccgacagagctgagctgtgaccagcggtcggagccacatggtcacagccgccaccagcatcaacatcagcatcgacttgggcttccgccgccaccactgcccctcaaccgccacggggagtcgctgcacaatccgagtacgtgcaggctgaagccctgcgcatgcgcatcaatgagtcccgggagcgggcctccgcgcactgcagcccggcgctccgcctgaatcttgagcatgcgcagacgaatcccgggaagcccgaatccgcgcaccccaaagtgcgctcagagcctgagtatgcgcacccggccacccgtggccagtctagagtctgagcatgcgcatgttgtccgcgcgcctaagcatgtgcacaggctgctcatgagttcctaaacgttgcgtttgcaacactaccagtgttttgtacgggcgctggcgcctgctcacagccttccacgtgaccggaaaaggccttcagcgcataaagtgggagaccggaagaggcggagacgatccgatgctcgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggtaatgggagtccccgcctcggcctcaggtttcccacctgtgcaagcagcgggctgaaccgtgggatcacttgagcgcccttgtgtttcgcaactttttcagacatgaagtttctcgaagggtgcagttcgaatccttgtctgctcaccactagcttgggaaccttgagccaaagtcctctccctttcggatttcttaggatccgttagatgagaggagttgaacccgatgagcctaggattatccactttagaacgccggtcatagaaatccggggccgggagggacctgagtagtgttacggcgctgttagttttctccttacttggcacgagttttgtaatacctcctcgccccaggcgctctgccgtctggttacgagcctcactgggatcagaattcattcctttcttagacaaatacttcttgattgcttattatttgccagagagtgttctaggttctggggatatggcagtgaacaaaacagacaaaaatttctgcctttgaagctgggcatggtggcgcgcgctgtactcccagctactctggcggctgaggtggaaggattgttggaaacctggagtccagcctggtcaacatggcgagaccctgtctcttaaaaaataaatctgccttggagcttacattttggcaggatgagacaggcaataaagatgtttagtaacgatattgtattagaaggcaataattacgagaaatagtagagcatggatgggacaggaggcttaggagggtgggaagaggtgggttattcagtgtgttcttgacctcctaccacgtagcaagttctgagaatactgtagagaacaagtcattccggtggtagaaattagatcatttcagactaagagccttgggggtggggagggagcaggatgatgtaatagagagaaagcagtgagtgtaaggaacttgagcttttacagtaggaaggccccaaaagccttctcccccagctccccttcccttaaaaaaaaaaactactgatgtggaaagtggcatctatgggaaggttatctcctaactggcagagcaaggtcacgcagtgagtcagcctctgcgctcactctccagactcttctaaacaaatctcaaggatctgttgggaagggaaaggccatttcagaggggcagcagccagtagagaggggacagagggagcttctccaacgctgctccaagattttttttttttttttttttgagaccaagttgcactctgtcatctaggctaaagtgcagtggcgcgatttcagctcactgcaacctctgcctcccgggttcaagtgattctcctgcctcagccccctgagtagctgggattacaggcgcccgccaccgtggctggctaatttttctatttttagaagagacagggtttcaccatgttgcccacgctcgtctcgaactcctgacctcaagtgattcacccgcctcagcctcccaaagtgctgggattgcaggtgcgagtcactgcgcccggccccaaggcctttccttgatgttgagtactggttactgatgcaggcccccagagcaagaccttgtggggtcctatcctagctccataaccttcagcaagttattcctttggcttccctcttctcatctgtgacctggacatattagtgtcttattagagttgttgtgggatttaaatgaggccatgtgggctgggcacggtgtctcacatgtttaatcccagcactttgggaggctgaggcaggagcataatttgaaaccagtatggtcaacatagaccctgtctctacaaaaaaaaaaaaaaaaagaaagaaagaaaagccgggcacagtggcatgcacctgtcttcccagctacttggaaggctgaggcaggaggatcacttgaaactgggagatcaaggctgcagtgagccatggtgtcaccactgcactgcagcctgggcaacagaatgaggccctgcctcagcaataacgtgatgctgtttcctctttggtgtacttctgacatttcaggactctgccccggaggcctttttcccatccttgacttcacccctggcagttctctttaccctcccaggtttctgggcccaggatggtgttcatcaggcctggtcccctccgttctgcagagcgacagatgccccttgctcccggtgcctgagcagagagatgattcttctaagagagttcagacggcccacgtggagctagccaggagagttaaatgagtggctgcagatagtatttgggagactggcaggtggttctcattgtatttctggttgatgatgcattgtaaatcataaaaatggatcctgccaaggccaggaggcagatgccaaggatgcagctatcagctgttggcagaggggaaattgggaggcaacttctttgggacccaataaatgtttctgaaattgttagcaaagcttgatttactcttcagtttgtacttgacttgtctggccaacttgctctagaagcttctctcctattagcaacttttgagtaaggaacaatggctcttaatttttggtgggtattaaagaataaatcataagtgttagaagtattagtttcttttaaaaactaacttcgtgggctgggcgcggtggctcacgcctgcaatcccagcactttgggaggctgaggtgggcggatcacgaggtcaggagatcgagaccatactggctaacaaggtgaaaccccgtctctactaaaaatacaaaaaaattagcctggagtggtggtgggcgcccgtagtcccagctactcgggaggctgaggcaggagaatggtgtgaacccaggaggcggagcttgcagtgagctgagatcgctccactgcgctctagcctgggcgacagagcaagactctgtcttaaaaaaaaattgcttccctcctttgttcaggtgtgctctgctctcgccattgttccatctgcgaggagcaccctttcttcagaaagtaaaattgtcttgctaagaaaactttttgtccaaatgctaatttttccttacagtacagaggtacaagcgttctgtctctaaacaaacattttacttataacagtgggtcacacaccctcctgtcagatgttactgacttttttttttctgggaacagaaaaaaaaaaaattatgtatctatagtgtcaggaatttctggaccacaagttaagagcctgtgttagggagtgagtcaaaacactggctctcaaaggatggttgtggaccagcagcatcggcatcatgtgatgctcttttgtttgaaatgcagatttttggacccaccctagaactgaatcaaaaactccaagggtggggcccagcagtgagctgcttaaagtccttcaggtcatcctggtgcctgcaaaagtttgagggccattactatatatatatatatatatatatatatatatatatatatatatattttaactttattatataataaagaattaaaaacttcaaaaagaaaatagagatggggtctcactgtgttacccaggctggtctcaaactcctgggctcaagcgatcctcccacctcagccccgcaaagtgctgggattacaggcatgagctaccattaccaggctagccaggccattacctttaatcagggtctgtccagtgaattaacaaaggcttgaaagaaatcaggtgagctccttgcgccttcaaatgcttcttagaagacatcattagccctgaacctgccgttgagaatgtgctgtgatcctgggggtcttgatcattaatgaacagcatatgatgtgataaggaagtaactgtcaatgaaaattggaggaaccaggcatggtggctcatggcgaaactccgtctctactaataatacaaaaattagcgagtgcagtggcgtgtgcttgtaaccccagctatgtggtaggatgagttggaagaatcgcttgaacctgggaggtgggaggttgcagtgagccgagattgcaccagtgcactccagcctgggtggcagagtgaaactttcttttttttttttttttttttttttttttttttnnnnnnnnnnnnnnnnnnnnnnnnnnnnnnnnnnnnnnnnnnnnnnnnnnnnnnnagagtctcgctcagtcacccaggctagagtgcagcggcttgatctctgctcactgcaagctccgcctcctggattcacgccattctcctgcctcagcctcccgagtagctgggactacaggtgcccgccaccacgcccggctaatttttgtatttttagtagagacggggtttcaccgtgttagccaggatggtctcgatctcctgaccttgtgatctgcccgcctcggcctcccaaagtgctgggattacaggcgtgagccaccgcgcccagcctgaaactttattaaaaaaaaaaaaaaaaggaagttatcaatctctggagtgggtcacatttaaattacttatgtttattctgacattaataaaagcagaatggttttgattttcaaaccaagacagtttgccctggacatcccctttgaagctggatgttaaatcaatttctgggttctgaccattcgtctactttgaatttcctttgggagtggggaaaccgctaagaagaatccagctggtcagttctgctcactgtattcaccaccacagcctcctggcctccagcacttttttttttttttttttttttttgtttaggcgttcccaaaccatgttgattagtatccaggatgcggatcagcatgtccccagagaataatctacacagcgttagagcggctctgctgtcaaaaaatgtcagctacaaaagctaccctgggaggccgggcgtggtagtttacgcctataatcccagcactttgggaggctgaggtgggtggatcacgaggtcaggagttaaagaccatcctggccaagatggtgaaaccccatctctactaaaaatacaaaacaatcagccggacctggtggcgggcgcctgtaatcccagctactcaggaggctgaggcagagaattgcttgatcccgggaggcggaggttgcagtgagctgagatcatgccactgcactccagcctgggtgacagagcgagactccgtctcagaaaaaaaaaaaaaaaagaaaagctaccctgtgctgcgtttggtggctcacgcctataatcccggcattttgggaggctgaggtgggtggatcacctgaggtcaggagttcgagaccaacctggccaatatggtgaaaccccatctctactaaaaataaaaaaattagccaggtgtggtggtgcatgcctgtaatcccagctactcaggaggctgaggcaggagaatcccttgaactcagtgggggtggaggttgcagtgagctgagatcacgccattacattccagccagggcaacagaatgagactctgtctcaaaaaaaaaatctactctgcatttcactttggggtcattgtcatgctaggttaaaaataagaagttggttgagctgctgagaaggaaagttcgtctcgcccagccttatgtcggcgtctttctaaagagagatgacaggtaagtgtgatttttccttcattcccttgttgacggtgccctagagtccagctcaccacaagtcctactctgtactttgcacctttgacccctgaccccgaggaaaccagggaagacctccagaataaaggccagaagccacgcaggctaccttttcagcctgggctgagaactcagcttgtagtactaaacttcatgcattgttaagatacgggggaaattaacttcagggactcttagtgatgaaatgctccatgaggctacctgaaagtcgagctagctgctcggagatgtggctccatgtagaaatgagttccatgggccgggcgtggggtcgcacacctgtaatcccagcactttgggaggctgaggcatgtggatcacctgaggtcaggagttccaaagcagtctggctgacatgatgaaacctcgtctttactaaaaatacaaaacattagccaggcgtggtggcaggtacctgtaatcccagctactcaggaggctgaggaaggagaatcggttgaacctagtaagtggaggttgcagtgagctgagattacaccattgctctccagcctgggcaacaagagcgaaactccatctcaagaaaaaaagagttccatgcatgcattcgaagcaggctctgtgatagcatagaagagactcatcaaagtcccacctggaccatgtctttgtggctgacttagcgaggagccacccacccggtcctgtgaccactggggcagccctggcctggcagaagctcccctaggctctggagctcctgcgggagccaaggaggccgctcttggttttcagtagcatttggtaggggcgtttcttttctctccctcctccatctcagccagagacatcctgcctagcatgaaagccatgttccaacattcctctgtgctcttctcccacagcaatgagtcggatgtggtcgagagcctggatgaaatctaccacacggggacgtttgcccagatccatgagatgcaggaccttggggacaagctgcgcatgatcgtcatgggacacagaaggtgggtggctggcgggggacagtgggaggtgggggcagagtaccacgcgggagaccagccaggatgccttatgccccagcatcagcctctgccctgtccgtcagcccagcggctttctcactagcactgaggccagagctgggggtgagagtgagacatgtcacctctggacccctcctgtctcagaaaggggtgagctgcagggccaggcatggtgactcctgcctggaattccagcactttgggatgtcaaggcaattggatcgcttgagcccggagtttgagtccagcctgggcaacgtagcgagatcccatctctgcaaaaaatgtagaaaaattagctggatgtggtggctcatgcctgtggtcacagctacgcaagaggctgaggtgggaggatcgcttaagcccaggagtttgagaccagcctgggcaacacagcaagaccctgtttctataaaaaataataaaaagttagatgtgacggcgtgttcctgtagtcccagctacttgggaggctgaggcaggaggattgcttgagcccaggaggtaaaggctgcagtgagctatgatcacaccactgcactccagcctgggcaacagagcgagaccctgagttcaggtggtgccaggtgctctgaggggagacgcagacagcgtgagaggtggaggtgggtagcttttgtgaagtgcttggggacagtctttgcgatggtgtccttgaaatcgagacctgaacaacaggaaggagctgctatgagctgagtccagggcacagagtcttggagaccagcctgtgcccggccaggctgacaccgttttcgacaggaggccctggggcttgtcactgcagcttatccacgatacttaggatggggacagtgatgcattggcgtgggatgcagggaatgcctgaatctggctggagtctaaggggtggaggggacactggttgggaggccccgagaaagcggctcacgtctccagcttgaggaccctgtagccaccctgtggctccagaggtctgggctcagcgggacccttggaccacctgtgccaccagggaggcctcagccgggtccagctcccagcctcagcggctgattcacacctgccttgctcccgtgtcagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagtgagtccgtgcgtcacgcagggcggccacagctgcctcccccacgggctcccttgagccgttcctgcggcctctccgaagagtcatctcccaccctgagccccttaggaagggtctggcctgtctggaactcaattctaatggaacatagagggtgcttttcctcccagaggtcttcggaagactctgggatgggagaggcacaggaaattcgctggagcctgtagctgctcaggaaggagacagggttggaacccaggtccagccccagcccgtgtcccctgtgccaaagcctccagcggttaccaagacaccttccagccctggcttcttcccaccaagcctgggaggttggtaccagtggttgcaggacaggaaacagcctgttggccaccctgatcccccaacctaggccgtcctgcctgcctggtggcacaaggagtcagcttccgaggtgggcaggctcttggcggtgccacctgccctcccgctgtagggacagtcagcgaagctaaccaaaggcctgaagcgtgtcagctccttacctgtgtgcctggtgtcatcagcctcttccccaggctgctgcagggcctagggggaagtgctgtgagcaactggtgatgtctgctgtgggcgctggcaggggtggaaagtcctgtccacaggcccacctgggttcttgaggtcagcacttctatcctgccccactacccctgcgaggtttttttttttctttctttttttgagacagagtctggctctgtcaacccaggctggagtgcaatggaacgatctcagctcactgcaatttccacctcccaggttcaagtgattctcatgcctcagcctcccaagtaactgggattgcaggcacgtgccaccacacacggctaatttttgtatttttagtagagacgaggttttaccatgttggccgggctagtctcaaactcctgacctcgggtgatccgcccacctcagcctcccaaaatgctgggattatagtcgtgagccactgtgcccggccacctgtgagtattgagcacttgaagtagagctgctgtggccaaggaacagaatggaacattttattggctgggtacagtgtctcatgcctgtcatcccaacacttttggaggccaaggaaggaggatcacttgagccctggagttcaaaaccagcctgggcaatattgagacccctgtctccacaaaaaaaataaaatccctgggcatggtcgcacacaccagtggtctaacctgtgggaggatcgcttgagcccaggagattgaggctgcagtgagctgtgatcgcatcactgcactccagcctgggcaacagagtgagaccctgtatctaaaaattaaaataaaaaaattcaggccgggcacggtggggctcacgcctgtaatcccagcactttgggaggccgaggtgggcggatcacctgaggtcaggagtttgagaccagcctgaccaacatggagaaaccccgtgtctactaaaaatacaaaaaaaaattagccaggtgtggtggcttatgcctgtaatcccagctactcgggattactgaggcgggagaattgcttgaacctgggaggcagaggttgcggtgagccgagattgcactattgcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagtccaccagggactgcactcctccatctcccaggccgtccgtggccagggccagttggcggaggggagggagttgatggagctggtgggtggggctcccagggccatgctcccacccagcccaccccctgctggagcactgctgggccccagcgaccctgccccatacttggcaggccctgactgcagagatcgtgaagaccatccgggacatcattgccttgaaccctctctacaggtgggcctctgtgcgggcagctggccaggcgggggcatctctgcagctctttctgcagctgggtgggtagggggcttcctcagcgtcctcctgggaggaaaccttgcctgccccaaggagtggcctgtgtggaggagcccgttgcccactggggcatggggcaggtgggaggcccggggccgactcagcaggcccagtttctttgtccccttctgctgaggccggaagctgttggtggcattggctgggggagtggggagcagactgctgaggtgaggtcactgcacggctcccgtggtggctgcacgtgaggatgctgcatgcctttccagcccaggacgggtgggccctgaactctggagaacaagcagcagagctggctcccagcgagcacccctagaccgtgcccatagctacaggggacagggaccctgaggaccgggtccccgtttgggggctgcactgcagcagagcgtgaggccctggccaccgaggcagctccctttgtcccccagggagtcagtgctgcagatgatgcaggctggccagcgggtggtggacaaccccatctacctgagcgacatgggcgccgcgctcaccggggccgagtcccatgagctgcaggacgtcctggaagagaccaatgtgagtgctcgtcacctccacagccccccacgcctggctgcaccccacctccactatgctccgcccacgcccggctgcccccgttcctcctcagctcccccatgcctggctgcccttgtccctccaccgtgcaccatccacacccagctgtgtgtccctggctctgtttttgagatgatttcccgctgcgtgtcttggtccacatccatccgcctttcggtggcttcatagccttcggttgggagtcaccgttgcgggttcagtgggatcctctgggccgtgtacccggggcgttgccagtcttttgctgttgtgagcagcactcctgagcgcgtccccatgcacgcagctggagggcctgtgaagtatccgtaggatgcgtttccagcacgggatttgttggggcagagggcacacatgcctctgtgctgggtacagcatggccaggtcctcccggcagcatctctcagggtgcgcattttcccccaacctcggccctacacgcacagatgccgacttctgctcatcctttctgtcctccctgtctcggcagattcctaagcggctgtacaaggccctctccctgctgaagaaggaatttgaactgagcaagctgcagcagcgcctggggcgggaggtgagcccgcggctgaggcgcagccactcttgggggccttcccctcgggccacgtgacatcagtcaggctctggagcacacggagggaccggtggcatcggccagggcaagccaagaaggcctgtctgggttttgagggcttcgtgccatcatctgctctgtcgtcctgggctgtggaactctccgcgttgaacagggaagcttaaagctggtcccagtgtaatgagcccagggtggagcagtctcaggaccgtccaacattaagggaagaattcctttgcctttgtaatcttggggacagtgttggaaattggaaagcagcctgggaaaagtgaagatgctgtttcttaagacccagccattgaggctcgctgtcatgattttcggcagatcacagcctgcctgatggccggtcacctcacggtcgtagcatttttcagaattttttactttaagacagggtctcagtcggccacctaggctggagtgcaatggcgcaatctcagctcactacagcctccacctccagggctcaagtgatcctcccacctcagcctcccgagtagctgggattacaggcgtgcaataccacaccggctaatttttgtattttagtagagacagggtttcaccatgttggccaggctggtcttgaactcctggcctcaagtgatccgcccgcttcagcctcccaaagtgctaggattacaggcgtgagccaccgcgcctggccccatctctacaaaaaattttaaaattagagccaggtgtggcaggtgcctgtggtcccagttactcaggaggctaaggcaggaggatcgcttgagcccaggaggtggaggctacggtgagctatgatggtgcctttgcactccagcctgggtaacacaggtagaccctgtctcaaaaacaaaagaagatggaaggaaccaaaggcttcgtgctctgggtttcgtttcttttctctctgagtcctgggggagcagagggtcccccttcgtctggggacgcacccacccacccagcttcccggagccagggcctgatggcagcacctcaccccacaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaagtgagtgccaggcccggggcggcccagccctcaggtgacccctcctcagcccccatcttaggcaggccaggggacccagcggggagccccgtggcaccttcttggtgtggcaggtgcgggctgggaggcatccagtgagtatcagccctgttctgggcaggacacgtcatcaccatctccattctacaaggaaatcgaggctcggggctgttgagctggtggccagggcctgtgaattggcaggtggtgccacggatttgagcccagggacgcctggctctaagccagggctgctttttttttttttttttttgaaatggagtctcgctcagttgtccagactggagtgcagtggcacaatcttggctcactgcaacttccgctttgcgggttcaagcaattctcctgcttcagtcccccaagtatctgggactataggcatgcaccaccacgcctggttaattttttgtatttttaggagacatggggtttcaccatgttgttcaggctggtctcgaactcctgacctcaaatgatccggctgccttgacctgccaaagtgctaggattacaggcgcgagccaccatgcctggcttttttttttttttaagacagagtcttgctctgttgtccaggctggagtacagtggtgcaatgttggttcactgcaacctccacctcccaggttgaaacgattctactgcctcaacttcctgagtagctgggattacaggcatgtgccaccacacccagctaatttttagtatttttagtagagatggggttttgccatgttggccaggttggtctcaaactcctgacctcaagggatccgcccaccttgccctcccaaagtgctgggattacaggcatgagccaccacgcctggcctaagccaggccttctcgccaggaccaggagtccccatggctgtctttgcaaggctacccctggcttctgttgccccttcgagagtcagccaggaagtgaccatgccttcccgcagcactggccttgcccgggggccactgtcctgagcatgccatgagtcagggtggccgccccaggtttgagggcctcaggtacctctgagatcctttcagccatgcccatgtccagccaggacagaacccacctggccacttcccatgcagcatgctctgttttcagcccaggaaccagttgtcacgccagggcagcttctaggcagaagtccccggggcagggctgggcaggccgtaggacagcgcttagagggaaggcatgagtttctttcctggctgctggcccaggaccccgcctcagatttgaatgtcacggtcgccggagtctctcccccagggccctgagaggcactggttgcgcgcgaaggctgtggcttcccctcccagcacgccccgatttcggtgagtggcctgtgagctcccatggctgctccgacggtgccacaacttagtgccttacacaatgccgagccctgagatcccgctgtgggccgggcccgtccctcccagaggctccagaggagaatccgtttcctgcctttcccagtatctggaggcgcccgcatccctcggctcggggccccttcctccttcacagccacagcgcagcctcttccagtcagtctctcacctcccaccgcctgtcgtgaggacctggtgaggaacctgggccccctgggtcacccagaatgctctcctgtctcggggaccttcactcagccccatctgcagttccctgctgccatgtgagaggcctgtgccgccgcctcctgtggggggagaacgtagatgttttcggggttcttctgtctcccagcgagtgcctcagctgcccttgggctggtggaagtacctgctcagaccgggccttgtcctgcagaagcagatagctccttcccccaggagctgagggggtctgtaaggcgggttctgtcctcaggtcctgggaagtcacgggggacaagccctcagtacctgcgtgtcaccaagatgcctgcagcaggctgccagctacctctcccacccagaatgctctccgcaaagtgtcactgcctgtgtcacttccacagtgacttcatgtgtctctaaactccagcatccgtgtggcccagctggcctgtcccggtgcgtctcgtatgcccgttgggtggcagtgcgccctgacggtgtctgctcgtggggccgcctggcccttcctcggaagccgtcctcctcttcatcctcttccccaatcctgccgtgtgctcttgcagccctcactgacttgctcctggcccatagtggccgctgctcactgctgcacggctcccaacttggggaccaatatggagttgccctcccaaccttcagcgtcactctcccggcaggggacctggcctccatttccccacctgccctgggtcaggccttgtcccattttctaagcctcgtcccctctgtggttctgctcactcagccctgggcagaagccagtgccgtcttggctctcctgatgagtcagcagtggacctccggccatctcctccttcctgcactgggtgctttggacagggcagtttgtaaatttttttttttttttttttttgagatggagtctcactctgttgcccaggctggagtgcagtggcacgatctcggctcactgcaagctccgcctctcgggttcatgccattctcctgcctcagcctcccgagtagctggaactacaggtgtccgctgccacgcccagctaatttttttttttttttttattgatcattcttgggtgtttctcgcagagggggatttggcagggtcataggacaatagtggagggagggtcagcagataaacaagtgaacaagggtctctggttttcctaggcagaggaccctgcggccttccgcagtgtttgtgtccctgggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggccgggcagagacgctcctcaccttccagactgggcagccaggcagaggggctcctcacatcccagacgatgggcggccaggcagagacgctcctcacttcccagacagggtggcggccgggcagaggctgcaatctcggcactttgggaggctaaggcaggcggctgggaggtggaggttgtagcgagccgagatcacgccactgcactccagcctgggcaccattgagcactgagtgaacgagactccgtctgcaatcccggcacctcgggaggccgaggccggcggaccactcgcggttaggacctggagaccagcccggccaacacagtgaaaccccgtctccaccaaaaaaataggaaaaccagtcaggcgtggcggcgcgcgcctgcaatcgcaggcactcggcaggctcaggcaggagaaccaggcagggaggttgcagtgagccaagatggcagcacacagtccagcctcggctcggcatcagagggagaccatggaaagagggaaaggggagaccgtggaaaggggagaggcagagggcagaggcagaggcagaagcattttttgtatttttagtagagacagggtttcaccgtgctagccaggatggtctcgatctcctgaccttgtgatccgcctgcctcggcctcccaaaattctgggattacaggcgtgagccactgtgcctggcctgtaaattgttttatagagatggggtcttgctgagttgctcaggctggtcttgaactcctgggctcaagtgatcctcccacctgggcctcccaaagagctgggattacaggcgtgagccaccgcgctcagccccacacatgggtttcaagccccttgcaaccacccagccaagtccagcagagagacaggcagctcgtgagctccactcagcatctctccatctgtcccctggcagtgtcacccgcaactacctagactggctcacgtccatcccttggggcaagtacagcaacgagaacctggacctggcgcgggcacaggcagtgctggaggaagaccactacggcatggaggacgtcaagaaacgcatcctggtgagcccagtgtctggcctgttgtggatttgcatgtgggtgcccgggcccaggactcttgtgtgctgtgggttgagatttcaaaggagccccctggtgaattcgtaggcctgggggtgctggtcggggggatcccggcggaggtagcatcctgccctgcccccgagggctcgaggatttcccaggtggactgaagtcatgcctgacgggccgggcatggtggggctgcttgtagtcccagttactcaggaggctgaggcgggaggatcacttgagcccaggaagttgaggctgtggtgagctgtgatcatgccactgcacatcaggttgggtgacagagtgagacccccatctctacaaaaaattttaaaattgcggctgggcgctgtggctcatgcctgtaatcccagcactttgggaggctgaggcatgcagatcacctgaggtcgggagttgaagaccagcctgaccaacatggagaaaccccatctatactaaaaatacaaaattagttaggcgtggtggcgcatgcctgtaatcccagctacttgggaggctgaggcaggagaatcgcttgaacccaggagccagaggttgcagtgagcccagatcgtgccattgcactccagcctgggcaacaagagtgaaactccgtctcaaaaaggaaaaaaaattttttttaattagcctggtgtgatgttgcgtgtctgcagtcccagctacttgggaggctgaggtgggaggactgcttgagcccgggaggtggaggctgcagtgagctgtgatgcaccactacactccagcctgggtgacagagcgagaccttgtctgaaaattaattaattttaaattaatttttaaaatatcactcctgagacattggaaaccaggcaggcaggtgggagtcaaaggttaaaaaacaggagtcagagcctgggcatggtggctcacacctgtaatcccagcacttggggaggccgaggcgggtggatcacaaggtcaggagttcgagaccagcctgaccaacatggtgaaacctcgcctctactaaaaatacaaaaaaagtagccaggcatggtgactcacacctgtaattccagctactcaggaggctgaggcaggagaattgcttgaacccaggaggctgaggttgcagtgagatgagatcgcaccagtacactctagcctgggccacagagcaagactccatctcaaaaaaaaaaaaaaaaaaaacaggagccagaggcattggtggactgcttctctgggttggaccggagagagtggagcatttgcggtcttcagggtcccgggaactgctgaacgggcctggcactgccgggtggccgcggtctcctagcacctagttgtcctttggtgttaaattgttaaatggagcccttgtcacaggctgcccctccccgtggccagtggcagctctgatgtgctcagcctcccggacaatcctggtcccttctcgcagccctcagacgtctgaaaggcagtgtgcaggtggcgagagtcatgcgcgggtccccggcttccccagctcacgtgcccactgaacctgcctctgtctgcaggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggtaggcctggcctgacagctctccccacgcactcccctcagctgtgctgccgggcttcgtcttctccggtcaccctttaacatctggtagagcaatccgggttgtgggcaaccgattccactcatgctggagtaactgaaaagtccagccatgtggcggacttcaggcccagctgattccaggtgctcaaacagcgctggcaggaacctccatggcttgacccctgggagagagacttctcgggccggccctcagcagacacccccggtagttccagcataggacctgcaatgcccgggccagagctgcagggccggcgtttgccgtgcagatgctggtctatgtgggctgtggctgatgccccaggactaggggtggggtcggctccaccccccaccccgaagcctgtgggctggagtcaggagagacggtctccagtgaggaccgggccgcgcacaccagagaaacctcggcgcctctgtgggctcactcgtcccggccagcctcaggcccagaagcaggggccacggccctcagagttcagcgccctcccacctgaccctttgggtgggcagccgggcgcggcttttctggggcttccctcctcgccagcctctgtagacagcggttctttggaaaccgtagcctcagtgagagccgagtgtgaggcatctgctgagtccaccacgtgtttccatcctgcaaggcattcacttgagtccaggtttaaagtgaacatttctgccttctctaaaaacatccccagctcccgacctcccggctcaggccttcctagcatctgcccgcccgctgcaagggtgacagcatgctggcccgcgcagtgtccagtccccagggggcggccactctgaccagccgggagttgggaggagctggaggaggtggggccagtgcagctttggggagtcccagattgactagggggtggggggtgtgagggggaggacaggggacctgttctgcaggcccttggttgggctggggtctgagcaggaaggagcagctgggtgaaggtggaggggtgggggtggggggcacccattccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttctctccccccctcctccctctgcctcagcctcatggcctcctcactgttcttctaacacaccaggcgtggtcctgtttcagggcctttgcacgggctgtgtcctgggcctggaacacatctctcagaccctcacgtggctctctcctcacgtgcgttgctcggggcctctccctaagacactccttacccccctgcacacttaaagtgtcacacacatcccagtggcatctcagtccctccatccctgcctccctgtgtcttcatcccacagacagagccttcctcactgtctctcgtggggcctgggattcttctgtccctgtcgcgggccgggcccctgtgctggggcagagcacagagcttgcaggaagccctcctgagagccagtgctggccatggctagtatcaccccagcccttgagggctgaggcgtgcctggcgtccctcagtgaggagtgggggccttctgctgccagcgcctgtctggctttcaccatggtgtcagctgagggatgggactgagggagatctggctttgaatcagtgaccccagaatctgagctggtgagtcagggcaagtgaccagcgtgcctgcaggtgccacacatccggcggctgccagcatttccgcctcccacatcatggccacatcttgtggggctccaggtggcctctcccctgtggccctggagggtgcatggtgtcgttgtggccgagccaggctaccaagtgacctctgaccccgctgtgcacccacaggcggacctacgtgggcgccatgcccgggaagatcatccagtgtttgaagaagaccaagacggagaaccccctgatcctcatcgacgaggtgcgtgcggagaggcccggagaccccctaacccggcaatgccgtgtgcaagatgaagccgagccttccgggtcctaggatccccgagccaactcaggggccatcgccgtgatgctggccctgatggcacggacgggtccctcccacccacagccacgcccagcaggctgcccgtccaaggcagggtgtgggtgccgctctcactcggggtctccccagccctgaccctggggtctccccactgggcgggctggccaggggcacggcgaggggcaccacctgctgtctgctgccccaggtggacaagatcggccgaggctaccagggggacccgtcgtcggcactgctggagctgctggacccagagcagaatgccaacttcctggaccactacctggacgtgcccgtggacttgtccaaggtggggggcctgtctggggcctgggcttgctggggagggtaagcggccagtcccccagcaccttgccgccgcccccaggtgctgttcatctgcacggccaacgtcacggacaccatccccgagccgctgcgagaccgtatggagatgatcaacgtgtcgggctacgtggcccaggagaagctggccattgcggaggtaagcccagcccctccccactgctgtccccttcccagagcagggggcgccccccagagcctgcagaggccgtgcctctgggagctcctgggcccgggagagacaggtgggacctgcggccgaggagcagatggggccgtgagagacacaccagacgcttgcgagcagctgcaggtggcgcgagtgggcgcagggtttagggcctgggactgtccaaaacaccgcccaccaccgtcaggccacacactctgtctcccggggcctccaggctgccccatggtggggcccccacctggcccagagtgtagggaaggtttctggcagccggaagcagtggggcctgtggctcccacccagaatgaggcttggaggagaagtggtttcagtgaggagcatgcaggggcccatatttctcatgtgtttttttttctgcaaaggtgctgagtgcatttctcccctaggagccctttgacagccagtggtgggcactggtccctgcccttgaggccctcccagcatcctcgtgtcccctgggggcttcaatgcccactgctgggcccagttcccagcctgacttctccaagggacgggcctgtagttcctggggacaggactggggggcatggggacccctcagggcatcaggagtgccccccagtatcagtggcagatgtagagtggcttgcatggctctgtccgtctcacagatgccctcccccatgccattagagctcagaactgtggcaagaattgtgtggggctgtgggtgaccctggagcccctgacccagtccccttcctcatgtgctgagggcagcagccacgtaaccagtcagccaccctacaggccctgggtctgtgtatggggccagcccatggggcaaccaggaggccttcctggaggaagcggcatctaagataccattgggggataggaagtggatccaagcagaggacgcagcacaagcaaaggcctggggcctctgggcatggtgggtggcagggcggggtgtccaggccctggtttcaccatcagggacctcgttcccaggccagggtctgggggccatgggagaggcattggctcccaggttctagactgagctggtgggcaaggtccctccagacccaaccctgacggttgcccttgcagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgagcggccagcccgccctcctggcacctgccgcccacctcaccatcccacgctgatcaccccacctttccatgcccatcatcccactttcctgcgcccatcaccccaccaccccgcgcccgtcacacctttctgtgcccgtcaccccaccaccccgcacctgtcaccccaccttcccgtgcccattgtgttgccctgaccgcccaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggtgagcgtggtggcgggagaagaccccaaagccattcccatttctacccgagaacaagcaggtcccaccttgtacacctgtgcagtgggcctcaggtggctctgaacggcctctggcggggggtggtgtgctgggagcccagggggtctgggctgagggaggggaaggctgtgacacatgggggtggcagcacaccatgggccttatggatttgggtgccactttgataggcttacaggtaaggacaagctcatccagatgggccttggggccaccacgcacaaaggaggcgagagggcaaaggggatggtgcgggaggggctggagaagggcttgtgtctgtctgcagggcagcggcagctgggccttgtagccctgggcgtgtcctctgtggctggcagctgctgggggctgccctgtggggcgtacagagccaggaacccgcaacgcagcaaacgtagaggccagcgttggctcacgatgggacaccaacccctgcccaggggcaccaagatgctaaactggggcaggagcggtcagagtggccccgaggggtggagtgagcaccggcctgggctccgaggcctcccgtgttcacagctccacacctgtttcaggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgaggtgaccgcgccatccgctcccacctgctcccgcccagtccctgggctgctggccacctgctcacccactatccccacatgcctccacagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggtgagtgtccctgtacccaccccacagcactggcagggcccacaccaccacgggacaggcccagtccccgccatgcaacctctgcctgggccaaggagagggaagccctgggctttggaagcaggtctctctggcctggagctggccttaagctcaccgccctagctgccttctccacagcaagtcttgtggagaacattctgagcctccactggcttccccagtaggattgggggggtggctcctgcttctcttcccaggcagcccagcgccaagggagaggctagagatggggacgacgtttaggattactggtggcgggggtgtttggagcccctggccaggggctggcctcttccaagggtgctgagcaggttggagcgccactgtccccactcttccctcccatccctgcctgtccccagactggaccacacttgccatgtgtctaggaagcctggtgcagtcagtcaggagatgccaccacgagggaggcatggtcaagtggctgtgaccaccttgaattggacaccaggcacagacttcctagatgataaaatggtggaggcaaattgggaggctcactgtccatggagtcagtgtgcggtgacagtgggaactgctgtcctttcaaggggctgtggtggggctgtgcctggcatctactccagatatgtgtagcctccggaggtgaggggggtgacgcagggcctgggggcagagatgcagatgctcacaggaaccctgttcaggccccagacactgcctgacctctggatgtgaggccgtgggtgtgtggctcatccagagccctgagactgctcccaccgcacggccagacttcctagataagggggtggggaggccctggctcctgctctcaggctgttggagccaaggccagtggttttgccttgagcctgtttccccgtgggagacggggaccctggtgggttttgggacttactgcttagaacccggcatcactgtgtatcgccggtccccaggaagccctttcgttcctggaggttagcacacctgctgccctcccacaggcccaggcagggctgaccctgactctgcccccaggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatgtgcgtccccacctgccagggacgaggccgccgtcagcccggccctgactcccatcccaccccgcccctcggccggcagcgcccacctacccttttcttgataaatttgagggcccgtttgtccttggagaccttcagtaactccatggcgcgccgctcgtacggggcaaagccacacacctcccgaatcatgtcccgcacgaacttggtgtgtttggtcagacgctaggggggaaaggggcggccgtcagggtagggggatccctgcattctagttaagcagcttctctcgcgctgccgcgatttccctggctacttcctcccctctgtgggtagctgtgagaaccaaggtattaacgcctagcgcttttcgccgcgcccggagcagctcccatcctccctaagtcccagtctccgcaacactggcaggacgcacctggagtctgggctgcctgctgaataaaggcgcccaatacactgacacacctgaaatccctcaacctcacacaccgcaacctcgggccagctccatgagcgaactccttactcctgcgtcagaaccccaaacccgctgcccgcttaataaaggcgcccaatacactgacacacctgaaatccctcaacctcacacaccgcaacctcgggccagctccatgagcgaactcctactcctgcgtcagaaccccaaacccgctgccccgcgccgctctcaaggtgctccctctgccccagcgtggattgcacggttgggaaaaacccagatgggtgcccgccttcgagcaccaggcaggaagtcccactcccccaccccatctcttccattcaagccccccttagttctgcgcccgaacgcgcgttctttcaggtcgagagcctttgcccaagccatgccctccgccctccaagaaacccccgacaacctccgcgcggcacccgcactcaccccgcggcgtcggctgtgcctgggcttgctcacgttcttggtcactttgtggcccttgttgaggcccacggccatagggtagcgtagggccatggctgcggacagcgacggggagaaggggcggaggtgagtaccggctcagttcccgaggcccagagccccgcgtcccggctccttcagcctcgctcgccacaaccaaccatcctccaacctgcacagaggacccgggagtccggatggcggcggataccggcagtgcgggaaaccacttacctgctgctctccagagacggccgtggcggaagggctggcgccgcgcggaactccgggatatctactcggctcaggaggcgcaggccagagaggcaagaacggcacgcgctccccctggcggctggagtcttccccgccgttgcgctgagcatgcgcgaccgagctccctgagcatgcgcgtttactcctgcgagcccgggagctggagtcggaaccagtggaggtggctatggctgctctcctccctctgcctgtgaaatgagttcga

SEQ ID NO: 713 - DNA, 22184 bp, Human
cctcgttctttggctagaaaagcatagttttgctagaacttgttctgttgggactttttcttgtttgtgccccttggcattttcagttgttggcttctccagtattcagcctgagatatatgaggcaaagagaaatcccagggaattcaccaccattccttaagtcccgaggttcctaaccagtctgcttctctccatctttcagtcttcttatgcttgtcttgtcacgttcaaggttttcagttatacttggcagaataaataaatacatctactccatctttccagaacatcactgctttttgttcattttatttatttattatttactgagacaaggtcttactttgttgcctgggctggagtgcagtggtgctatcatggctgactgaagccttgaactcccaggctcaagcgatcctcctgcctcagcctcccaagtagtttggaccacaggcatgggccaccatgcccagctacttttcattttttgcttttgttgactagccccacagagttttgctgtgttgttcaggttggtctcaaacttctggccttaagcaatcctcttgccttgctctcccaaagcgtattacaggcgtaagtcaccacacccagccctatcggtgcttttggaagaaggtgttcttccctctctctgtttccctccctatggccagctgcccatagagggcagtggtgctggagtgaagacctctcagcgcatccctcttcatctgtaggatgtgcatggcttccaatgctgtctgttctgctcctgagacactcgctggctacaggattataaaggtgatgaggtttcagcctaaagactctccattcaataacacttcctacaagatatcttttttgtttttttgtttttttgagacaggatctggctctgtcacccaggctggagtgccacagcgcgatctgctcactgcaacctcagcctctcgggcttaagtgattctcctgccttagcctcctgagtagctgggaccacaggcgcccgccaccacacccagctaatttttggattttttttttttttttttttagtagagatggggttttaccatgttgcccaagctggtcttgaactcctgagctcaggcaatccacccgccttggccacccaaagcgctaggattacaggcatgagccaccatgcccagtcctacaagatatcttttctttttcttcctttctttctttctttctttttttttttttgagacagagtctcactctgtcacccaggctggactgcagtggtgtgatctcttctcactgcagcctccgcctcctgggctcaagtgattctcctgcctcagccccctgagtagctgggactacaggcgcctgccaaaacacttagctaattttttgtatttttagtagagacggaatttcaccatgttcgccaggctggtctcgaattcctgacctcaagtgatccacccgcctcagcctcccaaagtgttgggattccaggcatgagccaccgcacccggccgagatatctttttcctcctcaatatctatgtgctcctccctcaacccttgggggcttcagtgtaggtggtcagattccccaccatttatgcctatgatgaaaagagtggaaatggtaataactggatggtgtcactaaactacaaatactttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttactgtacttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttctacttcccgggttcaagcaattctcctgcctcagcctcatgagtatctgggattacaggtgtacgccaccacgcctggctaattttttgcattttgagtaaagatggggttttgccatgttggccaggctggtcttgaactcctgacctcaagtgatctgcctgccttggcatcccaaagtattgggattacaggtgtgagccactgcgcctggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtaccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcggagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctcggatgtcccatctgaccctcagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattgggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacatctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggatgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgcttggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactccagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttacgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacacgccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcggcctcccaaagtgctgaaattacaagcgtgagccaccatgcccggcctcaggaccccatttgacagacgtgtaaactgagacctgcagcccatgcccgtgcgcctctcagcagccgtctggcttcagcgctgtgccctgaacccctgcaccaaaccacagccaggccagagagccagggcagggtttctgttctcacacagatgcaggaaggacgcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttccttccttcctttcttttcctcctcctcttcttcccctcctcctcctcttcctcctccttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttcccaaagccctgggattagagccatgagccactgtgcctctccctgtttcctctcatgctcctctctggccctgtctgctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttaaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaagatctcatctctacaaaaaataccaaaaaaaattttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctgtaatcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccattgtcaccctcttcctctgcacccctgcacgcatgcaggggagaaggacgagtctggctgcagagagaagtccaggatgccttccaggcaaaggctgccagggagagctggcccctcagttgattaaggtctctcctttctccacccagatagcccggagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgcctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggtcaggagttcgagaccagcgtagccaacatggtgaaaccctgtctctacaaaaaatattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgagactctgcctcaaaaaaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaagacccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagagctcgtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccaattcttgcacaacccatagctgccagagaaagtcttgaagaccagccaccctgagaaacctcacagcttttctgtcattcgaggtcctctgcacccgttctctaattctgttcactgattcagactttccagttaggtgccccagctcccctctccgcttctcgggtttgatctttctccacccattcacctgcttctgcaaaggggctaaagcccattctccttagagggcaggggtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattctcgtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgagcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcaagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacacctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcagaga

SEQ ID NO: 714 - DNA, 70313 bp, Human
gctgaaagcactaagctggtgctctccaagccttggtatcctcacctgtaaagttagaactggaatcagaatcgatgtttctcagtggaagtgctgttggcattcaggggtggaggggtggatgtcagtggatgtgctctgggcatttgggcatggaggtgggaatgctcggtagaatggttagcaaatccggccctacccattaaataccagtaatgactcccagtcaaataaggtgaggagggcagtaccatctccagataaggaccacgggccttgttttcttagatttcttcccaatctgaaattctgtaagtctatggttgttttgttcctggacccagtaaaaacatgcagaacagaattaccgaagatctgacaaattatcagaatcttgagtacatcttattcaaatgtaagggaatgtttaactaaacagcaacaataggtaacatctgttaagcaattactatgttctagacccttggcaaatttccttcattagaagtctttacaggcgatctgattgtttactatttcagatcatctgtgtcccctaatttgcccccttaatttcagagcattgagttgactatcgtttttgcttcatttatctttgcagagttgtgcgaagttcagatagcaaagtgtctctataggaggccctgcgatatgagaataaagcagcagtctgccaagttcatgcctttgtgttggatacagtcttctttctttgtgtgtctgtggtctttatgaacttagaaaacctgccagtctcttagacgctatgatattaccttacttcagagatctgaatttacatgtctagttttgcagggtttttcctccccacttagttcctatacctgtaatttgagtcaacagccaccagagggcagggacagtgaagtttagatttgacccattgctttgaagagcgaggtcacattgtcagaaagaatacagctcaccatgccagttttgatatagcactgggaactctgcaccctggtttctgggcaaagagagtccttttattataggtggcaacattatttccttgtaatttggtacatgggcttcttcaacttacgtggaaagcaagagatacaaatgtcattacatcttagtccctgtgaaagcctcttaaaatgttcaaagacatttgtaaaagaaggaagaaaaggaacccaagtgcaaaaacacgagtatcgatcctttgttttctgtctgcaactcattgctttctactctcacccttcctagctagcgctgatgtgtgtgtttggagagcataaaacaaattaattttccgaaggtcagaagggataattctccaccgtaatttgcacatgttaaacttgggggagcaggcactgacataagaggcacagcatctgatggtcttatcaaatcaatccatcttctgtctcttccaggggagtgctacgcacagcaggagggtggctgggcagtgcaaagccccggaatcccctgagcaagcagtgtttcagctggctggacagatcaaataacacttgggctggttaacaaaagacgcaagtgggaaggtgttggaagccggagtgtggaaatttacccaacgttatttctttgacagggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacgtggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaaggtatgtctggctggaatggcggatactggtggtccacagaatccccaagaatacttgcagcattcccaagctattcctagctccatggtagtcagaggactagagttagtaattaggggaggctggagggtgctaggaagatcactagcctgaaaagttgttggaggcgtggagggagatctggttcttggtcttggctctgctatgtggctttgatcaccctgagctgtgcctgcagaagctggactagacgatctccaaaatttcttccagctctaaattctatggcttgaaaactatgtggttggtgaatttgcctctagcatcttcttatccctgctgtccacttagccatcccatgtccttcctgtgtgctcaggacacaccctgaggcttcccaccctgtgagcctcatgctctggttggtctcacctccctcatcccatccaagctgacccattcggtgtccatttctctcagtcagtggacagcaggcacaaattgttgatctgatgagctaatccttcactgtaccttatccagctaatgactctgttctcctgggtcccgtgatgctcttgcttctcagtgtgatgtgaaagccatgggtggcagacggtactattgcgattccccgtggtgggtgctaaatgctccaccaactgcagggatcagagctgacccggccactctgctggagacaaatgtcacactgagttgttctcaagggcccagacctcctcttacctgatccattcctctcttcagaagctgggagtcctctgacattcccttccttcccctgccccgggttcctgccactttaggggtgcctctgagcccctcagcatgagcatgttgccatgtaccctgcaacagagctgggggctggctgtggcttccagcctgctgcccaaaccttgatgctacaaaaaatgttattagaataaaacatctccttgggattaggtgtacagtagtctgttatcatccaaggggctggggtgggtcatgaaaggggagggtggttttgaccttgaacatgctttggctgtctccctgagccccattcctctgccctcctttagcacccccacatagaagggcactgatctgccctctacagctgcagtgcagggcatcacagggggcagggagcagggctccctgtcctaccctccctggctggaacttgggctccagcccaggtttcagaccccaaatcagcccagctggctctggctccttggtgccacaaattacttagtgaccttaaccatgagcctgccctctgccccactcctgcagccaagccatctgtcaaaactgacagccaactctgtaggaaggaatgtccatgggctggggcctggggaggcagggagaaacagtgcccttgtatctctttctaattccttgaactgcttcttttttctctttcttctaaggagcaatgactccaaaccaccaaaccaagggttttaatccaaatctgttcttacttggtaaaaaacctagaaaatccacaagactcttatatgtgggatgcacaaaaactaccttctgaattggaataaaccggtacatttgagtatcatatgatgaaagaacctgattaagtgagctgcaacaaggaaagagcttaagacagcacatagtagggctttaggaaggtccaggaagatggtttattgtggcgtaaactggctatcgcaataattctttgggggtgacatggtgtgagcaaaggaccctttaggaggagtcagaggtctgggttccttctaacagtgctagcttggatgtagatagtcacttaccccctgggagcctcagtttcccctctttgacagggataataattgtgctctgtctgctcctctggcttatggttaagaatcaaaatgatccatgaatgtaaaattccttggaaagcagtcaggactgcatccattcatttaatggatatttgctgagccaacatcaaacccaagctcagtgctgggagctggagagaccaaggctcacacgatcccccagcaaccctgagggctgggcttagtgttatcctgtcacttgggactggaagccacttccctggttgagactttcattttcccaatgtagaggaattttgatgttctgacttgctcttatcgggttctctttaataaaattcgctgtgggaggttaaagaaatcactggaggcagttatgagcccagtaggtgctcacatcatccctgcaaccccgtgtttggcagatgccacccacccctaccccacctcctccctcatacactttctgcttttagctttctgccctctcttcccacagtgatgatgaaaggctttatatttggtgcttttatttatccaatgtgcatttaaatcagttctcgtttaatccccataatgctgtgaagcacttagggcaaatggttcattttaaaacagagagaaacggctttctcaagcttacacagctgatatggccaaaggacacaggatctgaggcctcttcctctcctgatggagggtctctctgagcgctgtctccttcatgaagtctttccggattctgggttggaattaatcattcctttctctgaattcccatggcactttccccatcccatcatgggtatcttctaagactcatcactctctgctctgtcctaggagtatttgagtctgtctctttgtactctcccaagctgagagtcccttggccccttgaaagctgtctctccttctttatggttcccctccatggattctgatcactgtacctaagacacggccctcaatcaattttgttgactgtattgaacagatggaagaatagtcatctactagcacattgcagaaagggagctgttgggttcattgattttgtgtggttggaagggttgactctcagaaaaagagcacatacttcttccagacagtaggttggttgtggtcagatgtgtacatctggggcatgcatctgctctctccagtgtgcttggaggatgctgtctacacacaaacttctcgaaacttaaccccttctaaagttttatggatctccactccctttgaagaagaccatgctcacctgggctgcagcgagtgcctttgtgtgggacaaaaaaatgccccttctccctggctgagacagcccagggccagcgataggcttagtgatccaactggagccttgtttggaaaaactctcagaacatttttcctctgctctcacaccacaacaacatacccagaagacttctgtgacctcaaaaccttggggatttctccccaccggcaagctagcaatcagttcttcagtggacaccagctgggtgtcccccaattcaattccaacactatttacctggagatagcatcagatcccacatgttgagggacacaagactgccccctccttcccacgagtcatattaataagtccgtgcctccggaacttctgatggactggcttcaagttggggttcccatggtcccctctttgagtttaattaatttgctagaggagctcacagaactcagggaaacacctatttacatttactgtaagggttagggttaggttcatgtaacacttccttacatttattatgaaggacattttcaaggatacaaataaacagccaggtgaaaagatatacagggcatagtccagaaaggtcctgagcacagaagcatctgtccccagggagtgggggcgcaccaccctcctggcacatggatgaattcttattcgcccacccagcagtgtgcagcagcctggtcctcatgcctcccatctttctcatgggtggacagtatgtctcatttgctcccacatcccctcctctagcgcagggcctgacactgggcacgtgcccattaggttcatttagtgaaggagataccaaaggaaatggccttctcttctctagtgagcaactggccacgtcgaggtttcaagttgcagtcaggatgcatgctgggtgtgtgccccctactgcaccacccctgggggtcttggtctttgcaaggtctaggggccatgtagaggctcctgcagcccacacttggggagatggtgtgggtggcaatggaggatgttccctttcaacaggggcagtctggaaaacactgcctctgtgttattctcactcatctcgccaactgcatgaccttgggcaagtccttttgctcatgtagtttatccctagaatagatctgtaaaaagacctcacacccatgttgtccatccctggcttttcacagatgacaaaactggaagggaaggagactcgctcaaggtcacacaatgagtggctgagcctgggttttgactccatgtccactgttttctcagagcttcacttcccgattgtcttttctgccaaatcgggagagtcaggccattctgcttatttcataggattcctgttagagtcaaacgaaaaagcgtggctgtcaaagtgcattcagatgtacgcagggctaaatcactaaccaaactttgcccaaagagatgccacggcaatgccaggcagacaccagatgtcagtttccccttcactgagatacggaccccactcctgacccagtggccttggggcgagtcttgcaaccccacctgagggtggcttctcagcccgtggtcctgtgacaagccctttctaccgcttcctctgcaggcccgctaatgagttcttcgttgtttgtgttgagaagaggcagctgaaggattggagtgtgctttcttctgaatttatcccattaggaagcagactatctcaaaagagaaaaaaaatgtcattaagacttcactgagcactgtgtaaggcttaagaaaggtcaggaaccacctcaagagtatgcggaggtcctgaggagcacgatgacagcttgactcacggtgagagtgtgttgctccaggaagggccacctctcctcctaccatagagtcctcgctggggctgctggggggaccacccactacccttgcttgtagcacttattttaccctgggctcactaaacctgctcatctccactacaacattcaagaaccgtcaaactcctgatccagtaaccttctatgactagcgtgcatcatggcatttacagtaaagctagccctctacagctcacacctctgactgccaaaggcacatatagaggccccattgccgggtctatcgttcttgcagcagtacttctaaaattaggtgggtatggtataatacaagttactttaattctaatcccctggcagaatttatagcatatccattcctcattctatctctctaagggataatcataacaagttctatttgcttctgacagactgacctaaaatcactcattgcagccgggcacagtggctcacgcctgtaatcccagcactttgggaggccaaggcagatggatcacaaggtcaggagttcaagaccatcctggctaacatggtgaaaccccgtctctcctaaaaatataaaaaattagccgggcgtggtggcgggcacctgtagtcccagctgcttgggaggctgaggcaggagaatggcgcaaaccccggaggtggagcttgcggtgagccgagatcgtgccactgcactccagcctgggctacagagcaagactccatctcaaaaaaaaaaaaaaaaaacactcattgcctattttttcataagccacatggcgcttgtctttcacatatccgcctttcaaaggggcagtaagcagaaaatacccaagaaggaaaggaagaggaaggtcccatcagaatttgggcaaaggctcatgtgttttggtggatcattcaagcaagtctgtttcctgcgggactggcctgcctttgagcctttctgcttcatagccctctgtcttctttcttcgttcaagatcagactgcttccatgctttgcctccatatctcattaggatgccttaaaaattaactagcaggccgggtgtggtggctcacgcctgcaatcccagcactctgggaagccgaggtgggcagatcacttgaggttaggagtttgagaccagcctggccaacatggtgaaaccctgtctctactaaaaatataaaaattagccaggcgtggtggtgtgtgcctgtagtttcagctactcaggaggctgaggtaggagaatcgcttgaacttgggaggtggaggttgcattgagccaagatcacaccactgcactccagtctgggcaacagagtgagactccgtctcaaaaaaaaaaaaaaaaaaatcaactagtgtagtggttctcaaagtgaggccccacaccagcagcctcagcttcacctaggaacttattagagatacagattcccaggttccatctcaaacaacagcccttagggtgaggcccagcaatctgtgttttcacaagcctccaagggattctgatgctcctgaacttttaagaaccattgacccaaagacatgggattgcttatctcaggacagaaagctgatgctcctgatgtgtttgctgacgcttggagctgtggctctcaaacttcagcacaatgaaggagactaagaatgcctcccagagaacacaggtgtgtctgaagcaggtgccttaaccagaagggctgctaatggtgggaatctcaggctctgtgacaggggtcatgtggattgttttaagcatgatgactttggagggcctcactcacatcaccttggaaactgcctgctaccccatggcacgagtttactggaaagctacacacaccagggacctaaacccataggaggactgtttatgtttaggtttgatttttaacaattaggtgatacgaacaataattttggaaaacataggcttttcattctggtgtgaactacttcactagatgttatttaaaagcaaaaacactggtttcacagttcagcaagattgaatgtctgattgagggctcagcaaattactgcagtttgttaagtttgtggttcaatttgaggtcccaaaggaggaaaagaggtacatgatgtcaaacacatgcagccagcttccagtggctttgcgtgggagctctggtcagcggggtttacatgggtttaatcatgctgaggccagatgcagtggctcatgcctacagtcccagagctttgggaggccaaggcaggaagactgcttaaggcaaggagtttgagaccagcctgggcaacagcgagacccccatgtctacaaaaaataagaaaaaattagccaggtatagtggtgcacacctatagtcccagccactcaggaagctgagatgggaggatcacttgagcccaagagttcaaggctgcagtgagctatgattataccatcgcacttcagcctgggccacagagtgagaccctgactcaaaaaaaaaaaaaaaaaaatcatgttgatcaacttcatttcctccctctcctgggcactctgtctttctttgatggcttcttgcctgagaaaaacacacagaaagctctcctaaagcacaaattctctccaagctgaaactaggaggagaaatattcaatctgtgactaaaatggggtctctgccggtgatcaagagagtgcccttttagtgtctgtgtgtttatattcaggtctccatagtgcagatggcaacccacagggtgcagggagtggagaaggattttcccaggaccccagagtaggaatggggtccacagggctggtgctgggagcagaacccagccatccgcggaggctggatttcatgggaaaatgagcttgtggaagggcactttctgagggctcagctagcaggaaaggtcactttcttctgaagccactaagcatgttattccaaatcagtggagctgaaaagatttatttaaaaggctatgaaatatcccttttttaaagggaaaaatatgatcaaggggattagaacggaggctgtacttgagagtcaggtgtccctgaacacccaggcagacttggaaagctcattgtgttggcgttcagtgcctccctgtccccttcccatggcagaagaggatcccgagaagaggctcttccctctgtccctgggtctctggggtcctcttctacccactctcagaagaacaccacacccaggccacccttccgggaagcaaccccactgagcttggggtgatattataaatctttaagcacaagcctggcctgggagatgaccaatcagaaaggaagccagccagggtcctgaagcagggtcctagaggcgtcctgcttgccaccagttcaccctttattgctggatcaaggggaggagcaagggagtcaggggcttggagtagtggctatttaccagtcagcttgcagtatttcattattcagcaactggcccagctatctcagtgcacatcagccacgctgtgctgcttccctcatatcaaagttccccctttccaatgtgcctgtgggtctggctgtccactaggggtaagcagttgattaaatggctcaaagtgctgggcatagtggctcacgcctgtaatcccaacactttgggaggccgaggcaggtggatcacttgaggtcaggagttcaagaccagcctggccaacatggtgaaaccccatctttaccaaaaatacgaaaattagcctggtgtggtggcagacacctgtaatcccagctacttgggaggctgagccagaagaatctcttgaacctgggaggcagaggttgccgtgagccgagattgcaccacttcactccagcctaagcgaaagagtgaaactccgcctcaaaaaaataaataaaaaatgcctcaaagggatcaacagccccctcttcggaagcccagcctgctcactcacctggtactcccctcaccatgagagctgccacctcctgtggcaagtgccaaagctcctgaagaattcaacaggcaggaagtctgcagcccgctagggacgctggagtggagctagtgtgtttcatgcagtgcaggcttgctggtgacaaatcctttgtttacctagaaagtatattttttattctcatgtttaaagtttattttccctgggtgtaaaatgctgaattggccgtcgcggtggctcacgcctgtaatcccagcactttgggaggccgaggcaggcggatcacctgaggtcaggagtttgagaccatcctggctaacatggtgaaacccagtctctactaaaaatacaaaaaattagctgggcatggtggcgggcgcctgtagtcccagctactcgggaggctgaggcaggagaatggcatgaacccaggaggcggagcttgcagtgagccgagattgtgccactgcactccagcctgggcgacgcagcaagactccgtctcaaaaaaaacaaaaatgctgaatttaccattttttttcaatacttcaaaaatgtcattgccttatttcctgtccatgttgtttttaaagagtagttggtcttcattcataggattgttcccctgtatgtaatgtgtctttttttctccagctgattaatgaatattattaaatggaatgaagtgggagggcctcggtgcataagtgttgaataatgagctcctccttccttttatacccaagatttgctggtgagagaactcactccctctcagagggtgttttcagtcctggtgtaaaggacccgaccttcagtcattgctccagtctctccacttgggtacacccaagttgtaaacatctcaggaacaggacactgtcttattctataggcagatattctttggtttatatcgaagaaggataattagaaaattgaatcaaatccttttccgttttctcctgaaatgtggtttcttgatttagctttgctgcggtagcctgttgagaagacagtagtatagaaatagaaggctcggtgggggtgtgggcatcgcattgctgtgatgatcctgccttttgtggttaccttctatttcagtctcacacatctgtgagctgggagagaccagcccttatcctcgcctcatccgctgccactccactccctcgtgttgtaactgacttgtcaccattccctggaaaataccatacccagtgacagctctggtcccacacactgttccctctgttcccacataaactcctgcggaccctgctcaaatgtcccacctctgtgaagcttcacccagcaacccagggaagagttaatcacaccttcctctggctgtgcaaagccgttatccccacgttactgtgatgatctgtttacatgcctcttcccagacagacctggcagggcccctagaaaaacatatgtatctctttcatttctatattcctggcacctagcatagtatctgatccattgtatgagttcattcaatgctaattggctaatgaacaagccaagcctctgcctttctattgaataagcatggtcttcaagcataaattctcttcctcagggcagcattcaaggatttgaagtcatctaccatgtccctctaaatctcggtaggctagaagcccccctatacaaaaatattcaggtactcttctaagtgcttaatgggtgttaacctactaaatcctcataacaacctaataggtgctgttgttgcccccattgtctagatgaagacactaaggcacagagagtaacttatccagggtcacctgcctggtcaatggcagcgttggactgcaaagcccagtggcagctcagagactgtgctctcagccactgagctcagctgctttgatggccattcaggtgactgcatttccagagctcacactatcctgactgccctttcattgacctccttcttggcaaaccattttttttttttttttttgagacggagtttgctcttgtagcccagactggagtgcaatagtgcagtctcggctcactgcaacctccgcctcccgggttcatgcgattctcctgcctcagcctcccaagtagctgggactacaggcgcctgccaccaggcccagctaattttgtttttatttatttattttttttgagacagagtttcactctgttgccaggctggagtgcagtggcacgatcttggcacactgcaacctccacctcctgggttcacgtgattctcctgcctcagcttcccaagtagctgggactacaggcatgcaccaccttgcccagctaatttttatatttttagtagaggcggggtttcatcatgttggccaggatggtcttgatctcttgacctcgtgatctgcccgcctcagcctcccaaagtgctgggattactggtgtgagccaccacgcccagcccatttttttgtatttttagtagagacggggtttcaccttgttggccaggctggtcttgaactcctgatctcaggtgatccgcctgcctcagcctcctaaagtgctgggattataggcatggcagaccctttcttaaaatgtatcttccagaacaggtgctatgtgatttagctagcacagcatcagtggggatgcgacattgctgctctgtacacatcacgctgttcatgttgcccatggtctttcggtagccaggttgcactgttggctcattgagcctgtagtcaactaacttctgttagctctgtatactctattttacatgaatatggttgatctttttttagcccaagtacaggactttctttaccctcatcccttgtagatttcatcttcttggcttcctgcaaatattgtaacctgatgagatctttttggatctttgttctgtcacataatcttatcccttatagcttcataatttataagcctgtcttctaggacttcactcatttcactggttaaaatatgtgtaaagagattagaccaaaggcctagccactagacacgcccctccagagtgacactgacattctttggatttagccgtcaaaccagttatcaatttacatagttatatactttttacccaaattttttcattgtccacaaagatgtcctcaggggttttgtaaaagtgttttgagactcagggacactgtaatatcctttcattctatctcaatacaatttgaaactcatcctaaagttaaaaagtgacattcaagctgcatgaccagctgtaacagttttaattcctagatacatggagcacagatgttaggaaacatcaccactttagagagaacccaatgcatgaaaatctaaacttacaaaattatattggaggctagggtgtgcttaggtaaactatcattcatccactaaatagaattgttacacgagtatgttctatgatgtttttgaagagtttgcaataacatagacaattttgtgtaataatagtaagtttgaaaagcaagatacagaattatgaagatggtatgatcataagtttaaaacaaggagaaaataactaaacatttttttaaaatagacttgagtaagggtccccaacccctgggctgaggaccaggactgtctgtggcctcttagaaaccaggccacacagcaggaggtgagtggctggtgagggagcatcctcacctgagctccgcctcctgccagatcagcagtggcattagagtctcataggagctctaaccctattgtgaactgcgcatacaaggaatctaggttgcacgctccttatgagaatctaatgcctgatgatctgagtgtaacagtttcatcccaaaaccatctcccagctcctcttcccggtccgtggaaaaattgttttccacgaaactgatccctggtgccaaaaaggttggggactgctgggctagaagtaaaaactccaaaatgttaacaatggttcgacaaggcatagccttctttcaataattcccaaaaatatgtaaaatgaacattcatggttttatcacagtaaccttttcaggtgggaagttgggaaagtttgctgcaacagtttacccattgcaaaaagagtggtaaacctggattattcggttactgaaagaaaagggtcaagcaccccagcgtgtggcccaggagtccacggacagggaccctcaactgccttctgctctgaggtgcccactgtgtcatgtgtgtaaggtttttttttgttgttttttttttgagacagggtcccactctgttgctcaggctggagtgcagatcatagctcactgcagactccatctcccaagcaatcctcctgcctcagtctcccaagtagctggggctataggcacatgccaccatacctggctattttttattttattttatttttagtagagacaaggtctcgctatgttgctcaggctggtctcaaactcctgagctcaagcaatcttcctgcctctgcttcccaaagtgctgggattataggcatgagcccctgcacctcccaggtctataaatcttacctccccacccagagtggctgctctgcctcaggctgcagcctctgggaagaggagacttctggacaggctggtggggtgagggtgggttccatgcccccgggaaataggacaacctcctcataggtagagtgggcaggtactaactagtgccatgtgagcctaagcaagttacttaacctccctcaggctggctccatcccctcataataactcaggtttctgtgttctcagatacctaaaattgtaccactaatagtaaattgtattggagtggttgaccatgtattagtttctcttctaagataccgataaagggagtgaagatgagtgggaacaagtcagaaaattcttactgtaatgaacttgtcaaaatggattaattaggaagcactgggctaggggaagggagttgaactcaaaaggagaccagaatacagagcccccttaaatgttgacacatttgcaatttggccaaagcctgcctctagtactgtggttatacactacaggtgatattcaagatatttaacaactggtaagctttgggaccaaccaatctgaacagacatcggcagtgaccaatcagagtagatactgtctgggagccgccatcacccctccaccctgtacagactggagagcgggccctgtcttcccagaggtgttcactcaagggtccaccagcgacttccctgttcaggcactcagagcagcaactgagaggtctgccctggcacagtcactttgggaagaatacagctttttttccctccctttttcaataattcccaaaaatatataaaatgaacaggccttggtcccacagctgcccccacactcttattcttgctttcttctcttccaagataacacgtttgccctctgctgtccatcatgcacctggcaggatccccttgttttctgggtgaaggcagcaggaaagggggagccattccttgccctcccttttgtggcatggcggccccacctttggctttcagatgacacggccagcaggttttctggggtatgggagacttgagggtatggtcatgaagattttttttgcagcgtcttctgcatacaaatactaccatctgtaggaaccatgcaaactccagcagtaagctcgatgaagccattgtgatccgcaggactcacctgaggtcttcttggggtcaaattttccccattgtcaatccctatgccttttattatggaattggagtctgagttccccatgaaggagagcaagcccgggagcacagaatggcctgcgtggcctggtttcacaggcctgaggcatcactgtgtgtgaaggtggttttcagtagcccacttgctgagctgggtggagcccaaggccaggaggactgagtcatgggtgtgcttccgtgcaggtcttttgtcttagccacgttttcttgtccccagctgcccttccaagcctgactctaaccaatttgcaaatgctctgggtcggaagctagggaaggagtgatcagccaatggcttctgtagctggaagatcaataccctcatatctacccagaaatatttcctacaattcacaataatgcaccctagggagttctttcccacccataactctggatcctcataccaaccctctgagagaagcgagtcaggttaattactatcctcctttgatagatgagcacaaaggagcccctagggttgaaaagctcatctaaggccccactgctaatgagagacagagctgggacaagatctgcctccgggaacctggaacagcagctgatgtaatcaggctccgttccagaatttgagaactttcctggtaccctctgtgatgagaagagggagtaatcatggcatggaggcgctcgggcttccgctttgcccaggtggaagcttggagaacaaagcagttctgtgacctccctgggccccactgtgagcagagatggggccaggacaggaaagcctcctccctgccctccttcctgtgtccctcctggtggcctctccccgtgctcttacgctgtcctcctctactgtccctcctcactggagactcactgaggcccaaggcctgctaactagcaacatagattcccaccaagggacccagcgctcgccgccccacacacagcgagttaggaaaaggccactacccagagtattcctttcagtagaacagtgcttttatatttgcttttaaacttttttttttttttttttttttttttttgagacagagtttcgctcttgtcgtccaggctggagtatggtggcgcaatctcggctcactgcaacctccacctcctgggttcaagcaattctcctgcctcagccttccaagtagctgggattacaggtgcccaccaccacgcccagctgatttttgtatttttggtagagacagggtttcaccacattggccaggctggtcttgaactcctgacctcaggtactccgcccacctcagcctcccagagtactgggattacaggtgtgagccaccgcgcctggcctaaactctttttaaaaacaatgttattgagatatattaacataccatacagttcacctatttaaagtctacaattcaatgacttttaatgtattcagaaatgtatgtccatcagcagaatcagttttagaacattttcattacccccaaaagaaacatcatcccatcccccttcagcatcacctgtccccacaaggtccctcatcccccaaccttagacaaccactagtcagctttctctatctatggatttgcctagtccgaatatttcacataagtagagtcacacaacatgtggtcctttgtgacttctttcactcagcataatgttttcaaggtttatccatgtgattgaagcaggtatgagtacttcatttctttttattgccaagtactatttcattgtttggatatgtcacattttgtttgtccattcattagctgatggacatttgggttgttgctactttttggctcttatgataaagctgccatgaacattcatgtacaagtttttatgtggatatgttttcacttctcttgggtatatacctaggagcgaaattactgggtcatgtgctactgcttgaggagctaccagactgttttccaaaggggccacactattttgcattcccactagcaatgtataaggattcaatttatccacatcctcaccaacacttttttttttttaaattttagccatcctagtggatgtgaagtggtgtttcattgtggttttgatttgcatttcccagatggctgatgacgttgaacatcttttcatgtgctaattggccattagtatatcttctctggagaactgtctatttagaccctttgttcatttttaattgggtttttaaaattattgaattataaaagttttttaaatattccaaatgtaagtcccttattagatggataattgcaaaaaaaatttcaacccaaattttcaactcaagttcttttgtgttgtctttttcacttccttgatgttgtcctttgaagcacagaagtttttcattttgatgatatctagtttatgtcctttttcttttgctgcttttgtttgtggcatcatatctaagaaaccactgtctaatccaaggtcatgaagatttatgcctatgatttcttcaatttttgtagttttagctcttcagtttaggtctttgatccattttttagttgatttttatacattgtatgagatagggggtccaacttcattcttttgcatgtgggtaatgatcccagcaccatctcttgaaaacactattttttcccattgaattgtcttggaatctttgcaaatatcacttaactataaatgtaagagttatttctagacttcattttttgttgctgtatatatcgctgttattccagtactatgctatctcaactactgcagtttgtagtccgttttgaagtcaggaagtatgaatactccaactttgttccttttcaagattgttttgactattcaggccttagaaaggaataaaatgctgatacaggctataatgagtgaaccttgaaaccattatcctaagtgaaagaagccagtcacacaaaggccacatattgtaggatgccatttatatgaaatgtacagaataggcaaacccatagagacagaaaatagattagtggtgcccagggcagagaaatgggagaaaatggggcatgactgctaatgagtatggagttttttgttaggttgttgaaaatgttctggaattagatagtagtgatgattgtattaccttgtgaataaactaaaacccactaaatagtacactttaaaatggtgaattttacgacgtgtgaattatatcttgaaaaaaattttaagagataatttgaataccttatatctatgaaaagcatcgtatatgtagtttaaaatcttcccacaaagaaaaaaataccctccaggcccaaatagcttcattggtgaattctaccgctatttaggaaataaataatatcaattctacaaactctcccaaaaattgaagagaatacttcccaactcattctaaaccttattgtgatagcaaaacatgacaaaaacctgtataagaaaagcaagtgacagattaatatcttccattaatattgatgcaaaaattctaaacaaaattttagcaaattgaagccaacaatatataaaaaggataatacatattgaccaagagtgttttatcccaggaatgcaaatttcatttaatatttgaaaatcaatgttataaccattttggaaaatgatttggcagtttctttaaaagtaaaacttacatctgtcatatgatccagacatttcacttctatgtatttacccaagagaaatgaaagcatatgttcatagaaagacttgtatacaaatgttcatcacagcttttccataaccaaaacctaaaagctacccaaatgtccatcaacattcaaatgaaaacactagtctttccataaagtggagtcaccactgggcaataaaagggaataaaccattcacaacactacagatgtatctcaggagagttgtgctgagtgaaagatgacagaaataaatgaagtaaattctgtgtggttccatttatgtaaaattctagaaaatgcaaactaatctacagtgatggaaaacaaattagtggttgcctagggatggaaagggattacaaagaggaatgatgaatattttgaggatgatgaatatgttcttttttttttcttttgagacagaatcttgctctgttgcccaggctggagtgcagtggcgtgatctaagctcactgcaatctccatcccccaggttcaagtgattctcctgcctcagcctcccaagtagctgagattacaggcaagcaccaccatgcccagctaatttttatatttttttagtagagacgggagtctcaccatgttggccaggctggtcttgaactcctgacctcgagtgatccgcctgcctcaccctcccaaagtactgggattacaagcttgagctaccactcctgacctaatatgttcattatttttattggtgatggggtgtgtgtgtgtgtgtgtgtgtgtgtgtgtgtgtgtgtaaacttaccaaaatagcacactaaatatgtgcagttattgtatttcagttatacctcaatgaagctgttttaaaataaatacgtttattcaattaacaaatatttgaatgccaactatggtctaggtgttggagatacaaggctgaaacacaagactctagacaaggttcctgccttcgtggagtttatatttaagtggaaaacttatatagaccagattatttttaagagtcctggaatttacccacacagctctttcagccccagaggagaagtttcctccctcccagagctgcaggagaactggcaacacagctggatgtagggtggcatggagctgggtgtagggtggcatggcgctggagtccagtgatagactaacagtggttagattgtctcgcttctctctggatgtcccccttaaggcgtctgatcaccatccatgctcccactcctgaccagcaggaagtgggtcaggtctgagaacagacccctgtggtcccttgtagtccttcatgtctgagaacagaccagatggcaccacggagacctcctgagccagagagagccaggttgtgttgtgcagatggagggtgctaaggaaagaagggaagtcggagtagagagagggggctgccctgttgctagagcactttctggctaatgttttcattcctttggaggcttgattccattaaataacctggtggagccccttttttgcttaaacttatttgagtggcttctgttattgcaattaagaagagctttgaccaggcgtgatgactcacatctataatcctagtgctttgggacgctgaggtgggaggattgcttgaggccaggagttcgagaccagccgcagaaacatcgcaagacccctttttctaaaaataaaaaataaattagctgagcatggtggcgtgcacctgtagtcccagctactcaggaggctgaggcaggaggatcacctgagcccatgagtttgaggctacagtgagccgtaatcaagccactatactccagcctgggtgagagagcgagcccctgactcaaaaaaaaaaaaaagcttttattccccttcactcccttgggtgagctctgccttcggggggtgaggagaagacacctcctggcctccccatcacagtgggctgtggcttggacccattcattaactacagcagctgccaccctcagagagcaggctgtgtgggaagggagggaggtcagattgctccaaccaccgaggaagacaggtgaaggcaggcctgggtgaacagccttgggaactctccagaaggcatcagtgggaaggcactgggatgaatctaaataggatgaaaaaggaggctccaggcagacccatagggattgaggccagagggccgggagcagtgtgttaggtgccctgcagacgtctccatgtttcggtggcaccgggccccatctttgttcacctggctgtcctccatctccttctcttctcaccccttcttgttttcctgtttcctctctaagcctcctagctcacagcactcatgatggatgttccatgcccaccagaaacacacagtactaaaaccattgctcctttgggaacaaaaccttggcctgagattcaggtgatctgatttctagtctccattctgctcccaactcaccaagtgaccaggagcaaacattactgcctgtgccttgaattccccacctagaaactttcttctaaaggcacagaagcaaagtggaagaaaggccagttggctggcatcaggggcctgggttccagccctgcctcctgagtgttaactgtgccacctcaagcaagttgccaagcccggtgggtcttggcttcctcactcactgtccaatgagagagaatatggccagcatcccacacgtggctatggggaagatcctgcagttccctttaagtcttaagcagagggaaactttccttcatccagcgggggcccaatggacacatctgctttaccaagtgagattttcctgtcatctacaagaacgcgtagagaaatgaatgtgcagtgcatgtgggggaggcaccgggatggcataaagccagccgtgggattgcttatccagccaggcaggactcctgtcctggcatcttcccttgccacccatctggagaccaagaccccaaattccagatgtgaggctctgtgagatcaagccagtcctcacaccagaatgacctgcatccttcgccttctcaagggaggccagtgctgtttacttcacaccttccgacggtttgggaagagaatccaatgttgtaaagcctgccatcttcttgaatggcaccagatactgacactcggtacacgcagctctctggagcatgctgttttctcggtggcactgatctgctgccttcacagagagttctgatacaatcatggcatgcagaaaagagcaaaatatcaaggggccagagcaccacggttctcagacacacaatgggagagccaggtaaggacatagaaatcagccagccccctagaaaggccccctagaagtaactcacctgaggtgatggtagagactggatttgctttcaggagtaaaccaaggaacagcaaaacaaaaataagcctcgttaggagtcgtgttactctttggtttttaacttcaaattaatttctcttctgaaccttctgcagaccaagctgccaaatgtaactccagttttccacacttctgcctatagccttgcaccgtagtgaactaaaattcagaaagactggaagctaaggaagtcactcagtcatcaaacattaaattctgttccctggcagctatgtacccaggcaggagattgaatgggaactctttggagagatttccagcaacaggagttgaaacaaaaagtcttttctgcttaatcctcatttagccagagcactaaactgcttcctaaaaagcaccaaaactttgtccacatgatattctttacaatggtgcgtcctttctgaacaatggattttcttctcagatgtggctcccgatttaagcaaaccaaaccgacacaacttcatacctgctggatggctaagggatgtttgctcacattacaacactcatcttgccagctggcttcctgtagcttcctttaaacagatcgagatttttctccatccaatgtgagcccagtggacacgtctgctatgtgaagtaagactgtcctgaaatccatgtcggttatttacccttgtggtactcacggccatccagaagggtattgcctccttaagctcaactctggctgactggcggagaagaaagcagagattagacagaggtcacagattctgagcagtgagaccaaggaggcaagagcagatggatctgaggtccctggcaaattattctctgccttatactctgccactagtgttttccacaaagcccagatggagacggccaaggattgtgtgtgtgttttatatatgtatgcatctatacatatataacagctttaatgatatgtaattcacatacatataaaaacatagatgaaaataacttagaattcacataccttttgcccatttaaattgtacagttcagtgtcttttagtatattcccagagttgttcattcttgccataccaattttagaaaattttcatcatcccaaaaggaaacatcatgtgtcaccatgcctggctaattttttttctattttttatagagacaggttctcactgcattgcctaggctggccctgaactcctgggctcaagtgatcctgtcacctcagcctcccaaagtgttgggattacaggcgtgagccaccatgcctggccaatggtaggatatttagaagcatccttggccgctacttactagaagccagtagctccacccctcaagttatgacaactaaaaatgcctctagacattgccaaatatccttgggggcccaaattgccccccagttgaaaacaattatgttatcctaaagtagctcactcagtttgcgagtttttgtggaacactgtaaagctcagcctgacctctttgtgccacccagcaagttcccagaggcctgcctcgctctttccctggtacacgcctgcaggaggtacctgcttaggaaatggatgcttccattccagctgaatcagcacccgggtctgaagtgcccactcccagcgagactctgcggtgtgacctcgcctggcaactcgagaagagcagtctgctgggcaaacacttgggcaggacaagcaaaacccccacagaaatccttctgggccacgtgtctgcttgcctgtggtctcgagggccctgtgttgccactagaatgccgtcagctgctcctttttggagagatttaatggagggactggaggcagggactaatttcaggtgtctcctgggtcctaggaaaaaaaagagaaagccctggtttaacctttagcgagatcaggactgaccaggcacgaggctgggtactgagaacagatgactaaacccattccctgccctcggggtcagggattctgctgaaaggtgatcatgggcagctgcctcgccctcatccccagcttggtgctggcacttctctggggtatagacatctaatgactgagtccctgccgttgagaggctacagtctggtgggggaggcggcaggttggcaaagcttacagaaatgaaatggagattgcaaaagctctctgaagagacgaggctgggctggggtgatcagggaggcaggagccagtgcaactgaagaaagatggagtttggaggtgctgagttctgcagatgagtgttccaggcacagacggccccaaaagctgctttagactggaaatgtctgggctccagacccctccccagggccccaaacagcagtaagcctatctctaaagagctgaggtcagaaaaggcatgtggaggccccactggggaacatgacttgagttaacctctcatgaaagtacttgcctggcttctgactcttcaagaaaggcaaatagaataaagaggcttcccacagaatttcaagatgacagagaatctgtggatgaattctgctagtgaaagacagtgcatatcacaacctggatggaactggagactattattctaagtgaagtaactcaggaatggaaaaccaaacattgtatgttctcactcataagttggagctaagctatgaggatgcaaaggcataagaatgatacaacggacatcagggactctggggaaagggtgggaggggggtgagggataaaagactacaaattgggttcagtctatactgcttaggtgatgggtgcaccaaaatctcacagatcaccactaaagaacttactcatataaccaaataccacctgttctcccaaaaacctatggaaataaaaaaaaaaaaaaaaaaaaagaaagacagtgcatatcccttctaggactcatagagcaaaagaggctcgcataaagctatcctgctggcctggtgcggtggctcacgcctgtaatcccagcactttgggaggctgaggcgggcggatcacatgaagtcaggagtttgagaccagcctggccaacatggcaaaaccccgtctctactaaaaatataaaaaattatcccaggtgtggtggtgcaagcatgtaatcccagcactttgggaggctgaggcgggcggatcacatgaagtcaggagtttgagaccagcctggccaacatggcgaaaccccgtctctactaaaaatataaaaaattatcccaggtgtggtggtgcaagcctgtaatcccagctactcgagaggctgaggcaggaaaatcgcttgaacccaggaggaggtggagattgcaatgatccgagattgcgccattgcaccccagcctgggcaacaagagttttgaaactccatcttaaaaaaaaaaaaaaaaaaaaaaaagctattctgctgcctggaattctgattcctcatgcgctggtgttccacctttgaggagatgggcagggggaatagatgttttagagaacagcactgaggactaagtcacaggatgttcaagttaacaaaattgcacatatttgctgacttttccttcaagggcctctaggttaaaaatgaggttgtccagccaggcgtggtagctcacgcctgtaatcccagcactttgagagaatcgcttgagcccaggagttcaagaccagcctcggttgggcaacagagcgagaacccaccttgacaaaattttaaaaaaggggggctgttcttcttgaagactcaagtacataagctaataaaggctctgataagtcctgcaatttacaaaccagtttaactatatctcagatttctccaaatttgacatgaagtctattcactaggtaacatccaataacaataacaacaacactttaggaagattgagctagtgcaacctcttattgtaaatggtgtcttaggaattaataccgtgggtcctagaatctggtcatccttattagaaaggggtcctagaggtctcatatcaggactccaggttcccatctggacagtataggcaggaagagtttggggaaggggctggcttttccctctcacctgagctagagccccagaaggcttgccactcccaggctggctctcctgccaggtggcaggactcccttcacctgcctcagcaagtcattgaagtgacctccctggccagaagctctggccttgcttcttcccagggctttttccttacaaatagtagaaaaggaaaatggtagctgcactctgtattttaatgtgatacgttcaggttgagcttttatatttctaacctactcccacgcctactctttcagatccaggtgtgagtttaaatgcaaaccataccaatttctttctcagaagagcatcttactactaacagctcaataccatgagttagcactggctgaaatgttttagagaacccaaacttatttggagagcaagacattcagaacaaaaacgtaaagagctttgaacagattttaaatgacaaagggattctgtcctgtgcaaccatttaaaaagctcttttaacactaatatgagaagtcatctgtaatagatgaaggagaaaaagtaggttccagtaaagtacaataggatcatttcaattttggaaaaagaaagtctatgtgtttgtatgtggagacagggaaggaaagacgggaagtaaacctacttgtcattcctcttagggaatggaggtggggagtagcttgagaattgaggaacgacattcactctgaagtgtacttctttaattattgaaatttttaaatgaacctgtgctacttttgcaattaaaaaatacaaatctgccttgctggatggcaaaatgaagcctccaaaaatggactggccaggaagtcatagtgtgccctgggaatggcaggtaccaaagaggtgtgaaggaacaaaagtctgtcttaactgggggcacaaaggaaggattcatgctcagttgaaatttgcctctttttattttgagacagggtctcgctgtgtcgcccaggctggaatgcagtggctcaatcatggctcactgcaacctccgcctcctgggctcaagccatcctcccacctcagcctcccatgtagcttggactacaggtgtgtgccaccaagactggctaaattttgtatttttggtagagacagggtttcaccatgttgtccaggctggtctcaaaactcttgattgcaagcaatccgcccgccttggcctcccagagtgctgggattacaggtgtgagccaccacacccggccaaaaaatacaaatctaaatgcaaatctgccctgctagatggcaaaatgaaagctccagaaatgaactggccaggaaggcaaagcatgtcctgggaagggcaggtaccaaagaggtgggaacaagagtctgacttaactggaggcacaaaggaaggattcatgctcagttgaaatttgacatgttttgctttctgataagaaaacgtaaagatcatgaagacccgtgccattcaacttaacaaatcctgaggcatattgtgtatacctactctgtgtcgatacagttcctacacacatatatgtggtcatttaaatgccatatgacatccaagttgaggcagttttccagaaccaatcattctcaagtcagggcatatggaaaagagacatttagcctggagaattcctttgcaaaatagcttatcattttcaggttttgcctaaagattttcagcaggctctggccccagtgcacctttgtcaagggagcagctccaatagtttgtcaagagaataaaagtatcggcagccaggactggttttagccaaaactgcagagacggcagagtcttttcttgtaatctcccagtctcccatctgtctaccccttccctacctgagcactcagatctacactttggttacccccatctcctttcccatcccccctcacacccaccttctttcaaaattctttgatagatcttaaaaagggagctggtgccagcctttacactttagtatgaatgtaactcagggtcacatagcttagaatgtctacattttaagttttattttggattatgaaaggggaggttgaatccctttccaggtaaaagattcttcaggcatcagctagcaggtagaggcagtggtttttgaacaacccttctgctgttgctccagaagccacactgcctcactgttgttagcctgtagcccaggtcctgggcattctcacccagaggctccatgcagggcctctctccgcgctctggagggaattggccctcattctccgtggaccaaatgatgcatatgagatctctggtgcaggccactgcattctttgtaggacagaatttcgacattcaggatcaagcagggcctcagattcactgttgagagcccaggggaaataatgctggacagtagcagggacgagccctggttctgttccttaagaattatgtgaccttaggcaagctatgtatccctctctaagctcagttttctgacctataaaaaggaaacaacagtgttgattttacagggttgttctaaggactaaatgagataaagaatgcgaagtgcttagcatagtgctgggcagggagagggccctcaataaatatgagctgtttgcagctcttattacttggtgggacagagctaggggcctgtgggaagaaagaaaacaaaagggccaaagcaggctagaagctggggttggagaactcagaataatgacacctgtttccatcagctccagctttgatcgtgtccttttacaggatccccaggcaggagaacaccgagttaggaatggtgactggcttcccagtagagtctgggttttgaactcatgagtaaggacagcagctcctccgttttgcaggggcatccacctgaaccacaggcaaggcagaagtgatcctaaggcgttaaatagatagtgcaggctaggcacggtggctcacgcctgtaatcccagcactttgggaggctgagatgggtggatcacttgaggccatgagttcgaaaccagcctggccaacatggtgaaaccctgtctctactaaaaaaaatacaaaaagtagcctggcatggtggcgcatgcctgtaatcccagctactcaggaggctgaggcaagagaatcacttgaacctgggaggtggaggttgcagtgagccacgatagcaccactgcactccagcctaggcaacagagagagactctatctcaaaaaaaaagatagtgcacagtctacaagcaaagtgaatatattttacctgtgcctgtgtgccctcactttatacacaattgtaataaacttcatcatgtggttgtcaaatccgcagcggactacgagcagcaaactagggactcaacaggcacaccaagcagagagcagtgatagctgacagtctgacaaagagacagaaaaaaatacaaaggcagactgagaattcaccaagagtcacagctctcaggctctttagagaggtttcttccgcccttcgacttctgagtgctgcactatgtgatgatccaaatcataactgatgttcgaatcttgaccctgtaaaaggatattaaattatcgtcaattttaagcagccagttgtgtgaatgacagtagcctctgggtggagtggtgctttcaagcgtgcatgtgctttccgtgggtttgtttccacgtgtttgcttaccattggattcccgtggtaatcctgtggtataggaagggtgtgtattattttatagagagaaaaactaaggcctagagtggctaagagacttgcctgggcttatgaaacgagtgagtggtagatctgggcttgactccaggacttctgacttgaggctcaatgcattttccaccaaacacattttcaaaccctgttccttggatccccagggttctgccccagggccacaggagggttgcaggagctgctgtaggatgcagagaaggctcatgcacagggctgtggcttcttgcctctgattcagtgagaagcattcggtatttatctgaaagagacttgggatggggaaaatcaaaaaggtcctatgctgagaacatttctatccaaaatgactaaaatccaaagaaagtcgtgggctgtgtgcatactgcgataaatctgctgctctctgaaaaacttggccatcagaatgacctccctcaaggatgccacaatcttgctggacacagattttctgaggacagccctagatgactctcagcctccatcctccctcctcatgcacgtgggctcctcaggccacccagggccattactgcccttcataatccctatcccatgggccaaacacgtccccctcacctcagaagtcccctggctggtgtcctgttctctcaaagtcctgctgagagacaaatggcaaactcccaaatgaactccactaagaaagcatgtttattttctcttgtatcttctccatccaccggagccctatgttaagctatttacagtgggctcatggctgtatctccccagctgtgagtaattaatacttaatgaatgacagatgtcactctggtggacccagaatattaacccaaataatttattcttaatgtgggaatatcgggcccatgactggccctcaggaagttgtttgagtagagaggcctttggtgaccccatagaggtggtcacttattcatccaggaagattgggacctgcttgtctctttgccaacacccagctctccttgctcccttactctgcatccacaccaacctcagtgagagaggagagagcaaagaggcatccagatgttagtcattactccatcaccactgtcaccattgacagatgcttactgactgtgaaaagtctgtgctgggtattgcaggagggaaattatattattacttctttacctggccactctaagcattaaataaccctaaatggtaagtgcctgataactggcagtgtttattattattactgttgctctctgcctgtcagaagctgatgattgaaccggaaagacaagaacatagactcaggccaggcacggtggctcacgcctataataccagcactttgggaggccgaagtgggcggatcacttgaggtcaggagttcgagaccagcctggccaacgtgatgaaaccccgtgtctactaaaaatacaaaaattagccgggtatggtggcacatgactgtaatcccagctactcaggaggctgaggcagaagaatcgtttgaacccgggaggcggaggttacagtgagccaagatcatgccactgcaccctggcctaggtcaaggctccatcttaaaaaaaaaaaaaaaaaaaaaaaaagatagactcaagtcttagcacatcagggaaagtgtcatgtatagccagtgtgaagcgagtgataccgactgggtcttgtatggaacactttcctttccattcctacctttctagccctgttttcccctatataaggggtcatttggagctggagggcattccgaggacagggcgcttgacgtgagccttgtgggttgtcaagatttaaagagggagggaggaggaggcactccaggtcagggtgatgacaagacagaaggtggcggatgccacgcgtgcagtagagagagctagagagagcgcctggggagccgagagtgagaaggctgcataggatgaggacggaggcagagggagcacctgagaaataaggctgcaggatttggacaaaatataacaagcaagaggaaaccatcaaagtctctatcaaaatggagattgcgaaagggagggcagagtgacatctattcagagctgggagcttctcctacattttctgtttcattctgacagcaaccctatgaagtagatattggctcctttaatgcagctgaggaaactgaggctcagagaggttaagaaagttgctttaagtcaccagcaaataagttgctgactcaggatttgaacccagcctcagagcttgtgttttcagcacagtactcaagggatcctcatctgggagggcactgcaggatgcagtgggcaagatgagagccaggctcccctgattaaaaaaaaaaaaaaagcaaacaaaactgttggccctgcactgtgtacacccttaccctgtgctggagctcccaagagtcagggcaccagcggagccaggacatcctagaaggattcataaagaatttgatgtttgctattacaaaaaatcaaatactcattgtgggaagaaaacttgacctttgttggactcccttacacttattttatggtttgtattgcttttacttgaattgcatacaggacaggggaactgtaacagcatcagtcctgagtggctcagaacagctgcttctgccctagggacccactgagctgagcactgttggggatacagccagtgaggtcctgattttgaggtgggcggcatctcctatgcttgagacacaattggctgagtagcaagtagcgtgggcttccttggaaagaggcaaatgaaaaatgcagcagaacctgcaggtctgagaggatccgcacaccactcaccctgaacgcaaacccagagaaccccctcatcttccggctgaaagccagagcctcagctggtgtgattgatgtgtgttactcataacacagcctgagaaatcaggtgcaggaactgccctttttaacagcgtaacttgtttacacggattctatgtgagaacctatttaattaaggtaattatgcacacagacagatggtgatggcagcacacaccaacaccagctgatggcagtggggttgaggtcctgggacatacagggagtcttcctggtatggggtcccttgcacacatttggaggagagacacggcacttgagcacctggagagagaaaaaagtggggcctgaaagaggcaggagggaaggcgcagagacttgggtcctgaaagaggcaggagggaaggtgcagagacttggtggtggccagaccagcagcatcagcatcccctcggaactcattacacatgcacattgtctggccacacctgagacttgctgaatcagaaaccctgggggtgaggccagcaatgagttttagcagactccccagggggttctgatgcatgcttaaggttgagaattgctgatgtagagcatagcatagctgttcaaaacaaaacctgggtttattcagttttcacacttaactagccactctcaccttctctttcccaagcctgactttactcatctgtaaaataggaataagaacagcaaacctaccggcgtagcatatgggtgtcacagaatgggagcttctctgcttggttcactgctctgtcccagcacccagaaaagtacctggagcagagtagaagctcaatagatatttgctacattaataattcaataaatgtattcattgagatttttgatgtaaagtgttaacacagtgtttggcaggcataccgtaagtgcttttagtaatactgctgttattggtgatggtgatgattagttcctgttcagcaaaatgagagacttgactgaaatcactataacatctcttttagagaaggaggcaggtgatcagatccacagcctctgaggtttttaaccacacactaaaatatttaaatgggcaggggacaggggaagctgtcacttgggccacagaggggaaggtaggaagccgaataacatcagccacccctgagcctgggcctaccagtacagagccatgctcagccatctggagatagaaatgctcaggggtccccaggtagcttggatgtttcactggcccaagtgctcctatcagctgctccttagggcctgtggttttccagactgacttgtggaaagggcttgtcaaggccttctttactcacttcaattaggggagttcgctcttattccctgtcactctaggaaatactgaactgttgtaagcctacaaaaatcagctccttaggcaacaatgatactcttctcccctgaaatcaaagtggcagctgatcatgactttcattctactgaaggaataaatgaagaaacctagtctgggaccagattacatttattggccctgccccaaatacttctatttatgaccatctttgatcaacatcaaataaaatcaaatcgggctacaattcaacaagcttcagagtattaggccttccactgagtggccagggggcttctagaaccagaggcattcaaacagccctaaattatcaaggaacataactatagacacaacagagactcaaaactatggcaataccatgaactccatgctcataaatattcatttattaagtaaatacatatttatcaaacatatctaagtatataaaataaatatgtccttgtattttttgttaattacatgaaacaagttcttagcaaaatatatcatcaaattgactaaaaaagaaagaaaacacctaaataatgcagtcactactaaaattgaatcagtagctaaaacttctcagaaagaaaacctcatgtccaatagttttatcaacttcaaccagactttcaattaacaaataatagaaaatagaaaaaaagcttctacctccctgcattatagccttggtaccaaaaccagacaagtgtaatatgaaaaaggaaaattgcgggccagtctcacttatgagactatatttgcaaaagccctgaaaacaatattgacaaacaaaattcagtaatatagccaagcacggcggctcacacctgtaatcccagcactttgggaggccaaggcaggcagatcacctgaggccaggagttcaagcctggccaacatggtaaaaccttgtctctactaaaaatacaaaaattagctaggtatagtggtgcacacctgtaatccccgctatctgggaggctgaggcaggagaatcacttgaacccaagaggcagaggctgcagtgagtcaagatcgtgccactgcactccagcctgggcaacagagcaagactctgtctcaaaaaaaaaataaaaattgagtaatatataaaatatatccaaattgaactcatattagaaatgcaaagttggtttaacattagaaaaatctattcttttgacttaccagaaacaaaggaggaaaaaaagaccccatgatcatctcaatcgatgcagaaaaagcattctagcaaattcagtatctgtgaatgatataaccaggaataaaagaactaccttcatccaaaagaaattgtttctaccaaaaaccttctgccgtattatgtttaacaatgaaatgttaaaagctttttctttaaaaccaggaacacataaaggtgttcactatttctcagtacatcattgcactagtggtcctagcaagcaaaataaaataagactgttgttattcacagatgatttgatcgtttaaataaaactcaaccaaattagtgacttaataaaaagactttagcaatattgctaaatataagatcaatatacaaaaatcaatttcatttgtgtatactgggggctaaaagcaaaaaacataaatagtataccatttataatagcacccaaatgatatttggcaatttgtcaattaagttctgcctcagaattagggcaaactttgcaggttaagagcagtcccacacaagggtgctctcacctcagtcagttgccacaagcccgggggtccctaggtcacctgcacatctgacccaagagctacaaatttggagattctcatcttccctcggatttaatcattcacttgactggttcccagaactcagaaaagccctgcatttgttattatagttttattacaaaggattaaagtcaggaccagccaaaagaagagacctagaggatgaggtctgggaagctcccaaatgtgaagtttttgtgttctcaggacatgtcaccttcttagcacatgggtatgtatcatcaaccagggaagctcacttgagcttcagtgcccagagttttttggggagggtaggagttaggttcatgacctaggcatgattgatttaatcattggccacctaactgaactcaacctccagcccctctccaccccctggaagttgggctgataccacgtggctcaaagcccaagccttctaatcacagtcatccccatcctgaagccatctagggaccaaccatgagttgcctcattagcattaagtcagatatggttccaggagcccaccatgaataacagacactcctgtcactcaggaaattccaagggtttagaagcttcctccaggaactgagaataaagaccagccaaattctttatgatgtatcaggcagttagaagtaaatcaaacaacaacaacaaaatacctagtccctcttgacaaactctccatataaatacactggaatactctacaactgtgaaagtgaattagctacaggtgcacacatcaactgttgcatatatttcagttttgcaaaccaaattcactggcagcgctgtgtgattaatagtgacgcaaacatcagcactcttctgtggacccatctgctgagagtgggcaggacccaccaaccagggttgtggaaaactgtgaagcaggcagactttatcttcagagcccatacccacctcctgtgcctcttcccctcctcagagccgcacctccctccaagtgtctgggacatttgcattctctttgcttcctcagctcttcaaaaccctctcgggtgcattgctaagtgtgaaggagaaaatccctgcagattctctaggcgggagttgggggtgggggacagggaatttgcttctctagctattccactcaaagttgcaactgtgggttttggcccttggtaaaggaatttaagagagtaaggtgacagaggaggaaatcaaaccttttctggtggccgaaattctcaccagcttgtttaggtgaaggacagaaacacctttcaaaaccacaccagctccccctgcagccatgcccttcacgtgttccctcctctaaggaataccagggacctctttgcaaactctccagccctcgagatgattttcctccgcctattagaacatgggccctaccatggattagattacttcaaagaaggttcctagaatatgtttctgctttccaagcttaaattctaacaagacacccccacccccacccccatcctccttggccattatcctcttcttttgcccagcttactctggtcagggccagatttaccgtggagtccatgaaacttaaccccaaggcctctcctttgcacaaccctgaccaaggccctgggagggaccctaaccttgtgttcacatggtcatgtgtttttgtaatattcacaaagcaagttattttgagagcaatctgttagcaaatgggctattgccattcagactttccctcctgctggatgccgcttgcttggctgggcatttgggggagctgacttaggggaggttgcagtggagatgcttttagttttagtgggctatgtttacgtggtttgcagttacttctgtatgtgcagttaggttactgccagcattgtggtgtaggaataacttctagaaatcctgctaaggcccacggaatcaactcatgaggtcctcatgcaaacacggcccaccctacaactcataacatgtgactgcaactaggacatcatcaacaacttggttaatgagtgtcgttaattcaaagagaatagaagttgagtcaccacataagaaaattagaaacgccccccaaatcttataggtcatgtacaaaagaacactaaatagaattatttcccaaatttgataatccagaaaacttataaggtaaaagaacttataaatatcagccatacaaggctgggcatggtggctcatgcctgtaatcccaacgctttgggaggccaaggcaggtggatcgaatcacttgagctcaggagtttgagaccagcctgggcaacatagtgaaaccctgtctctactaaaaacagaaaaaattagctgggcatggtggtacacacctgtgttcccagctaccagaaaggctgaggtgggaggatcgcttgagcccaggaggcggaggttgcagtgagctgagatcacaccactgcactccagcctgggtgatggagagagattctgtctcaaaaaaaaaaaaaaaaaaaaaatcaaccattctaaagtatcaaccacactagaagaaagacttagttatctttttaactacctaactttcaaagactgagttatctttcaagctgggcgtggtggtgcatgcctgtagtcccagctactcaggagcctgaggtcggaggatcacttgagcccagaagtttgaatctagcctaggcaacatagcaagaccctgtctcttaaaaaaataaagaagcatattacaaaattgtcacagaagagaagatcagagattatgcagcatgtttacatttgctgccagcagtttgccaagcagctaattagtaaaaatgttatttttatgaatggtgtggtgtttgtagtatttgccagctttttataatttttaatttgctgcagttccttttctgattaaacataaatattcattttcatatctaattttgtgttcatgattttgtatttttaagaggctccccaaaccaagatccaccctggccccttttctgtttccttcttcatacagtgactgccccatcttcctgccctcatctggtgttgactgtgccctggtttcatgatagtctttgcagttgaaccagcatacttactgcccagagctggagtgtatgctccctgaagacagtcccctgattcagagtaccacaaacagggccggacctactggaaacactttataaaggcctgttaaaagagcatctgaaatgagactgtaattctctcgaacaggtgacccgggagctgcctcccagtatgtgggcacttcaaaagtggtgtatctgcctgcaacttgcaggttttcccagaatacaagagtttctgcagaaaagatgtggttccctgtgaatagtgtgatccaaaaagacctttcccaaagtcagggtcagacagggttactgagccaagagttggatttggaccctaacagaagcaactctggagacccctctcaaattgatctcaagacctttctgctgccctcctccccatgctcactccccttctccatccccactgcctgtacttcttccctgcctggccagcctgggcagtggtctcagtgctactcattcagcaggcacctccttcctccagtaacctgcactctccaccttgcccagcctccctttcctaaccaaaacatccctgcttttccaaggggccagagcctctgtggagtgaaagtagctggcatttctaatggcttttataacacgcagccacctgccttcagcatcttctgtctgcaggcaccaggcacaccaagaggtcccagcactcaggggctctcaggataagtgggggaggcagtgcgcctccattcacacagagcattcagcaggcgccataatattagtcttgctaacagaagacagtgggcttaacaggtcagtatgtttcctctcccaggtatcgagttgatatgttgacagggaccttacccagcattcctcacagcctgtcctgagaaagactggtccccatgatgcacttagaaaaaagtggataagtggtcaaagaggtttgacaagcactacatactaaatccccatctagaagattctgagactttataaataagcttcactggttgttgccagcctgtcccaagggtgtttgggcacacatcctatctcccctgctagctattaacatctttggaatatgaattcatttcaggaaacactaccttactatcttaactaaaaacagcaagtctgtaggtgagactcctgcacccagacaggcaggtggtcaagttcaggaggagcagggcatccccagtgttccacagggagctacttcctgcctacatttaggctggaccaccaggagcctcctccttccccacacctgccctttccaggcagaccttgtgacagagagacttttaaaacttcaggtaagctctctagggcccattccattccctcccacgccatctgtataatgagtctacctggagactccaaaatctgtcacgccctccagacccatctaagttctacctcatcccgcatcagtagaaaaaagaaaggccagacacggtgtcttatgcctgtaatcctagcactttgggaggctgaggcgggtgcaatgcttgagctcaggagttcgagaccaactggccaacatggtgaaaccctgtctctacagaaaacacaaaaattagccaggcgtggtggtgcatgcctgtagtcccaactacttgggaggcaggaggatcacttgaacccagaaggtcaagccactgcactttagcctgggtgacaaagtgagaccctgtctccaaaaaaaaagcaagacaatcatgtgtgtctctctcttatttctcctagtctactgattgcatcacaagcattgtgggtcacattccagagccttctgagaagggagaagtcagggaagttccttttgttcttctgagcgttctctgcaagtcaaactggggagagttccagtcctgtggggtgggagcagctgtgaagaggctggaatcggagggaactttggggcctggaggcctaatggaggactctgtgatgttggactatgttgtgtcgttaccctccctgcctctgcatcctcttctgtggagcagggacaatgacagcagccatcctgggagagcatcatgatgaccaaatggaaggaaacagagggtgaggagcaccccaagcacatggtcagcacctggcaggtggctgttattattacccactcctcaaaagtgcttttggactcacattttctttctttctttttgagggtggaggtgtagagaggtgaaataaagctctgagtctgacctccaggttggtcccaggcaagattagcagcctgaggggtccggcttccacacggtagcatgaatagcatgttcaatagaaaaccggacccataccccacacggcagagggctaggcttgagcacagacactacctttgtcctgagatttctacatggcaatgaaacttcgagctaattttctcctgactggtggtcagttcctgaatttcatgggcatatcaatcattcctttagctcaacgtttttactccattcattcacccgattgtaagtgagcgcctatcttgtacagaggtgcactgcagacagagggaaaacaactggctcttgccttcaggagccctcgctgcctcccctgctatagagttaatgaagttagatgaaggggtccaggaggctgtgtgaacacaaagccttgccagctaagtcagagaggagggtcctgcagtaatatccccaaatgtaaaatgaaaaataaataccttcaacagggttctcaggaggtgagctgagctactgctggcaaaatcccttgtacagagtggatgtcaacaaatattccctcccctccctaatgtgctctcagttatgtacctggatgttaataagggagctgagagaaaagtttgctaggagggcggagaaagtttccaccctcctcgggggaagaggtcggggacagaaaggggaggcctggggctcagagaccaacgtctcatgtcttctaccacatggccacgtggctcgccccttgactcactctggtctctgctcgaatgtccccttacatgagaggcctttctggaccacccaccccatcactctctatctccttaccctgctttatttccattccttgcacttatctccactagacatatcatccatttgtttgttcagctgtctttccatccaaagtgtgcacctcatgattacagggactttgttttgctcactgctgggatcagatctcagctctgccaattattagttaatttgatcttgctcaagttagccccatctctctacctgtttcacagggtcattttgataattaaatgcactattaataaagcagtacttggcacggtgcctggcacatcataatttctcaataaacgatagctattattatgatcagtgatttttcagtaaatttttacttcctgtggttcagccatctggggaaaacctctgcggctactcaaggatttatcttatcctgaggggaggtagaaatagaaacctgtactcatccaggaaccatgaaaatactacttacctttccaaagcaggtgaactcaagacctctagagatgctggttctcaaatacagctacaccttggagtcacctggggagctgtaaaaaaatcactgatgcctggttcccacccccccgcctccgcccccacagattctgatgtgattggcacagcaggagtcctgaacgtcagtttttttttttttttaagttccctaggtgcttccagcctgtagcaggtctgagagcccgtgctctagagtgccaccagatttccccttgaaagccagcgtgacagatgtctatttgtggcttgacagttaatgcatcttactaaaagaagccatttgcacaaggactggcctattaaaaattaatcactttggcctagcagggcttctcacttaaagattgctgtccattgtcatgcagcaccccaggatgctaatgccccacagaggagaacttgtagcccctccagcagcaaaatcagataaggaaactgaggcagaagcagcccaaccaaatcatccctccacccacctctctacccagcccagccactggtcctggtgaggatggtggtaatggagctgccagtcctggtacatcactgaacaaacagaacatgttatcctgtctttgaactgtaataggattcagagttcttgatttggaccccatgaggataatgtccaaagcttttatcagacggtgagctctagctgaattagaagacaaccacatttcaccgaagtgctttttaaaaagaagcccaactccattgctcccactttcctgctgtttaaaagtaaggagaagtacattacgctaaatgaaataagccagatgcaaaaggacaaagcctgtatgattctgcttctgtgaggtccctagagccatcaaacccatacagatagaaaggagcatggtggttgccagaggcagggggcaagaacaatggggagtcattgtttaagggggacagactttcagttttgcaagatgaaaagagttcttggctgggtacagtggctcatgcctgtaatcccagcactttgggaggctgaggaggcaggtggatcacttgagctcaggagttcaagagcagcctcggcaaaatggcaaaaccccatctctacaaaaaatacaaaaattagcaaggcatggtggcccgcacctgtagtcccagtcactctggggggttaaagcccgaggatcgcttgcaagtcttactgggagactgcagtgagtcatgatcgtgccactgcactccagcctggtgacagagtgagcctctgtctcaaaaaaaaaaaaaaaaaaaaaaagttctggagatggatggtggcgatggttgtacagcattgtgaatatacttaatgccactgaaccgtatgcttaacagttaaaatggtgaactttatggtatgtgtattttattacaattaaattttttatggcaattttattataatttttttaaagtcaaagaaagtgaccacacagggcctggagtgtccaacaagggcctgcaggcctatgggaatttatatgagcttttggttgatttccatggaaacctgggaagagatggtgaatttcaggatctgtccaggatcccccagagggtggagtggagaaggggcagccctgaaaggggatcagcagatcagcatttagggcatcttagaagtttatgaaaattcagtgcagctgatttagccaaacgatttcttcacccatgtttactttagctgcgtaatagaacgtgccagatgatttcccagtgattgcgatgtgagccaggctttgtgatgtgttccctccctcaatttgagagagtccctgctgcatgctttcctgcaaatgagtttaatggaatgagtttgctatttggctgtggtattattcctttttaaaaaaggtttctcacgtgcctcatatgtacattggcacaaataagaattatgccttcagagggagatgactacagaagagaggctgtatatgtctgcttcagcgggacctctgggaggatgttgttcttctaaatgatcttttgatgagtgtctgtaactcaaagaattaacccctattataggtcagtctgctgctcggtttgagaaatctgcctggcctgtaagtaaagcaaatcataatttcttagggcaggccagtatcataaagaccatctaggaacttgctggtccaagtgtggtcatctgaaccgcaacatcagcatcaccttgtttagactgagaaatggaatctgcgcttaaccagtcgaggtcctcaagggatctgagagcaccccaaagtttgagaagccaagctttagggtctccaccaggaagacggttttggcacatctctccacgagactgtctgttctgtgcttggaccctctgcttgtctagacagcccaggcccccacagaaagccctggcagccttagaagtctctcttatgtgcgaggcagtggagccctctattcaggtcaaaggagctacatctgcacagcctggggttgaattccagctgtgccacttataggctgtgtgagtatggacaggctgcttacactctctgtgcctcagtttcctccctgtaaaataactatgatgagagtccctacctcatgggattgctgtgaggatgaaatgagttaatccatataaagcagataaaactgtctgaggagctcaataaatgttagctggtattatcatgttgcatagatttctgtctcacacattggctctcggctgtccccagagcctcagagaacaagcttagctcctcttctacatgacagccttgcaaatgtctacaggcagctctcacgcccaccccttccatgtcctccagactgaaattgccaggttctcgtgtgacaggcctttgatttccactgctcctccaccgggagggctcctgggaacccagtcccctgaaagaatcacagtctccctgccacagcctcacttttcccctaagtttttcttcttccaaggaagtgcagtgccaggggccttcctgaggccttcctgagtccattaatcccctgctctccagactgcccggggaattgggggaagcgtgatggggtggagagggagcacagagcctgcagcctccttgctccaccagtgcccacctgctagtaagacttgcaagggccccactaggggcgcaggcctgcccaggctaattagaaaagcagagacacacatggcccttctgcaacctacgctgaaacgccttccgcactaggagggggcattcgcctcccctggggagctcattcaagatggagattggaggactccaagtcggcagctctgagtggtctgcacattcacaagcacatctcttggagtgcttgtgaattcacaagcatgtcattggggatgggggaaggcctggcagtatgaaagtgatgagtgcaggagccagacacccctgaccacttcccagttacagcaccttgaaccagtcattttattagtctgtgaagggcctgcatcaaattcatgtaaaatactaacacagtgctgggcacagggtaagtcccacagaaatgttggccatgattacttcctggtccttacattttttccatattaacatttcatctctctaaccatgtgaaatgctctttgaagacaagggatgatctgaatcattttcccatccttcacacagggacagacaccttaggctcccaggacacattgcagaaacttctggttgggaaggcgaggctgtcagagtctcttatcatcctagcctggaaacaggggcagccctaaacattgcttcagcatgaaaggaaaagcaacccttcccaccctgtcctcatcccccagagctaaagttgactgggcttttattcttggagaatgtcatctcatttaaattcaccataccataccaggccaggcacggtggctcatgactgtaatcccagcactttggaagactgaggtgggaggattgcttgagctcaggagttcgaaaccagcctgggcaacgtggcaaaactctgtctctacaaaaaatacaaaaattagccaagcgtggtggcgtgtgcctgtagtctcagctacttgggaggctgaggtgggaggatcgcttgaatccgggaggcggaggttgcagagagccaagatggcaccactgcactccagcctgggcaacagagcgagaccctatctcaaataaataaataggccaggcgcggaggctcacgcctgtaatcccagcactttgggaggccgaggtggacagatcatgaggtcaggagatcgagaccatcctggctaacacagtgaaatcccatctctactaaaaatacaaaaaaaaattagccgggcgtggtggcaggcacctgcagtcccggctactcaggaggctgaggcaggagaatggcgtgaacccgggaggcggagcttgcagtgagcagagatagcgccactgcacgccagcctgggtgacagagtgagactccgtctctaaataaataaataaataaataaataaataaataaataaattcatcatacccctaagggattagtaggcacattatcattaaagggtgtagtagaaagtttattggattgagccttctcccccaaccttccaactcccacacgcaagagatcaggcagtgggggcacagcaagggcaggcacaggagacttggctccagatcagaactggtgcccacccagcacgggcttgctggagcagctgggagtgcccacccttctggagtgactttgatccaggctgttctgaattccctggcaggcagctgggatcgagggctgcttccctgctccctctgcaaagagaatgctcagagctttaattataccttctctctatccttcaggggcccctaattatgctcctcacagggcagctgctgctagattatttcccaaacacctctgaagcttttaaagtcaaagcctcccatgggctctgcgtgactctaaagggacagcaaaatgggtggatgggagcaatagctgacgaaagtcccaaggccccttaaaagggtctagaaaggaaaccatgttcatctgcctcccagtgggaacaaggtggcaggaggaaatagacgattaggaaggggccactcccatcttgtttcttgtgctctgagtggtggtcacagagaactgtgggagtgtgcacttcatgtcttctcagagcagtgatgttacaaagcctcacacaagaggctggccccagctggcctgcaacagccgcgtgcagacgcacccacttgtgcgccaagtgtgcctgctgtcctgctcactccctccttggccaccctgtgcatgggcatgccctgcctggggagaccaggtctgatcacagagacatgttcctctctacatccaaaagaagctgaaactatcctcaccctgcaggcttgggcagagggctatttggagattttttttgagccaatatacttattgatttatgagctcttttaataaaattgggtctcgacttctgggtattctttaaagtttttttttttttttgtagaaaattatcctgaatttcaccccatccactcgactgcaactcctctcttgaattctgatcaccagtaccatgttgtgggccccagagcctctcccattcggacacccagggctcagctcagctgacagcagggccctggtccactgtgtctgcccccagacctgggaatggagcttcccatatattcccatctccccttcctggggcttctcttgcaccagcttggcagaagacactgcaccttcccaaattcttctcagccttgtggcttctgaaacatatcaacaaatcccctttaagtgtcgggcacagtggctcatgcctgtaatcccagcacttcgaaaggccgaggtaggcagactgcgtgagctcaggagtttgagactagcttgggcaacatgacgaaaccccatctctacaaaacatacaaaaattaactgggtgtgttggtgtgcgcctgtggtcccagctccttgggaggctgaggtgggagggtcccgtgagcctgggaggcagaggttgtagtgagccactgttgcgccactgcatgtcagcctgggcgacagaatgcgagaacctgtctcaaagaaaacaaaaacaaacaaaaaatccactttatgtttttttaaagagtgtgaagaacaagtaaccataggaagatagctagtagttaaaaattcagcaggctcttgtttttcattaaaaaaaaaaaaaaggaagagctggaaagcaactttcttagctcctatcatgacctggtctgtaattctggcccaagggcagccttacccatgtcaacatctttcttttactttcagagcaagtgtttcagaagaaagccccctgtccccactgttctttaaccctagactctgaggagaggcagatgtcaattccagaccattctgtttcataaaagactgtgcatttacatatcagagaaaactcccctgaagctacctcccctctgggtactcttgctttagtcttttccctgacaatctcaccctctgactgaaaataaaaccagactatttttttagaacccacccacctaaaaatgaacttctacagacagtatttggcttgttcctgtaacttttagaatcgaacttaaattcctaacagcctactgtacacacaccatggatgagtctcagatgcattgtgctaagtgaaggaattcagactcaaaaggctacatactgtcattccatttatacagaaggtaaaattagagagacagaaaagagcagttgctaggggctgggactaggggtgaccaaaagagggcatgaataaattgtttgagatgatggaattgttacgtatcttgattgtgatggtggtgacatgactatgcttttgtcaaaactcacagaactggtgaattttaccctatgtaaattatacttcaataaacttgacttttaaagcaattaaactcttataaaaatgacattggcccatcctttgttggaacaagataaggcataagtggctatcaacttatataaactccacacccaccttggaaagtggaacctggaccaccttgtagtcaagtgtataaaagaagaggatcagtggtccctgcagaaggtgcctaaatttgggaggaggttcagaccatatgagatgtttccttttcattcattcattcaacagttcagcagtgtttactgaacacttcttaggaggcatggggctgggctatgcgcagtagctgcataacaagacacagctgctgcccatgaggggcgcacagtctagtggtccttggaggggtggggatgcagagaagtaaagaaacagcaacaaaacaaggaaacttctgagaggaagctggcctgagcgtgtcagccggtagcacgatgagtacggggatatccctcatggaatgtacactgtcaaatgcacaaaggacagaagaagagggcacattctacaaattttaaggagttcattttggtgagagtattgaggccagcgtatgggatgctctatgatttccagctgaagggtgtcttctgcttttcctccttccttctaccagtttgaggctctactcggaggaaatatgtgccacagaggggaggaaactgctgtcctttccaaaggttttagacatttaataaatctttgctgaacaaattaagggatttcagattaataggtcaaaagctcctgggtcctggccttcttaacttttcatctgctttaacctgagactgtgatacttctgcatcagtagaaaggaaagtgtgaatgctaaactgcgaagtaaaagaccatccctggaatctcccattggatctccttggtcctaactgtctcgccttgacccccaatggatctatacattttttttcttacattagaaagactgttctagggaattcaaatggacatttcccagatgtcactcttggcccagttttctgaattatgtagaaaacaatttctaaattccctgggtatattttcctaaatcatatatgggtatatgtcctcgctatataccataaggagggagtccatctcagaccacaaatcactgagccatgggcaaaatcagctagaacatttatcccccagaaagacacagtcagactccgagaatctcatggaccaacgaaagctgtgtccactttgttgttcaggactgcttccacatagcattttcctgcatccattatgaagatggtcttatctgttctcagcaagagcctggtgcctggctttgtggcagcattaattctgatcttcagtgtcaaagcaaccagcttgagttcaagcatatggctaattctgagattcatccactggatacagaaaacgccagagtctcatggttactctgttgctagcagtaatgaacttgagcagggctcctgtttctccatcttcttactagacaagggcagagttacatcaaggtggggtgggaaatcatttcttctaaaatattaataacctgaattcctttctataaaggagaaccctcggatctcgtaagattctctcaccaaagcatttcaaccccacaaaccaggcccagcccctctaaccagacgtctgttcactcatgctccttcaagatcaatgggaaaggggcaagaatgaaagggaccctgaaagaggtctgtttcatgggaggggaaactggaagaggcgtgggaggaagggtatccaaaaatgactgatcagtggaaccagaaattttgtctttcagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggtgagttgctaactatgccaccttccttctcatctggcgtcgttccatagaaaggggaactgagtgcaaaacacttacaatcacaaaacatgctcatcttttgctgaaattacttctgtggcttttatgacactatttggaggcaccttattatattgtcaggcaaaaatactggagaggctaaaaaaatagtagccttttgagcacagaagtttttgcaatcaagtaactactttgctatgacctaaatgcttgtgttcccctaacattcaaaggttgaaatcctaacccccaaggtgatgctattaggaggtggagcctttggaaggtgattaggtcatgaggatggagccctcatgaatgggattagtgcccttgtaaatgaggctggagggagcttgtttgccacttccactgtgtaaggacacactgagatggcatcatctatgaagtatgggcctctcaccagacaccaaatctgccagctccttaatattggattttctagcctctataactgtgagaaataaatgtttgttgtttatatgccacctaggctatggtactttgttatggcagcctgaatggacttagacacacttctactcaaacatcttgagactgatggctgcaaacacacccaccctacatttttagccccttcctcctccctccctgccactgttccctgtccttcggccacaccaagtgacccactgttttcctaatctatcatcattttttgttcactttggcacaaagacctccttctctgcttagaaaactcctagtgaaccttcaaaacccagcttatgtcttgtcctccatgacgtctctcctaattccccagggcatgagtcatccttcttggctctcccattgcacttcatactcattctcgcactctccctctttgctaggaagagcacttgctctcttcactccctctcttccattctctcctcactctgcagcatggttcacgccccctccatctgtctgaagctgttcccacccaaactgccgtgttcttaatccagggaacccatttcagcctcattctgtagcagtagtcagcgacgactgtcacctccttcttgaaaccctcttccctgggtctcctcctccctctctggcaatcccccctcagttgcttctcacccaccatgagctctacttcctctgcactatgtccctcagcccttcccaagtttccacactcagccctaaatgctgctgtcacttactcaaagaattttcatccatcccctccacccaggctaactttgtagaggctggaagcccagaaatgttccaaaccaccgttggtagaggaccatggtgaggccagtctccacacgctctggctgcagcatgagccccgtgggcctgcctccttgccacctgtcctctgcctggattccatgcccctacagaactccgggcctcatatccggtcctcctggctgacctctcttctcagtgcttgcagccccgccctgtcctcctaaccatgctgtcttggcctcagcctccctgtgagtgctctccccacctcctcagcctgccctgcttctcctcaggggcaccgtctcccctcagctctgttgagttgaggccatcctttctcccatgccctgtacacagagcgggatagagcctctgcatcctccttgctcaccattgcttgcctgctattaacaaagcagccctcctctgtggcctaccagatggcccctcttcttctctatcttgtcctcccgtgccagcacctcatctcatctcccatcatcccccacactgaggctgttggcacctacgtcatggcctccctctccacaattggtcccacatcattctggctgtgaggctgatgtgactcacttatctactatcctgacacagagccccacatcctcagttcctgggacactcactgcccttgttgtcagcctgtcctccccacatccaccctggactttgtgtcatcacccagagctgctcaggggaggagagatctgaagcgagtatcagagtggcagacgctggggagctgagtgtccagggaatggaaaagggcacgaaagctggaaggcctgagaagtacccacccacctccttgcttgatcatgactgcagtgtggcccagggggagcgtgttttctctgggcaatcagcttacaggaggcatggccagcactcatggcctgcattggtaggcctaggctcctggggctaccccacccttccatgttgggaagggagggggagagtgagggagtaggatagccttaccccagccccctttcagaaccccaagacctagtaagattccccccactaaagcccctgaatcccacaaaatataagacagcagtggcccttctagtatcccctaagagcaaaggtgtgtccttagcatccatgtgggctccctccaccctgaaatctctgtctacaaacctgagcctgcaagtggcagggctaatcaagattccctgtggccccacggggagccgacaatctcagttgctggcctgttgttcttgttcactgtagagtgaccacatatgggcagctggtgtaataattagctcatgggcactgcagaccacctaagcccacaggtgaaaaggagctgcccactcacctgtcaaagcccctggctctcacagctgctcatctgctgtgtgcacagaacatagtgctaaggatggggagagggattgctgtgggacaaagggacagtgaggaggcagggggagaaagtcagacaagggcctctccagggaacttatggtcttgagacagaattttagatgccagccctagaaggggcccaggacagcccacctcttttttaacaggtgatttggtttcaaataatgcagggtgggaaaatgagcccagagaagaagaaatggctaacagtggcctttctgagggaacaccagcaggacattaagagaaagccatgtctgaatagctaagaaagtctttattgtgttttgtttttgagacagtctcgtgctgtcccccaggctggagtgcaacggcatgatcttggctcactgcaacctccaccccccatttcaagcgattctcatgtctcagcctcccgagtagctgggattacaggcatgtgccaccacacccagctaattttgtatttatagtagagacggagttttgccatgttggccaggctggtctcaaactcctgacctcaaatgatccacctgcctcagcctcccaaagtgctgggattacaggcatgagccactgcacccagcctgccaagaaaatatttatattgggcacagttaaatcttaggcaccataggagcagatttatctaataaggagtaatgagagacccagaaaatgtaatctctcaatcacagcaatgagggaattattcagtgctatgctgggctagtcactctttcattcatgatgctaacttcttccagtaagtatttaaaatacatgctatatataaaacatatattaatatgatatgttaatattaattatatgttaatgtaacattaagtaacaagaaaaggtaaaataggttgggcatggtggttcatgtctgtaatcccagcactttgggaggccgaggtgggcggattgcctgaggtcaggagctccagaccagtctggccaacatggtggaaccccgtctctactaaaaatacaaaaaaattagctgggcgtggtggcatgcacctgtaatcccagctacttgggaggctaagacaggggaattgcttgaaccaggacggtggaggttccagtgagccgagatcgtgccactgcactccagcctgggcgacagagcaagactccacctcaaaaaaaaaaaaaaaaaggtaaaataaaaacaatggcaggaaagtcagatgaagctgaagtcagggcttatgtccaaacatttaggccctgagtacaaacgtcttcatttgccccctggactctcaggagcccctacagttttccctctggtggattttgtgctttgggtggatccttgaccacgtgctggggatacaagtctgagtaagacatagtctctgtcctcaaaggtctgatggtccagcaggggacacaaaagggttaaaaacaaaacaaaaaaaaatacacagtgaacctatctgtgcccagggtgagccatcctgctatcttatttttccaactgaaattgcacagacctcccagttccgtattttccagccaattcaaggcaggggagaaaggaggaacaggtgggagggaggtctcgccctggactctgactcaaagactcttcccaccctagccatagccactaaaccctggatggctcaacatctctggccctgccaccacgatctgggtcataggtgcctggctgcctccgttctcccagccttgaaccctcagctcacagggctgtgctccagctgcccttccaacaggctgacaaccttcaggccagacggagaagagctgggcttctccatatcacagcaggcaggtgactcactgagagcccagacgagactgtataatccacagtctattggcctctcatcttcaggctcactgtctgtggtcacgagatggtcgcaatcgctttcaggttctcatgcagaagtgtccaacgaagaaaggtagggaggggtcagccagggcagccaaacagctctcctcacatttctctcttaccagggaggaacaccttccccggaagtccttccaggagattcctgtccctgtttgattgaatcacatggcctccccttattgcaagagaggcagggaaggcaacagctggtgtgacatggaaaggaccttctttcagtaggaaagggacattgaccatagtatcctccatgcttcacaccttctcccattttcagtggtggcttagtagactcagtgttaagatgcctcccccaagtgacgtctgtcacaaagaatcactcacggatgattaggacgtaaatccccaaggtggaattattccatcagcttctctcaaagccactcttccccactcctagaagcaaaggaagtcaagagttattaaacatctgctacaagcaaggtatttctcccggagccttcatctgccaacacacttgactccttataatactcattccaagtataaataatcatcctcattccacaaggggtgggggagctaggtctgcctccagggctgtctgccaccaaagctcttgctttccgccccaggccatggattcccagggaggccccactggctgcctcccatatgacaccattgatctcgggcaggagcagacaagtgaaagaggctcattctctgcccccacccccgctgtggttgaagaagctactccaagcagaaggttgtgtattactagtttgtgtgtcacacaggagaggggtcaggggcttgggagcaaggtcccaccatctctgtctgcagcttgatcacccattgacctcatggtcccctggtgggtggtgtggagtacacatttggagagaggaccccacagggggcttccagagccctgaactgacccaatgagtccactgcagggagaggccaaaaggacctcttcaggagagagcctgaggctgcaggcacttcttcggtcagtattcacatgtgcttagggccacacagggaactgtgggggcacctgggagagccctcatcctaggctggatgactggaagactggaatcccatgggaattcatggcaaggggagggccctctgtgcagctggatgggcagggaagacttcttgaggaaggagaggtatggctgaagttttaacctagtacagctaagtggaaaggcaactcaatcaaaaaagagaaaatggaagtacagaagaacagcctggaggtcagagaaggacagcaaggagacccatctgtccagagccagaaatgccatacggtggccagtggttgtctgggtgtgggaggtgagttgagtttctgagacaaagactgaagcttcttatgaatgaaaactatgcctcaccgattcccagcagtcagcgtgatgcctggcatggagaaggtgctcgataaataactatttatggaatgagggaataaatgaatgtttgagtccatcctgtcccaccaaagtgcccctgcaaacctggcatagcctggcctgccttccttctcccaaggatcacagaggccatgtgctcaagatacatcccaaacccaatttgttattcctgatttgtttttctcttgaaagtttcctagatggaaccctcttaattagaaaccaaaaggtatggctcattcccagccttaaaactgtttccttccccatcctagtaaagattgtgcagagaggtctatgggaagttgcacttggaaggccttgagccaggctgttcccattctttagtgctgacttatatccagctggtctgagacacagaatgctaggggaatagatggggccttgcagactaccagattcaactccctttttctacttttgacaaagccaagccccagagatgtcagccacctgcccacagttgagcagcaaatgaagaccagaaccccggtcccagcccagtgctgccccactgccctgtgttgtccctcccagaacacctggcactgcttttgggctactgcacaccacagccccttggacagcacacttaaccatctggcattgcctccccaggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaaggtacctgagcctggcagccaggccaagtgtcctgggaggatgagctaggctccaccttgcggggtagggggcaggcaggtctccttccaaaagggcaaagcatggtccttggatataaaagtcaaggctcccctgccagtgggcctttgccctaactacttccaagctgtggatgctgggcctcaggagtccattaggggcagtcattagtgttctacccttgtttctgctgccttttgcttctcatcttccttgctcaccttcctccctctctttccttcatcctccctcacatttttgtcctggaaggcttggtgtgctgcaaagaacaggagcttcctcagcctgagggcaagacccaggtcccattccaccagtgatgagctgtgtggcctcaggcaaggaccgcccttcactcctcaggcttactccctctactgtatattcaaggctcagcaggcctgggaagaggccaaaggctctagctgcctctagctctcagaggctcaggagacccagtctcggtgacagcatccctcagcagccgaaacgtccatcttgtgacaggtgcagaacaagggaggcaggccccaagaccacactgggggcattaattctgagctccatttattacaggacagaaatagaccaaaggtgatgaatctgatgacaaaaactcaggtgcggcacaggtgaaaggcgggctctggatgaagcagggttgaggggctcagtgtcctgcccacctgcctctcaatctccagacatgctcctgagaacccttccagaacccctggggctctgagcagctcagtttggaatccactgggccagaggaaggtgacaagattgtacagaagcttcattatctaagaaatgacttaaaaacatccggggagggtgagcctagggaggaggagtttctgaggggcggtggcttaggagttaaggtgaagcttgtacagtagcagataaccctgaaatctccgtggcttaacccacttacagtttattcattgtttacttcacatccaggcagagttgggagcatggatgggcaggggaggatgagtggctgtgcccgggacccaggccatcaggtctgccatcttcagcaggtggctttcaaggtcaccttgggcattcccttccagccaaagccaggggaagagagagcagagactcttgcaggaggtttttctgggtcaggcctggaagtggggtacacacagcacttccacccccattccatcagccccaggcacacagccatttctcactgcaggaggggcttggaaaggcaggtcagaagggtgccaggatggatgtcacatgggacatgactgctgccttgaaacagaagaggggaaatcgtgggacagagaggacatgctgctttggggaaaccactgaaggcagaggtaggccctagggtagaagttaaagggggatttaagtttgataaaaggaagtattttctggggcaggtgtggtggctcaagcctgtaatcccagcactttgggaggccgaggcgggcagacctcttgagcccaggagtttcaggccagcctgggcaacatagggagaccccatctccactaaaaatataacaaattagctgggcatggtggcgcacacctatggtctcagctacttgggagtctgaggcaggaggatcacctgaacctggaaagttgaggctgcagtgagccgtattcccatcactgtactccaacctggatggcaggagtgagaccctgtctcaaaaaaaaaaaaaaaagaaatgaagaatttcctagtgtttgggcttcccagaagtatctggggacctgcaggaggatcagctgtcagggagagggaagagcagattttcatccgtgatggagtctgtggagcagctttggggttggtactcgactttttttcttttgcgacagggtctcacttgtcacccaggctggagtgcagtggtataatcatggctcactataacctcagcctcgagggctcaagtgatcctcccacctcagcctcccgagtagctggcaccacaagcatgcgccaccttggctggctaattttaaaattttttttgtagagacaacccactactggcccacctggccaactactactcgtcttgctagaaacaagcccagggtgatctcaaactcccaggttcaagcaatcctcctgccttggcctcccaaagtcctgggattacagatatgagccactgccccagtggtggtactcatcttttttaaagatgatactgcctgcctcaatctttacagctttaattctctcatttccttgtcaaaaggtcaagtcatggctggggccaaaaaaggggccagaggcccaaagagagaaaaacctgcccagacttgaagctgggccccgcactagactggcccgattcttccagtcctaggaatttgtcaggcagatcctcttttaagtttgcaactccagacccagaaacacgctctgagcatcagactgttgggggtgatcagagttactgctgcttaactaatttgggggtctagggttacactgcagcactgcgtcctcctgggaggccagtgaccttctgaatccatcgatttcctcaatcactgatgaattttcttgcaaagagatacagggctggtgtgaggggcaggttaatggtgcaggctgaggcccacgagggagctcctcggagggatgggcagcctgggccttgagctcagctccatttctccctctccatgtgggctgtaacatgaggagccaagtcatgatttaagcggacctccagagatgccagtgctgagaaggaatccaaacttctaggctagtccttgcgctgagataacccagggcagagctccaagagcagagctcccagggcacccacccctgctcaagggaagggccaccagtgcctgtgtgcagagctgctatctgctgaattttggcatacattcatgctggttagcaaacagcctctcgcacaaggcttctgagtgtcccttcccttccccaggttcccactgcccagaactcccccttgatccagacatgaaaggactactgcttggcagagcaggggaattcagcctggttgttcagtatctgtaatatctatccatccatcaaggctgtctgcctttgttgaacttccaggggcagcatatggtaggaagagctctggattcggacccaggagctctgggctgtggagaccctgtcccacccctcgactgcagcattcccctttctcactaaggctttttactgctgcacctggcactccagcctcagggcttcctcaggagcaggctcctccgtcccattccagcagccccttaagccatgacaaagggaagttggtatataaatatcccagcttccctgccccgcaaggggaaccacctctgagtgtggcccacactgtctctggaggatcccagatgcccacaggagtaacctgtcatgagtgtgccttgttctggttccccctcactcccccacctgtgcttgctgggatcccccaccacataaactacctacaaccctaagccttgtctctggttctgtctctggagaaacccaggctgaggctggaccttgagcaagtcacttgatcctctgagtctgtttaattcatttacaaaatctagaaggcagcatctgctttgcctttgtcactggattgtgacaagggtcttgagaaagaaaatggctaaaaaccttttaacaaatgcagaagcacagacaccagcacagaatgtcaccgtgctgaggaatctccttctgagctcaacaagggcaacaaatgaccttcatgtccggctttgctccctgcagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtgctcgcagccctgggttccagagcccacatttccctgtcctcccatctctattttgcctctaatcctccgtgaccttcccctctgtctcccaagttgcatagctcattggacgacttctccagcttagcttcctgcctttctcttgtgcccagacactaccagtaaatgaccagtgtgagttgcatgtgtgggtcagaggccttcctttgtgcaacacccccagcttccctcaccatgactctactgaacatggggttcaatacagtgctccgcaaggatttagtgaacaccatggtaggagctcacttctagcagcctgggaacttgcccttgaaaagtaaactgcaacaaggcgaggcaaaaaaacaaagcagagattaccattacaaaacgctatctcatgtttcatgttggtaactcttaaaaatgccattaaaaaccaggttcggtggctcatatctgtaatcccagcactttaggaggccaaggtgggaggatagcttgaggccaggagttccagaccagcctgggaaacaaagcaagaccccatctctacaaatttttttttttaattagccaggcatggtggcacacggctgtagtcccagacactgggaaggctgaggctggggaatcccttgagcccagaagtttgaggttgcagagtgagaccctgtcaaaaaaaaaaaaatgccattaacgggggctacattattattgcccattgacacacaaggaagcttcagctgcaaggttaagagactggcatcatgtcacacccctgatgggcctctctgcaatctgcatccatgtcagacgctgctaagcaattataggaccatttcctgctaaactgggcttggctacagaatcctcaacaggtgtccctggaagccactaccaatgaatcagcgttgggtagaagatgtatttttaaacaatttctgcctaggcacgtaatgatctcttagatcttttcctgttctgacgttcttagatcaggcagctaaacatttgggcatcaccatctgctaattctgggagggagtgctggtagctgctcagtttagaaacagcagtcgagggctcaagcagctaggactccgagggggcctaactgggagtcccactgccgggggaatgtgacagctagttacataagtgacagatgagcaatttctcctttttagtcatttgacagatgatgggtttcagattaaggaggcactgagggagggccagggcgacgctgctatttttggacaggtttgctggcttgttgttgtcaattgttgttttcaagcattgccaacaaatagagattaatgaagactctgtcttctgccacccctggggcagccctgcccttgactgtggttcctgcggcagcttccccttcctccagagagcctggaggcaaagaacattggctcagggagagtcatcctatactttctgcgactgtggcatagggttgtgccaggaaaaactgtcacaggatttgttgctgcctgtccaccctgaccacccctaaacctggtgcacctcacctgtgctcccaacctttgccatcacacctgcccaagggaagaggatgacaaaggaccttcttgctgtgggcaagctccttaccctcttggaatgctagtttcccaactgtaaagcgggggtgataacacaaagtcccacagggttgctatgaagactacagataatgtatgtttggcacttggaatagagcagccaagggtcagcgtcttcacacactcttcctcctggaaatttctgcccaaggccactcaatcaaggaggcagggttcagctgtaggagcaattcctgccctagcagcgtcactgggaggcgggcagtgctgaggccttcctgtgcctctccagtcacactctgtgggctacagctgccaggtctatcccacacagccgaatctgcctctccttggtctatctgttgggcctgctcagggagtagctggctgcaggctgatgtcctctgtgctcctgcctgccccacaaccccagggttctaggtagagcacccgcacaaggaagggagggctccgccagagctgatggcctgcctgtctgcccatctgcccttcatttgctcttggctagctgacttcactctccatggctgcagagcagtcgaacggggcagaatgccaaagatcttcagcttctctggagggtgtctgtaatctttctgtaggtcccacctgccctgcgtcaatgcaaggtgctatggggcccccaagcagatccaccagggcaggggttctcagccctggctgtacttagaatcacctgggggatcttcaaaacatgcttaatcaggtccccaccctagacctactcagtcagaattggtggggggaagcagtgaggcagacatgctattttatttttaattcccctatgtgactctaatctgatccagggttgagaagcactcactggagccttgctcctcaaaatgtgggtccaatgcccagcagcatcagagcagctgggagcttgttagaatctcaggccccatctcagatctacagaatcaacatctgcattttagcaagacccgcaggtgattcgtgcatctatcagcttttgagaagcattgcacaggtggatcccctagaaagtttcacgaggacagggacgtttgttttgttcactgctgtattcagtaatgtctggaacagtgagtgctggcacatggtaggtgcgcaggaaatatctgcagggtttcgaatgcgtacaaaagaacacaagagttaagccgaacaatccatgtccccagctgagcccccaaggctcgccattacctgtccatcaccctcccaccttgagggatgggggtcgaaggcaggtgtgtgagtggcaaacagggattagagggcttggctccctcccggaagctacctggcttgggcatccaatcaccgctctgtttgtacccttgcaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaactt

SEQ ID NO: 715 - DNA, 29201 bp, Human; identical to SEQ ID NO: 621

SEQ ID NO: 716 - DNA, 25589 bp, Human
  misc_feature (1)...(25589): n = A,T,C or G
ctgggttcacaccattctcctgcctcagcctcccgagtagctgggactacaggcactcaccaccacgcctggctaattttttgtatttttagtagagacagggtttcaccatgttccaggatggtctcgatctcctgacctcgtgatctgcccgcctcggcctcccaaagtgctgggattacaggcgtgagccaccgcgcccggcctcatacctactttttaatgtcagtacagcaggttatggtatggaatgcattttggaacaagatattaacaaaaattcaaaggaaaaaatacatggccatggaattccagtgctgagagacatttgggaatattgggggagttttccaaaagagaaatccaggtgactgtatttgttaaatgagtaacaaaaggaaaaacaatgtaaagaaacagaaaggaaaggaagagagaaatacaaagatctgagaagagaaggtgccaggggccgctgagagattgccaaatgttaatttcattatttggcttcttattttattctgggtaaaggtagacctattagtttcctgttgctgctataacaaattaccaccaacttagtggcctcgaacaatgcaaatttattctttcaaagttctggaggacagaagtccaaaaatgtgtcctatcagctgaaatcaaagtgttgtgttccttctggaggctctaaggagaatctgttccttctcttttctagttctagaggccatctgcgttccttggctcatgtccttctttcagcaatggcatcatcactctgacctttgcttccattgtcacatctccttgactctgacccttttgcctccctctaataaggcccctctgattacactgggtccaccagataatccaggatagctctctgtctcaagatccttaatttaatcatatctgccaagggttttgttttgttttattttgtttttgccatttaaggtaatatatccacaggttctggcaattaggttgtggacatctttggggcgacaattctcaacctaccatacaaccggtacataaggttctactacctactaaatgcatcataaacagaacttctgatccttcaacaactctgtgaaatatatgacaggatttgcttttaaagttgaagaaatcaggccttggtgcaatttgggattctgcccatggtcaaatagtggggaggcaaacccaggtccctgaacccagctcaagcctgcctgcctcatggccatgcctccattcacctctccccttcatgtctacttcctctttcctgtctgggcctgttccctagctccctggacaagcttaagctgctgttttccagcttgtcatgtgctccttatgacagtgtagccacagcttgatcttggggattgctgattgagcaagctgagtggctgcccctcagaatcttctgttaggcctttctcttgccttcttttattcagtaagtgttttgagcttattgtgctgggtgctagagtagcagggaggacagacctaagttgaagattacgggacaatctaagtgacacctgctatctcagacagagacttcagcatcatagggagccagagcagggagttccaagccgtgggaactgtgactctttcttactgacccttaagcaaaattctaagctccagggaagcagaggcagcagcttgagctccctgattgaccagatatgattaatctttgtttctctgtgctttgaacatgactatgctccataaatatttaaaaattgggaatagggtgaagatagatacaccaaaaggagcaagcagtgtctgaaaccagcaaagacttaaaagttaccgaagaaggtgttcatgctttcattttatcttttttttttaacctagcaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcagactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagtttcaggggcattaacagtggagtagatccattgttcaggtttatttatgtttttcctcctcaacacaagccctacctgtaataaaagatccaagaaagataaaaccatggctctgggtttgtttactgactgtgagaagtattaatcaagtagaagggagagtttttcattattcggggagctcaagtcactggggaagcaaatgccttctgttgcctcaaataggggaaagggcccatgggctagaaccaccaggcttctctgccctaatcacttgctccctgggctgaggactggtactggtgggcagtgtccagaacttagacttggccaccaccataggtgtgactgatgaacatgagaggaaggagttctttcaaatcacccatgcacatagagagtggaatgactgaccatggagatttggaagggcgaggggggtggatgattagaaattacttaatgggtacaatgtgtgttacttgggtgatggataccttaaagccccaacttgaccactacacaatctatgctataacaaaattgcatgtgtacatcataaatttatacaaataaaaaaattttaaatcatatggctgggagtggtggctcacacctgtaatcctagcacgttgagaggccgaggcagacggatcgcttgaggtcaggagtttgaaaccagcttggccatcatagtgaaaccccatctcactaaaaatacaaaaaattagctcggcacacccatctctactaaaaatacaaaaaattagctgtgcacagtgcgcacctgtgatcccagctactcgggagactgaggcaggagaatcacttgaacccaggaggcggaggttgcagtgagccgagatcatgccactgcactctagcctgggtgacagagtgagactccatctcaaaaaaaaaaaatccatatattaattgttcaaatattgattgatggcctactatgtgccaggcactttgggggatatggcagcgaacaagacaaacatagtctctgcttccatgaaaatttaatccagaaagtgtcatcatttatgggaaagattgggggtgagggtaagaggcagaagatgaaagaggaaaggaggagagaggcaaagggtgatatttttggaaataataaagcttatatattacctgcatgtgattctcaaagaactctccaataatatggaataatattccttaaacatattatctcctatgacaatctcactgactatttgtagtaggtgaagaaaatatccccatttaaagatgaggcctagatttttctctaggcctagagagtgaccacgctcacataaggagcaacctgaaggagactgcagatcttctggccctcggtccagggctgttccacaatgtcattgctcctttgggtgtgaagacttgtcactttgataattggggggacaggaaataaaacaagtaagttataaaggcaagggaaggtcacttggtgctggctgttctccttctgactccttagagtgcatccttctctgttctgttctgtgtccttgaggctgactgctagactgcatcacctagactctcttgcaagctgatttctgcttgggttcatacaatgggagacactgaaaggagagatgtcagagagcagggaggaaagagaggctgggatacatctttcttgctccttccccactttctgtgatgtctttggcagtagctatgttcttctgtaatgctgtcttccctgaataaccccttcttcatggttctagctcccattgggcttcagtaacggtatttgctattcttatctcttaagccctaggggtgataatggcttcccatagttgttagcctgcagatgcccatcatccttgtttgttccgttaaccttgaccatatctctgcaaggagtcccttcattaaggtctcctcacatgacccatctggcttgaaggctgtttcctgctaggaccctaactgaacattcctgggctttgagggatattggctggaaaaggatatgagattatgaaagaagactcagtctacttgatatttatgcctagtgctagccctgagtgggagctatataccagtaatagatggggaaacacggggaagagatactgcagggttgtgggtcattactccaggaaatgtcaacataactccaatatcactttcagtgtgttgctttcatcaactccacagcctgcagttgactcctccttcctttgtgctcccatggctcctgttcacagttctgtaattttccatttacaaaaatcttctctttgaggctctccttaaagacagaaagagatatcttcatttttttcttatttctctggtatacctagtgcccaacaggcacttagtaaatgtttgctgagtgaatttatgttcggaggtaatgtccctaagaaatcacagttatttgactgggagccatagagagctcgggcagtaataacgactgcaaattcaaaactgtggcttactgtagttgcaggatttgtattaaaaaggtgtttcatgcttttacaactcatcttgttcttcatttcagcctgtgtgaaactgtgaattggcgatatgggtgggtgtaatcagactgggggctggcatgagatttctcatgcattgccatatgtgatttgtatgtttcatctcgacataaccaaggtcagtctcttgatattactcataattttatggctgtataaatctgctatatcaatctacttcatgaatggtggagtccttcacaggcgaggtctgatgatggataagctccctaagctgccaactgggttactgttaaaaaacagacttgcatattatctgcttagaagtgaccttgagttcaaagagttaacatgagaaaatatgggctttttctttagactttattagatagacttcagtctgtttccatggagctgttgccaaggtatatgccatagaaatttctccaagacaatgtttcactcccctaaggccctcttcttaattggcattgaatctatctaaacttgagaaattcaactaatttgtagatttttcttttgactagttgaaatatctgtctattctcacttgaccccaatcctcttaccccacagtattgctaagagctggaggaaaggagcctaagttaaagatcaaacacatgactctttgaacacttattttagggaactcaaattgagaaagatgacaaaggatgttttttctgatgtatgaatttatatttatcggggaaaatctttcaagagtatacatattaagtcacattttgttataacttcaaaggatcattttagaaaaataaaatttataaaatcgggattttctgggaaacatgagacatatagtcatcattgtgtacagagagtactgagggaaaaaagacaccagagctcattcattcgttttccaaaactccacatagtcctacagggctcactttcttactccattcacatctctgctcaaatgccacctgctgtggtccctctatctaaaagatcaggccttctcctctccacactctcttttctctgctttacttttcttcataatctttatctccacctgaccttgtattatatatgtatttattgccaatctcctgtctagaaattatctcacagggctgggactttcatgtgttcattgctctgtttccagcagctaggactgtgcttattggacattcagaaaagaatatacctatatgaagtgagacattggcaaccttcaaaagggtagcctcagaagagtagctcacaagccaaacttgtcacagtcgccacttttatgctctaagttcctgtagttagttagacatgtcattaggagaggggactaatggttcttgctgcacatagaaccatccatgaacatggcctgagatgtgtccaaaggtccccttaactaaaaatattgccacctacttctcccctcattcccacgatgctcgaaattctaaagagtcattcccaggaatcataatcattttgaccttattaaggcattggacttcttgagagagccaataaataatcagactgtgttgacctggttatccaatcaggactcacggccacctgtgtgtaggaaggtctggagcctgtggccccagggactgggaaatcagaggcagtgagtcatccttgacacaagggggcaggagagagcagtgataatccaggggctagaagcctggcctggaaagcttcccctacactagggagggttgggtagtctcaaggtagagggacttcccatggagagatcacagtgtgattcctggttccttcacttatggattctgaggatgatcttgggcaattaatctctctgcacctattttcttttctttttttttgagatggagttttgctcttattgcccaggctggagtgcaatggcgtgatcccggctcactacaacctccgcctcctgggttcaagcgattctcctgcctcagcctcccaagtagctgggattacaggcatgcgccaccacacccagctaattttttgcatttttagtagggacagagtttctccgtgttggcaaggctggtcttgaactcctgacctcaggtgatccgcctgccttggccccccaaagtgctgggattacaggcatgagccaccacacccggcctctctgcacctattttctatctgtgggttggaattataagacctacctcaaaagtttgttagaagaataagtgaaacccatgcttatcaagggcttaaaatggtacctaacacaaggtatgtgctcaataaacaaatacagttgtgatgactatgattaagatgctgctgccctttatgcctcattgaaggcccatctgatctgccacctccttggaacatttcccagtggatcccttctcatgggaccacggtctctcttctcctagtggctggagcactccattggtactcttttctggcgcttgctgcttgttgccgtgtgtggtggaattcatttatttgttatgtgctttagctccccaataatactgtaagttcctggaggaaagagctggtatttgatttgttcttctcttcctaacattgcctccaattccttgtacatagtagacactaaataaataattgcccccatgaggccgggcgcggtggctcacgcctgtaatcccaacattttgggaggctgaggtgggtggatcacctgaggtcatgagttcgagaccagcctgaccaacatggtgaaaccctgtctctactaaaaatacaaaaattagctgagtgtagtggtgggcgcctataatcccaactactctggaggctgaggcaggagaatcgcttgaacccaggaggcagaggttgcagtgagccaagatcatgccactgcactccagcctgggtgtcagagcgagactccatctcaaaaaaaaaaaaaaaagaaaaaagaaaagaaaaattgccctcatggatgaagtgaaaacacttcatcaattattttacaatccagtgattttcacagccttttgtaagaatggcccaactggttaatggacaggttaaagggaacatgatttagaactatcaagtagccattgcacctagcctaagagtttttggttgtgtcgttcgggttctccagcactatctgtcagaagctgatgagactgggcaggagatgccttttgagaagtagcttgactggtttagacagaataccaaattctaaattgtatatttcagcttaataagtgagttgatgctgatgatctatctgttcatggaaagggagagagagacttaatttcaaaattattagggcgagaaaagagaaatggaagattagatcaaatgatatgaaattgccatttttataggtcaaaaatggtaaaatattggcctttccaaatgattcgaaatctgattatgtctgcaacaaatcctggtgggatataaattatcacaagttttaatgtactaggagagagagggtacctggacttttcctcatcttttctgttgtgagttactgactgaacatgtgtcaatcaacttcccaccacagcagaggtaacattttaaaggcccagctaaggagcaagcatgacttgttcctgtggaggcaccagatgggtaactgggcccatggcaaatgaagaggaagggactgtgatgtcctggagcagagccacgctgggctgaaccagtggtggatgggtgtgactgaaaaagcaagtccagcctttaggtgcctggactttgaagtcaaggctggctggtggagaacaactgtttcaaaaccaggcatcagaattagattgaagttaaaaaaaaaaaaaacccagaaagaaagaaagacacagccaggcacggtggctcatgtctgtaatcccagcactttgggaggccaaggcagggggaatcatgaggtaggagttcaagaccagcctggccaacgtggtgaaaccccatctctactaaaaataaaaaaattagctgggtgtagtggcaggcgcctgtaatctcagctacttgggaggctgaggcaggagaatcgcttgaacctgggaggcagaggttgcagtgagcagagactgtgccactgcactccagcccgggtgacagagtgagactctgtctcaataaataaataaataaataaataaataaataaataaagcacaatacttacttggacagtattgtcaacagaccatatttctctctatctacctcttttaacttcagataatgcaaattcttgtgaaaattacatttttataagaaagcaaagttacatgaattgtaaatattatgtttggagatgatgctggtgatacttaactggaataaatcctgctattgggcactaatgccccaagttgttaatactggaggtttttttgcttgttggcatctatcaggaatgtagacctcagagatcataaaaatagaaaacccagattccaggggatgttctacaccaacccagcttagctcagcaacacagcatctttttttcttccttcttttttctcctctccacattctctgtctggagtctgctctccgtggggattttttcccatgaaaaactatggaagtgattcctccctctttcttttcccctcactccctcaactccagccacaggcctttgtgctgctcctggaatgtgccaggcatgttctttccaggggcctttgcatggcccttcttgtccagactgctgtccccagacacctgcctgtctccccaactccttgcaggcacttgctcagaattcagctttgtgggaaaccttccttaatacgccttccttttttaaatagtgttgcccattcctctttgcagttttatttttcttcactgtactttaaaaaaattatatattttattttctagtctgtcttctccccttcccccgactagggtgtagactccatgagggcagacatttttatctgtttggtctggtacaagcttagggcctagaagagtggctggcacagaagaagcattggatatacaaatcaatattaaggaagtgtgagaactaatattcacaacttgttcctccttttgggtcctccttctttagacagttgtgtacctccagtgtagccacaaaactttccagatgtgaaaaaatagaactatttcaaaatcaattgcagaatatatatagtaccctttgcagatcccagattgcagttcaactctccattcaccagccttcccttgaatcaaagataatttttttttttttttttttgagatggagtctcgctcttgttgcccaggctggagtgcagtggcgcgatctcggctcaccacaacctccacctcccaggttcaagcgattctcctgcctcacctccctagtagctgggattacaggcatgcgccaccatgcctggctaattttgtatttttagtagagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccaaggcaggcagatcacctgaggtcgggagttcaagaccagcctggccaacgtggcaaaaacccgtctatactaaaaaaaaatacaaaaattagccaggcgtgatggtgggcacctgtaatcccagctacttgggaggctggggcagggagaattgcctgaagcagggaggcagaggccgcagtgagccgagatcacgccactgcactccaacctgggcgacagaatgagactctgtctcaaaaaagatccaggttaaatagattcatattcatttcagcatatttcattattccaaaccacagaaataaagtgtttcaccaacaatttaattcacccaatatttaccaagctactaccatgtgccaagctccctgtgctaagctttgcaggaaatacaaaggaaaaaagcaaagtccctgttcttaagtgctttaagattgagaagcaggtagaaggtagtaagcagagggaaacagaaggcagaatctggtagctattggttttacgacagaactcatgctctgatgcaatctctggctcttgtttgcataagaaccaacacttttatgaagaggctctcatgactaccccagaggcttccactgtcttccctcccaacccaagccctcacccaccacaggaagggaagggggaagtaaaaggtcaaagcaatacagagggacattgggaccttatgctgccccagcctgtgggaggccagcctccatcctgttcagtattgcagctgacatgcaggataacacctgtgagggaggagcccatggggcggggatacctactctgaaccctgccaaactgctacaccccagctccaggagcaaggagaaagaagtgctaacaatgattttaattgctgggcgtggtggctcacatctctaatcccagcactttgggaggccaaagtgggaggatcacttaaggccaggaatttgagaccagcctgggcaacacagaccctgtctctattaaaaagaagtggtgacgtgcttataatcccagctactcaggaggctgaggtgagaggaccacttaagcccaggaattcaaggctacagtgagctgtgatcatgccgctgcactccagctgggcaacagagtaaaaccctgtcatacacacacacacatatgcacacacatacatacactaactagtacaatcagttgctctgggagatacctctcagggcctcttgtttttcctagtatgcaaggtaagggtaccctggccttggggtggtcagttctgaaagataacctgcacattatgagttatttcataagcagttttagagaaaagaaaaatataaacaaacttgtagcacagaagctaatccaactattttgtgagctgattttttttttttgtctgatcttttttttttttttttttttgagacagagtctcactctgtcgcccaggctggagtgcagtggcgtgatcttggctcactgcaagctccgcctcccgggttcacaccattctcctgcctcagcctcccaagtagctgggactacaggtgcctgccacaacgcctggctaattttttgtatttttagtagagacggggtttcaccatgttagccaggttggtctcgatctcctgacctcatgatccgcccgcgtcggcctcccaaagtgctgggattacaggcgtgagccactgcgcccggcctgatcttttttcttaactatatgcttataaatgaggaggaaggaatgaatatcattaagtggtattcacccttgcaagattctctatagtggcaagggccaggttagaagatctgaatgtaggggaggtcctaaaggtgatggcagcagcagggtgggcaatctggaaagactggggaagtgttgtgtagtacagctcttagacacaggcaagagaagcccctggatatggccccacattcagagagccccactctggccctctgctacccacatcctttcccacagagcgaggagtgcgtgaggctgaggggaggtggtaaccctgtgtctgggcccctccactctagaccagactccaggcacccaggaacctggagttccccactcagctgactcagagctgctgaggtttacacaacaaactcgcactttggcccatcctcctaaaggtggactggctgcccttgagggccttgctaggcctgaggggtggccaagaggtgggaggatcacttaagcccaggacaagctcagacaagaggcagtttgtggctgagcctgaataaaaaagtagaggtgtttaattgtgggaggcccttggcagtgctggaaggagcaagaaacaggaagaaaaagaggtgagtctcaggctgagggccggggactggagggagacaccagctttctctgtgccgccccattcaggcccagaacttcacacagtgtgagattttttaatttgaacttggtcttcgaagccatacaaagggcaatctctcaaggtggggggatagaacatatttcaagtttgttagattgatttattccttttaaatatctggatctctggtatgtgagcctccatctgtcatctcaatttagccatgaaattttagggatgatcctgttttagggatgaaatgtttttggaggtgggttttgaggactgggaaggatttagatgggtcagaatggcaggagataacaggacaaaaggcttggacatgggcatctgcagacaccggcaggcagagtaggggaagaaagccattgtggctgcataccttctatttgccagcttttggggatggcatggggtacgtagccttctcagcctgggctccacctcccaggcatcgcctctgcccgtgacgcctgtcactgtgctccagacgtcccaggccatttggttcccatgcacgccccgccttctcgaacctcctgcttgcacatgtggtctctgccctgctccccctgcccgccctcctgcatcccctcccagcccctctgcctactcacctcctacctgtccctgagacctccctaagacatcaccttctctggaagtctctcctaagggcccacaccagcttggatcccataacactgagaggtgacagcgtgctggcagtcctcacagccctagctcgctcttggcgcctccgctgcctgggctcccactttggcggcacttgaggagcccttcagcccaccgctgcactgtgggagcccctttctgggctggccaaagccggagcccgctcccgcagcttgcagggaggtgtggagggagaggcgcgagcgggaacccgggctgcgggcggcgcttgcgggccagctggagttccaagtgggcgtgggcttggcgggccctgcactgggggcagccggccctgccggcccgggcaatgaggggcttagcacccgggccagcggctgcggagggtgtactgggtcccccagaagtgccagcccaccagcgctgcagctcgatttctcgccgggccttagctgccttcctgcggggcagggcttggggacctgcagcccgccatgcctgagcctcccaccccctccatgggcctctgtgcggcccgagcctccccgatgagcgccacccctgctccacggcgccagtcccatgaccacccaagggctgaggagtgcgggcgcacggcgcgggaatggcaggcagctccacctgcagccccagtgggggatccactgggtgaagccagctgggctcctgagtctggtggggacgtggagaacctttatgtctagctaagggattgtaaatacaccaatcggcactctgtatctagctcaaggtttgtaaacaccaatcagcaccctgtgtctagctcagggtttgtgactgcaccaatcgacactctgcatctagctactctggtggggacttggagaacctttgtgtggacactgtatctagctaatctggtggggacgtggagaacctttgtgtctagctgagggatggtaaacgcaccaatcagtgccctgtcaaaacagaccactgggctctaccaatcagcaggatgtgggtggggccagataagagaataaaagcaggctgcccgagccagcagtggcaaccgtctcgggtccgcttccacactgtggaagctttgttgtttcgctctttgcaataaatcctgctgctgctcactctttgggtccacactgcctttatgagctgtgacactcatggcgaaggtctgcagcttcactcctgaagccagcgagaccacgagcccaccaggaggaacgaacaactccagacgcaccgcctttagagctgtaacactcactgcgaaggtctgcagcttcactcctgagccagcgagagcaccaacccaacagaaagaagaaactccaaacacatccgaacatcagaaggaaaaaactccagacgcgccaccttaagagctgtaacactcaccgcgagggtccacggcttcattcttgaagtcagtgacaccaagaacccaccaattgcggacacaccaccacccataatgccaccttgaaaccactttgtctccgtcaggccctaagcttcttggacaagcggagagaagttcaatgtgggaacagcagggagggccaaacagttttgtttcattttggtttacttttaacccttattacaatccttataactagtaagtagaaaaagaataagaaaatggttaacagcagtggtttgacataataggaaaagcactgtgctttaaaaaaaaaaaaaatttcggccggccatggtggctcacacctgtaatcccagcaatttgggaggccgaggtgggcagatcatgaggtcaggagttcgagaccagcctgactaacatggcaaaaccctgtttttactaaaaatacaaaaattagccaggcatgctggcacatacctgtaatctcagctactcagtaggctgaggcaggagaatcacttgaacccaggaggcagaggttgcagtgagccaaggtcacgccactgcactccagcctgggcaacagagtgagactctgtctcaaaaaaataaataaataggctgggcacggtggttcacgcccataatcccagcactttgggaggccaaggcaggcggatcacgaggtcaggagtttgagaccagcctggtcaatatggtgaaaccccatctctactttaaaaatatacaaaaattagctgggcatggtggcacgcgcctgtagtcccagctactcaggaggctgaggcaggagaatcacttgaacccagaaggcagaggttgtagtaagccaagatcatgccactgcactccagcctgggcgacagagtgagactctgtctctaaaaaataaaaaataaaaaataaataaaataaataggccaggcgcggtggctcacgcctgtaatcccagcactttgggaggccgaggtgggtggatcacgaggtcaggagtacaagaccagcctgggcaagatggtgaaaccctgtctctactaaaaatacaaaaaaattagccaggcgtggtgaccagtgcctgttatcccagctattttggaggctggggcagagaattgcttgaacccggtaggcggaggttgcagtgagccgagtttgtgccactgcactccagcctgggcaacagagcaagactccatctcaaaaaaataaataaaataaaataaataaataaatttcggccaggcgcagtggctcatgcctataatcccagcactttgggaggccgaggtgtgcagatcatgaggtcaggagtttgagaccagcctggccaacatgatgaaacactgactctactaaaactacaaaaaattagccaggcgtggtggtgtgtgcctgtaatctcagctacctgggaggctggagcaggacaatcacttgaacccaggaggcggaggttgcagtgaacagagatcgtgccattgcactccagcctgggcaacagagcaagactccatctcaaaaaaaaaaaaatgctcagtgcatgtgtttgtgtgcctgtgtgtatatgcccacacgtgcacacacagaggtggagtgggggtcctcatttattcaccagaggcttctttggtaaaagaagaaggctgcgtcatcagggttttcaagccttcagagttcccgagggctcccgcagggacagctccccctgtatccccaatgagtggtcttctcccttccccctacaaccatagcagcactctatattttgtctacaagttgagattacctataaaattccatcctgcatttgcaaacctgaacgagaaaggctccaagtcactggtctggagctcttacgtcctgtccaggccccggttcctgggttctgtggttctgtaagaggaaatggcagctggggcgtggaggcctgggtacagctgagtagggagcactcgtgtggggctaaatgaatgcagttgaaggatctggatcatctgggaccctacatgtcttccttctttgcctcctttccagggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcaggtgtgcatgcggcagagacagacgcttcccccatcccaccccaacccgcagagacccctgggctggcctccaataagcggatgctgaattgcacctgctgtagctttggcaaagcctgaggaatcaggttggtggagttcagggcctcccatctgcctgtgcatcttctggactgtccctctctcccccaggagcactctgtcatttgccccacccactcttccccatctctgtatccgtatctgcatcccatttccactcaggcttctgatatgcatctccttttccattctaaatttgcccattctgcgtctcacttcctggtagtcaggcctagtgacttgcttatgagtatcgacagtaactttcccaggggtatttctggctcctgcatctctctccctcctccactgcagtcagaatagccacaaagtttatcagtcattcccattacaggataactccccaaggcgggaattagcacactcctttgacaggcagtaggtacttcacagatacctgctgacaggtgggcttccataagggggacctcctggggactcagcgatgccatggcaggcctggggggtgacataatgtagaccaaaggatgcttccagccatgcccctgctcccagcacttgagagcccacctctgtctctgtgtggacccctctgggcttctgtgtgtgttccagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacaggtaaagagaaagagaaggcctcattcccacattgcctgaacaactgtttttatacgtaactcttttaatctaggttatatccactgtatcctgaaagccatctctttagttggcctattgtgatctcatggctagagcccccacgaaaactttccctggttacttttgagcagcatcttgacaagatttgacagttccccttgtcttgacagagtggagtacctccaagggcaccttgtttttagggatctattgaggcaaattcttccattccgtcaatgataagctgggaaattctttgggagatagagcaattcttacaaactgtttagttaacaaagggctcacacaccaccagtaggagtaaaaatctggatttaccaagacaaacagaaggtctctgctttactaaaggattaatgaggttgggcatgatggctcatgcctgtaatcctagcactttgggaggctgaggcaggaggattgcttaaggccaggagtttaagactggcctgggtaacattgtgagaccctgtctctattaaaaaaaaaattagctgagcatggtggcacatgactgtagtcccagatactcaggaggctgaggtgggaggatctcttgagcctggaaggtcaaggctgcagtgagccatgatcatgatcagcctgggtcacagagcaagaccctatttaaaaaaaaaaaaaagtattaatgataagattcctttcagcaaagagctcctcttataccttaaagatatgattcagttggtcaacttttagttcatatagaacttttcatgtatggtcttgttattcaaaattaatcacacctgtatgatgctacaggaaactcctagatacaatgtgtgtgggaagagtatgggaagctcccctctccaggcctctgtctacattcagtgtcctaatggattttcaaccttttggtcaaaacacactcctaaaaaaacaaacaaaaaaaaaaaagaaaagaaaaaacacattcctagaaaaggatcttggattaatttcttacaggccctatcaaaaagcacagtccctcctagtagcatttattttacttttaatgttggaaagcctttttctactaccaaatatcatgcctcggtaaagagacaaggaaagcattgttggagtgaaggctcttctccgtattgggttggccgatgataaggtgggggtcaggaggcaagtcagagatgagcaggaagcagtcccccccagatagtgcctttggtctcggtatggctgtttgacccaatttcagcaagaaacattaaggacaggactgtatggaaaattaagagtagtcatgaggaagcaaggtcacacgtgggtacttctttggtgtcactgctggagcccttctatgatatcagtttcttcgaaggcacaaccatggcatgatctactacatatgtttgtacctgatggcagtcatcaaaatgccagcgcaagtacacaaggcaattcggagccaaaactgagtggggatggctgtgttatttacgtgcactaaacacagaaatgagaacaaggagttctaatctccaatctattgctgacttacttattgggaacagtcacttacacattttatgggtcagttttccttgacacataaaggtatttcaaaggttactagtaaacaaccccagcacactttccaaacagtcaaagctgtatgactttccccccttagaggatggagcatgggccaactccacattcttcactacctagcaccttgccatcatggaaggtatacgtaaatacgtttgttgttgatgaacctgagttctgggtcattcttagctttagaagtttcctgcaataaagaaaaattaggaaagccagttgccaagttctaatattatatgctcagtacataaggcactttgatttaactttagcttcttcttcctagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccagggtaaggacggggatcgtggctgtctagggagagagcctggagaaaggggtgagcaggaaaccatgctcgctgccagggaggggaggatagatcactgcctcactcagtgtgccttagaatgggtcttttaaataagtggttctcacactttttggaaccaggacgccttcatactattaaaaaattattgaggaccccagagagcttttgctgatgtgggttatatctattgctatttactacattacaaattaaaaatttaaaaattaaacacgaatgggtgcagtggctcatgcctgtaatcccagcactttgggaggctgaggcaggtggatcacttgaggtcaggagttcgagaccagcctggccaacatggtgaaaccccatctctactaaaaatacaaaaattagccaggcatggtggcgcatgcctgtaatcccagctcctggaggctgaggcaggagaatcgcttgaacctgggaggtggaggttgcagtgagccgagatcgcaccactacactccagcctgtgcgaagggagcaagactccctctcaaaaaaacaaaaaaacaaaaaacaaaaaaacacaacccaggcgcagtggctcactcctgtaatgccagtactttgggaggctgacgcgagtgaactgcttgagcccaggagttcaagaccagcctgggcaacatactgagatctcatctctacaaaaaacacaacaattagctgggcatgatggcatgcgcctgtagtcccagctactgaggaggctaaggtgggaggatcgcttgagcccaggaggttgaggctgcagtgagctataatggcaccactgcacttccacctggacgacagagtgagacgctgtctcaaaaaaaaaaaaaaaattaaacacaagaaaacacaagcagatattccattagtggtcagattgatgagtgagaagcaacagtaaggaaaatggtgttgggtttcctgatgatcacagggacaaaagtcccagaaagttaacacagaagggaaaggggacttgtggattttttctcatttgcttgctttcagaatcagaaactatccctcttgtgatgaaagctgtctctgggtccattgtccttgtcattgtgctggctggagttggtgttctagtctggagaagaaggccccgaggtgagaggcacatggaagggatccagggggctgcagactctcctgcatctctccagttttattttctgcacctgctgctccctcctccattcagaaatggcttggctctcaggctgggatcacagaaggacctgggacaaccctcccaccatgtaggggacacaaagcatggataaagcttacagggagagtggtctcttttcataggtgatgcctgacatcaacaaactagtacatctgtccaggggaactgtccccctagaagttgggtcagagaagatatggggatcttgatttgtctttttccaaaccatctttttattattaattactattgacttctggggcagtgtcctttgtttcaagacttcagtcagttttcccattttgaccaccattctttcatcccaagcatatgaaagtccttttccttgtaaattcattattcaaaacattaaatatgtaagagtagataccttcagggaatgggacttagagtaaggaaaaggggaggagaagtaggagatatataggctcttgataatgtggaataacataaattcattcagtaagtatacattaatgacctactgtgctccaggcactgtactggttgctgggatataacaatgaacaagacagatacgatccctgttttcatagagcttacaatagagcctggtaaggttatctcctggctctggcttcactaattgctcaaattgatcacaggatagtaccgatgagaccatgctttgaacccaaagtggaccagaagtttggttttccttcatagacatagacctcaactccaattcaggtgataactgtacaaaagcatgttgttagatcaaagtaaaaccaacccttttactagaaaatcagctcagaggccgggcgtggtggcttacaacttgtaatcccagcactttgagaggccgaggcaggcggatcacttgaggtcaggagttcgagatcagcctggccaacatggtgaaaccctgcctctactgaaaatattaaaaaaaaaaaaattagctgggcgtggtggcacatgcctgtaatctcagctactcaggaggctgagacaggagaatcgcttgaacctgggaggcggaggttgccgtgagcaaagatcgctccattgcactccagcctgggcagcaagagcgagactctgtctcaaaaaagaaaaaagaaaagaaaagaaaagaaaatcagctcagagagttaatgggttgttaatgttttctttatagataaagtacagcactaatcctaatccaataaatgatagtgaaacaaacaaaaaatttttttacaatgacatccctctctcaataattatacagactgtgagttcctgctttttatcttatagagtttacaaatttgagctaaagtttgtcaagtactaagagaatcttgacaaagcaagctaaaactgtcgatgcctgtttctcagattttgctgaacactgcatactttatttttgagctgtgaggaaacattcttgtaatctgactaaaaacccctttcctttcagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaaataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattct

SEQ ID NO: 717 - DNA, 88002 bp, Human; identical to SEQ ID NO: 639

SEQ ID NO: 718 - DNA, 20041 bp, Human
  misc_feature (1)...(20041): n = A,T,C or G
ctgcctcctgggttcaaacaattctcctgcctcagcctccccagtagctgggactacaggtgcccgccaccactcctggctaattttttgtatttttagtagagacggggtttcaccatgttagccaggatggtctcgatctcctgacctcatgatccacctgtcttggcctcccaaagtgctgggattacaggcgtgagccaccgcacctggcccagaatatttatttagagactgatgtcaggcctaagtgttgatagtgggtagtagtgggcaagatgcctggccctctctccttctcatgagcaagtcagtatcatagaggttaaacatatctttaagtagcatttaacttaacattttttaattaaaaaaaagagaagtaatttgtaaaaatattgcatcccctatttctcttgctggaagctatttgttcttagcagaaatgagaagaaaaggtgttttgcttaaaaataagtgagttgctcaccatacttctggatctcatctagaattggactcacagtttgtgaacagcccaggtatagccaatgtcttagctttggaacgcttgccactttccagctacagctgaaccttatatcctggtttggttcctgatgactttcaaattctcctgacccaaacgcaagctcagaagcacaagcacattgttggtggcagtacagactgaaacaccctctttggatggcagttcctctcacaggactttattctccaggtatgcacaggcacacacaggtgcccaaaggataaacacacagatctattgtagcatatttgtattactgagagattagaaacatcctaaaatgttaaccaaatcgcttggatgaaaagttttgctctgcttattaggtttggcgtacaatatggaggtgacatctgttacttccagtgtattatagatactttagctccaaaaatgatacctgtacctagatgggcaccaaaagggaatggttaacaaatattgcacatacaggggtatggggcggctccggggctggggatggcggcggccaggtttgtagcggctccaggatgagcgggtggatccctggaagcgtggtgaaatgggctggctcccgagccagccgggaggacgcttactacagctgctcagaagcaccactggaagctcagatgtaggtgccccagccagaagcagagaggggttcagagaagctacagagaagcccctcctgatgccccagggagcaagccaactccttccaggctccaggaacaccacaaagcaatatgaaacctgttcatgagaggaaccaggaatgccttccaccaaagaaacgagacctccccatgaccagctgctccactaaccacacatcctccagtgatgcctctgaatggtcccgaggggttgtggtggccgggcagagccaggcaggagccagagtcagcctggggggtgatggagctgaggccatcaccggtctgacagtggaccagcatggcatgctgtataaggtggctgtgccgcctgccaccttctcaccaactggcctcccatctgtggtgaatatgagccccttgcccccggaaaaaaaaataatattgcatatgcagttgattaaatggcatactccacggctattaggaatgatgaaaatgggctgggtgcggtggctcatgcctgtaatcccagcactttggtaggccaaggtgggcagatcacctgaggtcgggagtttgagaccagcctaatcaacatggagctgtgtttactgagtggggctttcgcaggctggagctaagaatttccagtatgcgtaacagccacagcccaaatatctgccagtgagttgtgtaattccccagagcaggcctgggcagtgtctgggtggggcctgggagccacaggagacgcccaaagccaggcagagcccgggggcgagggggcggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctgggtaagtgggagctggcaggagatttgggttcctgcatggtgttgggtgctggtcaccagggagtcctgagaaatgtaaagtcgcccttggctgggagtggctcagtctacatttggctgcctcctgggccaagcatggagggtgggaaggggccgagaagaaacagtcccaggcctagagtgcccacggcagggatgggacctgggccgggagacaggctgatgaagaaatctagaaatgcaagggggaagctgaggtttgagaagagtccaggggagggacccttgcaggggtggggccactcaaaggagggggtatcatggttgagccttgtgtgtaaatgtgtatggggtgcacacacgtgtgcatttggggagaatcaggcatactgctcctggcagagggaactgtgtgcagagggtcagagggcagggagcttggctttgagggaagctgctcagcacagctcaagggtcctggtaccggaggagatggacctggggaagcaggcagggccaggtcctgaaaggccttgcctggcaggctgaggagttaggctttaccttaagagaagtgggaaggcactgaagggctttgagcatgagagtaacctgaacctgctgttggggacccatcaatgccttcacctcagggatcaatgatgttcatttgtcaagactggagagggaagaggggaagcaggaggacctggcctgctagagcctggaggaacccggggctcagggcagcccatgcccagcagaactgatgggttctcgggagctttctgtctatggttgagcctgaggccatcgctgtgctaaggagttgaatatccagaaggggacagaggtgacatctcccggctgccggctctgcacacccttttcctttcctcccaggcagcctcaggatgtcagggctgcactttctgttttgcagatgatgaaatgaaggctcagagacactgagtgacttgctagggtccaatggccagcaggctccagtcagagagcagttgggtctctctgcccagccccaggttctctgtgagcttttgtgggatacccaggcttgtccagcttcagggagtctctggatcatagatgtcgcaacccaagcaagtgtcctcagggtcagacatgctaggttctggacaggtgggacaaagaggaagccaggctgaggtggggcagctgtcctggcccccagggaagcagccttcttccaggacaaggggccatggaggcctgcagcttcaaccagactgctgggaacctgcctttgaggaggtggacatggcagggagagcccagtgctgggtggtttccaaagtcagttgctggccaaggcagtctggcactgggccttgcacccagtgcagcaggacaaagggctgtccatgtagggacctgccaaattgacaggatcactgtgacactcactgagtccctactatgtggccggacccttctctaagcacctcacattcaatatctcccttgaacctcacaaggagtctatgaagtagacaccagtatccttatccacagatgaggaaactgaggcacaagtaggctaggcaggtgcccgaactcactagtaagtgtgagagtctaggtgagaatctgaacagcctgactccagggccaaaaccataccctggtcgtccataccccatgtgagagctggctaggggtagcaagttcacaggtagaccccacctgcaacagctgagctgctagcgaagacccagtgtcctctaggcacaaagctgggccaggaacgcgatgggaggagatgagggagccactggagagagatctgtctgcaggcagggtccatctgcacctctctttttggtgttgccttttcctctgtgtctctcatagagacaaacccatctcccaggcctctgggcagccacgtagcaggggaaggccaaggcgtggcagctcccctgtgcctgtcacagaacaagttatattaatagatgtagtcacaggctggtctgagtcaccttttcagtgaaaatgtgcctgtctggactagcacggccctgggcaagaccctgcaggagcctgaggctgacccttccttctcagcaggaggtctggagctccaggactccacactgatagccagggctccgattcccagaacacttattttctaaaaccttagagtgggaagtgagacagaggcttctcaatgcagcaaaatcagaaccagccagggagctgcttacaaatgctgcacctgagacctaccgcacccctgcgggactgcatgctcctcagggatgcggttacacagcctggccactcgctggtgcaccacagcccccgagtgctggggcagagggaagccggcaggcactgagagctgagatgcctcccacattcccagatgacctgcgttcctgtgggtgaagcttccttcagtggaacgttccaggaacactcattgtctgggaaaggtggagtcatcagtagggcaggggaggtagatagagctcagcttctgagtcaggctggggagtcccaacagcatcacttactagctgtgtaagggagtccagctccctttctgtaaagtgaggcatcagtacttacctagcacaactgttgaggaagccatgacataagcattgcttctaaagcacctggcccaggtctggcacacacaaggggcttgaagtgctaacaggagtaatagcagagcgtgactccacaagcaagggatatcgtgtgtgtggacaccgatgagcaatatctgggaccacactggctctctctggatggaatttccataggaattatttctaacaatttctgctgtgaaacatggtgctaagaaatgactcaggaagatctgtcaccagacatttgaaattaaagcaaagagttcagaaagatgccttacctcttactcaaaggaaagatacttacagatataccatccattggaatctctgtattttcacaatctaacccagggcttcgatggatggatggatggatggatggatggatggatggatggatgggcgggtgcatagatggatgggtgggtggatggatggatggatgtggtagtcaaatgggtaagtgcgtaggtgggaaagtagatgggcagatgatggaggtgatggaaggaataagtgaacaggtaaatggaagacaagactggatgggactaaactctttttcatcctggaggatctctgagtctccctctaattcaatacctatctccaatatccctccattctctaccattcctccacccaaaacacacttatgtccatgttaatcatctgagaaattctgcagggcacaagtttaaagagccctcaggcaagccctgaactggaggcttggaaatcaagggctcaggcacttggttatctggtttatttcacaatctgcagagcatcgtgcgggtttttctaaacctgacgctctgagccccatgggcctgtggacttgcaaacaccctgaactatcaatatgctcagctgggcccctgccctctaagttgctgtaagtcccaactccccaggaagagggcagactgagctcaaaccattcctcagaaaggcagaaccatgctcagccttccaacctcatctgcacactctgaaggtggtgcatgcagctccaggaagcctttgcttcagtgttctttcccctcctaactttgggtgagtttgtcccttcctgctgctggtgggtgatgctggaaggagctgggtgtggctggggctgctgtctgcagtcagatggcacagacagggacaggaaaggttttgtggcttctccccacaagctctggctctggctactccaccctgttggccaaggggctgaagggcagagcactggcctgcaagggctgagcagatctccgtgcccagggaaggggctcaccctgtcagggcgggctaccagatgggctgggagcctgctctgccctccctgtccctgcctgctttgagcaggcctggttctcttgcagattgaacaggagggtgtcacagtgaagagcagctcccacttcaacccagaccctgatgcagagaccctctacaaagccatgaaggggatcggtgagtgggtgttggcagccttgccacctctgctcaagacccctccgctcacagccctggaaagcgggtgccaggggacatctggggagctggggtgtcccatgatactctgaaactgattccactacccagagaatcacacagccctctgtttctgcagtgaggtcagcacccaccctgcaagactggacaggagggtgctgctcttccctgggtaatgggggtggggaggtgagctgtgtgtctctgtgagtgacttcccatcagtctcagctttctcacttgtaaagtggccccaagaattcttggccttgtgtgtcacatgaagtgtgaagggggtggtgctttatgatgccaggcacagagctgccaggggtgtgaggtgttgggagtttgtggggctgattcaaggcccccttgccccatgtcgatggccatggagccggctcccttcccatctcctgcacttgcccagtgctgccctcagcactaccgtgagtgggcgagggctggcctgaggccagatttaaacagcttgcccagaaagccctcctgacctgagagcagagcatgtaccctgacctcaccccaggtgggactgaccccttagccggctctgcctgaggatcaggggccttaatgagaactgccgctcctgacaagcccagaaaacgttctcatgccctctgctttctgtgaagcagaaagttatctccacttcccaaatgagaaaacggaggcccagggaaatgaggctggctgcccaatgccacgcagttgctgggccaggcctcggattcaggggttggactcttagtcttgaccttcccctactgcgaccaacacaaaggagggcagggccagagatctcactcggccaagctccaaaggcccgggctgatgtccagagccacccagacctcagattccatcttgtgaggctggccttgggcacgccccaacattgtgggggtgtggggtgggaaatggggaggcagatttcctaagggtcttgtttacaccacgaaaatggtctgggggtttggaactatccaggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggcaaggggaaggctggtgggggtggggataggtgagccttggggttgggggtacagcctgggaggcagctccattctggacgactttcccctagagccagcccactggcagcatgggcacatggaacctgtttgcatgaaaacaattgttctttattgaaattcaaatgtaactggctgccctgtgttttatctggcagatctacttttaggtgtcagagcccgggccgggggctggccttccttgcttcctttcctgcctcctctctcacagcattccttctcatgcacccaacaggccccactggaggtctgtctccctgcccccaggctatctcgccctgccctctgagcccagaccaccttctcttttccatgccccaggcatgcaggcctggctttgctctgttctggggcgtgggcatgctttcctcagtcgagctgcttgcacccacacctcgtcccttctgccacctgggaattctaagagcctggagtaagcatgccaggccctttgtttctcctcccacctgcactccacccctaggacaaagcctgacatttgggggtacacagtaaacacaggattaaatatgtgcacagccatggttgcctcaagcctctagtgactcatatcattagtttggagatgtaacgaaggaagatcagctcaaatattctcttggagaacccagtatgcatttttacagtttccctctcttagtcctcacagtgatacattctttgtattcaaacatttggggaaactggcactcagagaggttttaagttgcccaaggtcccagagcctgtaatcaacaaggtggggattaaaatccaggtctgacaaagcccttgatctctctgctgctctgtagatcagctgatgtagcctggtggctcctcgtagcaacatgtgaccttagaaggaggcacatgtgagacgaagtctttaattcaggcatgcattcattcattgagtgccaagtgacaggtattttatggtgatgccatactcagagcttgcagtctagctagcaataccaacttcattttactgagagcttatgatgtgcccagcactgcactgaatgctgaattgagtcacacacaaccccctaagcaacgggatgaagcaggagcacgtttctctccgtgtaaccggtaaagatactgatgctaagagaagctaaggagctggcccaagaaacccagccagcacgtggcaaggcccacgcagaatccagcccaagcccctggacccagccaccactccgctgcctgcactcaggtgggcctggcttatgacaaatatcacctttccctgttcccgcattaggacctcactgagaccttgaagtctgagctcagtggcaagtttgagaggctcattgtggcccttatgtacccgccatacagatacgaagccaaggagctgcatgacgccatgaaggtaaccaggcagacagggcaggggagtggcaggggtgctcacatgactgggtaggggcaatgcggggaccgggaacctacagcccagagctccccttgagccactgtttggaatggccatatgggccataactgggcccagtgagcaggcagcctgctgctcagactgcacccaacacctggagtcactggtgcctgattgacacgttgagtggccgtgatgaagccaaaatcagtacttctcagaacctcacgagctcaggtgtacagtggtattggaaacccacctctacagtcccaggcacagccccttgggtttccctttacctctcactactctttgcttttgcagattaataaggatggggacccagtaactatagtcattttgtttggaaagacacttgctgcatgggcactgccaggcattttacacccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaaggtaaggggtggcacagatggaggggctcaggagtggccacaagctttggcagcctggcagggaacaaggatcaagaattaacctgggccacactagaaaggaccctttggggacttttttacccacaggtgctgagcacctaccgtatgccaagatctgtgcctgatggtgacactgaacatgattcagacttgatctgtaagctcaccagctcctcttacaggggagagaggcctgtgaccaactaaaatctctgcccttgaggactgtggtagtagggggtgtggaccccaggctagcagaggccagtcagtcctccacatcatgtacctagtggggagttttcctggaggctttggctttgccaagccttgagatgaaatggagcttggttggcagcccctagcctggctctctgacctggtccatcttgtgctttgagcttggttgggtacgcatgtcgcttctagttgtgaagcaccacccaggcgacagccacttggacacccgggcattgcatccatgccctgtgccaaggactttctttcctagaaggctttaataaggagaagtatggggaacagggctggaaggaggaaagcaggccccgggtaggctgtgggcctctgcttgtgcctcatggtcctgtttccctgcagactatgggtccagcctggaggaggacatccaagcagacacaagtggctacctggagaggatcctggtgtgcctcctgcaggtgtcacagcctaggctcttgggagtgccttggtttgggagtcccaacagctccaccccagggagcagcccttgaatagcgccacaagagtcagggtaggggcatgggatagcccagcagccagggctcattgggtgtgtctcagcatggttagagggtcccaactgcagagcccccacacctgtccttactcagccatgtgagagcatcctggaagcgggaggagagcaggtccttcgtgcaggcctcatgccaggcactttgcttaccttagctcactgaatccgccaagccttatgaggcagtccttaccacccccattgtacaaatgaggaaaccaagggctgaagagaataactggcttgtcgaagtttccacagccaaagagcagcagagccatgcctaccctccaagcccaggatcccccctgtgcccttaatgctctggtcagctggcctgccttacagagccacctcctctgttcctagggcagcagggatgatgtgagcagctttgtggacccggcactggccctccaagacgcacaggtgaggctgcgcccagccggccatgtggccccaccccctgccatctggactccggctcctctgcccacgggggctttctctgacactgggctgggacccacccagctcagctccctataggcctttgtcctgtggtgtctggggaggagagtgagggtgttgggagactcgggaggaaggagtgtgacttgggggtgggggagcactaaagctctgtcctggcaggaacagcccatgaacccgggggcgctaggccccagtgctggacacaggtgtccgggtctctgtaggtctgcctgctggcagagggaagtctggggaccaggcagttcctagagcagcttgtggcccaggatagagaaaatattctaagccagagctgctagagaaaggggagctccctgtcagagacgaccaagcaggggagcatgctggcctggcagagtggacagggccaggccatggccacagctctgggactctggggctcagtccctcacctccctggtctccctcactggcttattgtgggtgtcccaatgctaggatctgtatgcggcaggcgagaagattcgtgggactgatgagatgaaattcatcaccatcctgtgcacgcgcagtgccactcacctgctgagaggtaccagggagggaggggctggggccggggccacagggggtgtcctggccatgagcctctccctcgtgcttctgccttgtcaagtctagagttagggagagagccagggagcccaggactgtttccccagccaccagtgggaggtcagggcggcaaattgatgtgcgatctctgatccgagacactgaggggcatcacgaggaggtctgaccatcccctgagcagagccctctccacagtgtttgaagagtatgagaaaattgccaacaagagcattgaggacagcatcaagagtgagacccatggctcactggaggaggccatgctcactgtgggtaagagctcagacttgcacgtttttcaggccacagggctcaccgtggggcagcaccaaagaacaaagggcctagggatgcgaccacaagagaaagaatccctgtgtcaccttcacgggatgtccccccgactcacactctgcctgtctccctcacccagggactgctccacctctagagtcccagtgtgtgctgccaaagattgttctctgtgctgcccacgtggtgcccagtgctgtgtgggtgtgtctgcatgagtgtgtgtgtgcgtgagagtgtgtgtgcctgagggtgtgtgtgcatgactgtgggtggaatgtgagtgtgtgtgtgtgagacagacagtgtgtgtgtgtgcgcacacaaatgcatacgccagtgattatgccagccccaaccctgtgtgtactcatggcagccatgcagggagcactctggctgtggttgtgaagccctggccagcacaaagtcatctttctggacatgaaccaggggcctggcccctgccttcattgccagttgaagaaacagtgatgtgtggcttgagtccaaactgagtgacggatggtctgatgctgagaaacactggggatcttccccacagcaggaagtcagggccactcaggaggacccactccagagctctcatgggttccagggctgagatcacaatgggaagagtcactgcagagtaaagagctgaggcccagggcagagggacgtctcttctcccacttacacacagagcccaggtccggactcctggcctgcagctctcacctccacaccaggctgcctccgtgcaaagccagcagccagcaggctccctgctgtttcctagcctctctgggtggacagggccatctgagacaccccagctggccttggatgctgtgatacaatccggtctatgtcaggacatctaatcacacccctgctccaatctcagcttccacccctggatctggcctgaacccaccaagaatgaagtctgccagcagggaatagtgaagccatgcagtgctccgtcatgctgggccttcctattcacttcaccttgaagcctcgcatcagtctcacttcccagatgagtcagggaggttgagtaatgaagccatactgcaccatcaaggcaggaagtgaacacatgcctacctcactcaaagcccatgctccttctgcagccctaagtgaaaatgccaaccttccccacccagatgccaagtctctgagcagtacccatgggagcaagcatgggcccagtctctggaccagacgcccccaggtgccttagtcctgtggggccaaactccacttgtcacatgggaattcaaaatgcagggttcctgctgataagtgtgagagagagggcactctgaggccagcagccaccatcccatggtgcttctgtggagctgagaggctggatttttggtggaggtgtctctgggttgagagcccagggcctgtcctgagtctgagctgcccttggatgggcttgagctggtgtcttcagacgagccccacagtctggtgcatttcacatcttacccttttgcctgcctgcttgggcctttggagctgtgcccagtgccccgggctaccttccctgtcccacgccacctgacacaaagcctctcacattgggaaaggcacggaacaaagaaatatgccaagccttgcacaacactgactcttaagacctaaggcaagacataaagttgtaggcagtgccacctaccagctccagacattaacacagctttcttgtttgccagtgaaatgcacccaaaacctccacagctactttgcagagagactctactatgccatgaaggtaactgtcctgtcttcttcttcctgacgctcaccctacatagcaccaagtgcaaagccaaggagctcaaagccaccacgatcctccacacgggggagttatcttacccaaacctgtcgtggatcagaaaggttttagttctcggaggtgaaattgagtctgggaaagggacgctgcatctccagaggtgaataattccctgaaactaaaaccattgcccgttttctctgattgatggttgctgatatcccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggtaagcaggcattcccaatgctgaggccagcctgaaacccagacattcagggaaacctggaggctgtggccaacactacgtgagcccctcccttcccagtgggcaccatgtgcttgcattcatgaccatgtggtgtgtgcagggaacagcagaggtcagtgtggctggatcccaaggggaatggggggcagaggggagatgcagagaccagggcacagaggctcccctgtgtcccactcagaaagttggtttcacatttaagttatggttgctccttggaaaagacaccaaatccttgcagaagaagccacctctgaatagtcaatgagatgaactagtccggtaggaatcgggcccaccgctcaaatccagatttaagtagtcctggcggccaacttctaaggagataagtcagatgagcgccaatagactatctaaccagattccaattagcaaaagttctggagccttcaaaacacagactgattatcacgctgcgataattgggagaaacagctcttctgggggtgtctgcaaattgaggtcttgatgatttcattagcagaagtcacattaggacaaatgtatccccaagttttctttggctactaagtcaagtctctagctcttctgcaaatgtcgttgttaagtgcacttttcaagaaacacatagctgacaataggtggaaaagacatttctgtttccagatgtttcaagatggcaacatcttgaaacaggtgggcaggggcaagagaggattggaattattcttggtttcacttgaggctccccagccaatcttgtcgggagacaggagggcaaggcacacaccagcctggactgtgctgtcacctgcagacagtctgagctgattgtcattaacccttttaaccacacatggtaacttacggcatcagagagatttctacagatacatgaagccaccctcttcaaattttatctaatgttgttacttaagaaaattgagttagaatcatgaatacattgaccaaacattttctttttagtgtagaccacagatgtcattaaagcaaaaatggttttcaacactaatatgagttaaaaactcctgcattgaaattaagaggcaaatgtataaacacttcaagtataactcatgtatttgaaaaagtaaacaaaattaatgcttttctttctaaaaactattagaaaaattgtcttcaaaataataaaaatcaccaggcgtagtggcccacacctgtaatcccagtgctttgggaggccaacgcaggaggatcgcttgagcccaggagtccaaggctgccgtgagctaggactgcatcactgcactccagcctgggtgacagagtgagaccgtgtctagaaaggaaaaagttaaaaaaatttcattgtagtttgaaacccgtaatgagatttcaggctcaaagcaggcaaattttactaaatggtgaaaagtagacaataaccatgagacctaaactggtccagagtgtggaaagtgggtctagccccagtctaccccttactcaccatgccgttgtgaatgaattcactcccctctcttggccccgctgtcctcaactgcatgaagaagaatctgggtgatctgacctggcccatttcccagctctgtatgcagaccccggactagccagtcccatcaggacctaccagtatctaagaaacagggctcctcagtcatcggaccacaaggtcagtctcatcaggagacaaacactgtggacccgatgtgagccagatgcagggcagaccagctcgccttcctcctgctgtaccctcaccacgtctcagcaagatgcacagcagcacagcattgatctcatttcatagatgagtcccacagaggtgaaggggcttgcctcggccacaccgtcagggtgcgatggtccaggctccctccacccccggccctgcccccaggtgtgtgctgatgcctcactctcagccttgattcccaagctgccacagcaggtgttgaataatgatgcatcgtgttgtgtaaatgaatggctgggcaccctggctcccgaatagaagaaccctgggacagctgaccccttccttgtttaggagtggaactgtctctgattcattttccacatcaatcctgcatgtagttggtaagagaatcaaaaggaaatgtaaaggaatagcctgaaattaaaaacaaggaaagaggggtgatggcacaacccctgcggctaggaaccctggagggccgggccaggtgcaggccaggggcacacctcttagtcataataacacagccgccactgccgagccaggcacaagcaaaccccttctcacgcttatgcgcctcctgcccacaggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaagtatctttggatgtttagcagggaccagtgtaggaccaatttaatttgtcagaaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 719 - DNA, 45432 bp, Human
tgcagttgggagaaccaagggactatttgggttcgttaagcagtggtgatacctagaaatgaatatatggcgtgctcagaaacctggtggtgttctagagatatcactatcaaaagccagaattaggacgaagtacaaactacagacagatgagggagaagacaacctaattcttagcaggtactgtcagtgggagaagtgtctctaggttcgaggagagtgaattgttatgggccttggctgactctggagtagcagctgctagcactgtgcggtcaccaagcaggggaggggctgtggctctgctataaatagtgctgggagccagagtcgctatagagataaaactgaatcctattacctgcaggtcctctactgggagcaagggaaaggagaaagcagtattttgaggatttgagaggtattgcaaataggtcttgtttattgttaggtaggggagaaaaaacttctactcattacctaaaccaaatagggccttaagcatccagggagtgtgtatgtctgtatatatgggagtgcccgcagcagcaggtgagggagtagagggtgtgtgtgtgtatacgataatgggtttctctccgtgtgcattgaacaaggtcttaggccgcatgtagagcacagaggtagaatcctggaacactagaaatatgagaaaagaacttctactcatagaagaagtagccctaccagaaatagctgtgcagcggggtgaaacgttttatttagagaagtgtatagacacttaacacgaaataaattataattaagaccatgaaagcttttcctaattttaggacatagtttagaaatttctctgagcacctctccctgtccttgcagaaatcctggtatttctgcctctaattcatagcctctgtaatgtatagtaggacaaggactcatctgtgggtattgtattactgattctgagcctgagatcaaaatagaggagagattatgattcagcaccaagggcagagctagtagcagtggcctctgggctcctttcttgcctgaaggagggagaaaagtggtgcagattaggcaattggggcatggacattttcatttgagatcacatgaggtagaatagccagctgttattgtctgagcatggttaactagacagtctatgtggtagttttacatcaagctgaatgtagattgttgaaacagaataattaagtttccatctagacctagaagtgcaggttagtgctagctagttgaggagtctggtttgatcctgatccaccctggagggatcctgagagtgacttcaatttttgttacaatgactgagtccagattagatggcctaggtctgtttttcagaaacagagccccaggcgttaagctggaaattaagtcattggtagggataggtaggtgaaccattatttatctacattttttttttttcttgagacggagtctcactctgtcacccaggctcgagtgcagtggtgcgatctcagctcaccacagcctccacctcctgggttcaagcgattctcatgcctcagactcccgagtagctgggattacagatgtgtgccaccacacccggctaatttttttgtatttttagtagagatggggttttgccatgttggccagctggtctcaaactcctgacctcaggtgatccgcctcggcctcccagagttctgggattacaggcgtgagccaccatgcctggcctattttttaacattcgattctgtgagctcatgagcctagacacgaggctaggcaagcgtcaagttctcctatcattagtatgaaagtggaagaccttctgacctctgcctctggccgggaagaagttgagagggatgagtcccttaggcacagcagtggatcttatcagtactttttttcctattagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggtaaccaagaagagattgacttttgtcttaatatctgggatagccataaaatctgcagttgttcccttctccgatttccatgttgctttgcatagctcatcttctcctgttattttaccctgatgggagcatcgaagccagtagggaaaaaacaaaatcaggtggattgaaagcaaaaccctgctcttaactaacatcttcttgatgtcgagcaaatatactctttatacctcagttttcttattttgtaaaaagaaaaagtacattataagctactcctctatgtatacttttttggtaatttattagttaattcactttaaaagatgttaatcatcttaaggtgccagtgataattttattgtcaaaatctccccttcgtttcagaatagatgccttcatgacagtgtagacttcacttaggttaccagctccatgcggcaggcagcacccatattttccaaggtgttacagtcaggttactttatccaaaatagcatcttgagctttatttgttgactgtggttaaaatttgatagcccattccatcccttcaggctgctgaatttgtctttatgttcttcaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaaggtacagtttgctgctgatgcctaatgggggaagcatttagagattccatgtaattggtctttgaggggcataggaaatttcctctacagctcaaggtccttcagacctattaagcatatttagagtatttagagttaatcttttttcttttggagacagtctcgctctgttgcccaggctggagtacagtggtgcgatctcggctcactgcaacccctgcctcctgggttcaagtgatccttctgcctcagcctcccgagtagctgggattacaggtgcacgccaccatgaccagctaattttggtatttttgtagagacaaggtttcgccatgttggccaggctggtctcaaactcctcacctcaggtggtccacccacgttggcctcccaaagtgctgggattataggcgtgagcatcatccccagccaagagttaatctttactaagcaaaagactgctgcagagttagacctctttccaaaattgtgtttggagtaatgctggaatttggtgttttaactgtggttaggacagtaagtcttacccagtatatatctttacatttgcttttgccattgtatatactttccggtcctatctgagctcagagactgggctttcttaatgatgctccgtttcccattgtcatcattagagcctctgtggtgatactgagttgcagtagggtatcagcttctgatgctaatgtgtctgattcctgctgtctgcttctcagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtgagaggcaagcttcctagacctttctaggggagaaactcttaaatatgccagtggccagaccacgagctcttagaggacagggactacatatttttcacctttttgtcttcaggaggtaacatgatgcctggtaaacagcaggtgttccgtagatgtgggttgaattaagatactggtatcatgtgggatgtatttagagggtttaccattcattagggcttatccttaattgtactgacctaattctttggaaatatcagtagttctgtttcagtgagtggtcctgggatgggcagtacaagaactaggaaggtaagggagtgatttgcatatctcaggtgactgaggatcaccattgtgcctggattgggaggtggcaggcatggtggggcagggggcagtgggagagacaaagctggagctgtaggctcgatgaagtggaaaccaagttgtaatgttggaagctgttttcttgtaaaccatattttatgttttggagtgattcttactggatggctcatgacaggtggtgctacagtcccgagactacaatgcactctccatgtctgtgatggcattcgtggcaatgatctacccactggaatatatgtttcctgtcatcccgctgctacccacctgcatggcatcagcagagcaggtgagtctcaaggcgacttccggctttctcacctctgtcttcctgagggaggaggcttaatgctcaaagaagttgtaagtgagtgctggtcctcaatcctttgtcataacttatttgtctacaaaatctgactgatttgaactgatctggtggcaaggcttatgctattttagttttcatttatcacaacaaatgttaatgactgtaggccactggctacactgcagcaggtgttacgtgtgttacgtaatacagtagttcctccttatctgtggaggacacattccaagacccaccagtggatgcctcaaaccacagatagttccaaactctatagatactttgtttttttctatacatatataccggtgataccgtttaatttatgaattagacacagtaagagagtaacagtttctctttgggcatatatttggtgttttttggagacagagtctccctctatcccccaggctggagtacagtggcacaatctcggcccactggagcctctgccttccaggttcaagtgattctcctgcttcagcctccctagtagctgggattacaggcactgccaccaccacacaccaaataattttttgtatttttagtagaggcggggtttcaccatgttggctgggctggtcttgaactcttgaccttaggtgatccgcctgcctcagcctcccaaagtgctgggattacaggcatgagccaccgtgcccagcctctttctacatatatttggcttctctttggcatatcccaattgccagcatcagtacccttgtgctttggggccattattaagtaaaataagggttacttgaacacaaacgctgagattgtgtgacagttgatctgataaccgagatggctacaggctggacacaggggtgattcatgtctgggtgggacagagcgggacagcatgagatttcatcatgcttctcagaactattgtcctgcacttcagatatgatcaagctgcagtttaaaatttatgaattgtttatttctggaattttccttttaatattttcagactacagtttgcctcagttaactggaatcacagaaagtgaaactgtggataagaaagactactgtatacaaaaaaatgtaccatgttacctttcaaaaaatctgaaaaattctgaattttcaaatacatctggcctcaagagttttggaagagggattgtatctgcatttccttatctagaagaatccagacttgataagtgctcatgataggttttgtctttgtttctcaccttctttatcatttccacagctgctgttggctccaaccccgtacatcattggggttcctgccagcttcttcctctacaaactggacttcaaaatgcctgatgatgtatggctagtggatctggacagcaatagggtgaggttcttggctgaggcattgtagagtctagaggaggattgcattctagacccagtcctgagatatctgtttctagattcctttcaggaacgtcctaagttgttggataatttctattgcgagacttactgaaacaagtttttttaaatgctccttttaccttattagccaaataaacccttggttaggtctcagagaattacaggatttatttttgccagaattaagtgaccccccaccatatcctccaagagcagtcagacagttgtgatctgagggccattacatgtggtatagatcatctcttaatggtttccctggggtatagtttccagtaagaaactgtctttcagtgcaggcttaattaattatatgaccattctgcaatgtgaatacattcagactttggtgggaagcccttatgtgtgctcattgtaaaacttaaaaaaaataaaaataagcgtaaataaaataagtgaaaagaaaaaccataatccttttatctagagataataaccaataacattaagttatatttcatttcagatgcatatgtatgtcatatatgtgtgtacatatatcttactgtgcagttatataatgtatattcgtttatataataataatgtatatacgtcctcttatttttatttatgtaagtgaaattcctgagcaataaactctaaggtcacgtcttttatcatttctctggtgcaggtgattgcccccaccaatgcagaagtgctgcctatcctgccagaaccagaatcactagagctgaaaaagcatttaaagcaggtaggtgaagaacgaaggaaagaaaggggagtattagatgctgtgggattcctataagaagacagctattctcagagccaatttcctatcaaacttcaagtggagtagttttcttcaccctggatgggcttaagaaaacgcgtatcccatttctgggtggcagagtgaatttctgtttttgattccaattcattgtatgctttaccatcttctaatgcttatgatgctgtataaaatagcccttcactctctgtttcttgtatgtgtgccactctctatggcttcagaacattttctcagtctttttttttttttttttttgagatgtggagtcttgctctgtcccctaggctggagtgcagtggcgcgatctcggctcactgcaagctctgccttctgagttcacgccattcttctgcctctccaggagctgggactataggcgcacgccgccacacccggctaatttttttgtatttttggtagagacggggttttgccatgttagccaggatggcctctatctcctgacctcatgatccgcctgcctcagcctcccgaagtgctgggattacaggcgtgagccactgcgcccggccgattttctcagtcttgttaggtggaagttagtagtgtggaccgtctggctgcttttatattatcttctagagttgatcctgagggttcctttcttcaaaaattcctttatttggctgggcacggtgcctcatgcctgtaatcccagcactttgggaggccgaggcaggtgaatcacgaggtcaggagttgaagaccagcctggccattatgttgaaaccctgtctctactaaaaatacaaaaattagccgggcatggtggtggacgcccgtagtccagctactcaggaggctgaggtagaagaatcacttgaacccaggaggcagaggttgcagtgagccaagattgcgccattgcactcctgcctgggccacagagtgagactcagtctcaaacaaacaaaaaaattcctttctttgagtaattcctcacatccattttttattgattgattttcttcttcctctgcatgctgaacacagtacctgaaggtaacacatgacaaagcttcattcccttcctctgccttatgtgttgtacaggaacaccagtagatagcactgtgtttatttttaggaatccctgctctcatttgaagggcctttagaaatctttttctgtgttgtctgaagtacttagtagtatctctagatgctatgtttgggtttaaatgggtcattgtgtttcatccctctcacctcagttgcttcatcactgctaatataatatgataccttgttactgcagagtctagtgggaattttaagttcagaaagttctctagctgccttcacttgctgtgttttcagtcttgatgattgctttagtatgactaatgagatggagaggttaataaatggaattatatttaattaaattaattaattaattaatttatttattttgagatggagtcccactctgtcacccaggctggagtgcagtggcacaatcttggctcactgcattctctgcctcccaagttcaagcgaatctcttgcctcagcctcctgagtagctgggattccaggcacacaccactgtgcccagctaatttgtttgtatttttagtagagctggggtttcatcatgttggccaggctggtctcaaactcctaacttcaggtgatccacttgccttggcctcccaaagtattgggattacaggcatgagccaccgtgcccagccagaattatattttaaatgtttgtaggagctaagatccttggactcattgatcctgtgttctaactcctgctattcaaagtgtggtttgtgaaccagcaacattagcatcactcgggcttgttaaagtgcaggatcactccaggcatattgaatcgggatctgcattttaacagcctcccctggtgattcttctcctcactcacatttgagaagcactgctgctctcgaccagtggtcttcacgctgccccattgagcctctgaggggccgatttagcttgggagccctgagcatttgaggctctgcttcctgtgtccttcagagcagctctgttttcaaatttccattctatataatttcacatagattccaattttaaaaaacatttaatgactataataattttgcaaacgactgtcgtggacttcagataagatcaagttgccttgagctaggttgtcttaagatggagagctacatatttcaaactgttttctaaaggctagaatattgggatttttatttcaaagatgaaaggtctgaaatgggttggccgtgatttgcaaattagcaccgttctttgttgcagaactttttgaccagagaatacgaggtagcagaccttaggaaggccttttccttggagttaagattggctagctgcccagggacgttccttgtgtaaggaattttcttgttgttccacaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaacgatgtggattctgtggatgttgcaaccaggtaagaccaagccgactgtataatcacaagttcttaaattaatttctttgctctctaagggaccttggggcagactatttctctgaaccagggttcctttttttttttttttttttttgagatagattctcactcttgttggagtgcaatggcataatctcagctcactgcaacttccacctcccgggttcaagtgattctcctgcctcagcttcctgagtggctgggattacaggcgcctgccaccacgcctggctaatttttacatttttagtagagacggggtttcaccatgttggccaggctggtctggaactcctgacctcagttgatccacccgccttgtcctcccaaagtgctgggattacagccgtgagccaccgcacccagcccagggtttctttatgtataaaatatatactatatttggttgttattttccaccttagtaaaatcaaagtgaagaaatagtaaaccacgtgctcaggatgaagagggggctgatgattctttaagatatctctccccttgatgttggaagcctgttaagtgatggctttgggaggtgttctaagactttggatcatgggaatccttaccctatgggtctcagattatctcatcatctgcttccccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacagtgagtctacctgccctctgctccgctctgccttgtgcctctgtcctcctgatggactttgatttttcctttgctaatgtttgacctgtgccttctatcctggctctgctttagactttttcctgcctttctttcaggcgttgcttgcctttttttccttgctgctgactttctgttcttttccctcatggggtagatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgataggtgagcatccttagggcagcaaaaaggttttaaaggtgaggaggctctcactagcccttctttagcacagagaaggcaaagtctcataggcttcccatatcagtgtttttaattttattttattttatttatttatttttttgagacggagtctcgctctgtcacccaggctggagtgcagtgacgcaatctcggctcactgccagctccgcctcccggcttcatgccattctcctgcctcagcctcccgagtagctgggactacaggcgcccgccaccacgcccggctaattttttgtatttttagtagagatggggtttcaccgtgttagccaggatgatctcgatctcctgaccttgtgatctgcccgcctcggcctcccaaagtgctgagaatacaggcgtgagccaccgcgcccggccttatttatttatttttgtatgtatgtgacagagtcttgctgctctgtcacgcggtctggagtgcagtggtgccgtctcagctcactgcaagttctccctcccaggttcaagtgattctcctgcctccgcctcccaagtagctgggactacaggtgctgccaccttgcctggctaatttttgtatatatatattttttgagatggagtcttgctctgtcgcccaggctagagcgcagtggcgtgatctgggctcactgcaacctccgcctctcgggttcaagcgattctcttgccccagccacccgagtagctgggattacaggcacatgccatcacgcccagctaattttttgtgtttttagtagagacaaggtttcaccatgttggccaggctggtttcaaactcatgccttcaagcaattcgcctgcctcggcctcccaaagtgctaggattacaggcgcgagccactgcacccggctactttttgtatttttagtagagatggtgtttcaccatgtttgccaggctggtctcaaactccagacctcaggtgatccacccgccttagcgtcccaaagtgcttggattacaggcatgggccactgtcccggcccccatatcagtctttatgctttggttgactgtttttcttggcttctttatttgatttgttccctggccttgagttcggagtgctcccccttttatttttcctggtgctgattgtaggtgttctccctgcccctttctgttttgtttgttttttatgcacttcactctgcagtggcagtgatagtatggattatgacgattcaagctcttcttactcctcccttggtgactttgtcagtgaaatgatgaaatgtgacattaatggtgatactcccagtaagtgtgcttggggagattggccagccctgggcaggggttgggggcccaaggatggagtggtctgtacctgcctcccttggattttggcagatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgtaagtgaggagcggtggatgagtgagaaccatggcctgggatgtgggcctcatctattaggaaagccaggctgtagctattcatttgctgcttctcacacaattttctcatcttcctcttcatgggccctagagcttagagcctaagagacctacttttgaccccaaaaggaggtcatcaggctttgttcagggtacagctatgatcccccttatatagtttgtggggacagagaacgggtgctacagagatcatttcccacacattccttaggctagaaatctgacaggcctggtccagccctgccaaactgggattacaggaaggtaccattgggcaccaggtaaccacttttaatttcatgcggcctttaggaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcggtgagagcctgggcatcccttctagatgggtgactgaaggacctcacctcagtggaccctgggcaagggttaatcagaaagtctgagaagtctgaatgctctcgtggtcctgccatccccagaggatggtgttctgatccaggggcttaggaattacgggaagggagtggcaactgtagtatagcataattatggcccatactcccaagatcaggtacccctgcctggggatcataggtgcctctgtgcattcaagggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagtaagtgccttcagctgtctctctcactcctgtgttccattttctctacagcagagcctgactatggcaaatgttgcttagaacttcacatgtagggctaggttggcattagcaagccctaatccagtcatttgggtgatactgaataaggcgttttcaagtgaggtcagtaaaggacagggacagattagtcattatcattatgcctggacatttcagtctatttcaggtaagacagctggatgggtaactggaaaacaggcagtaaattcaaaatcacacacttgtacttatattttgtggaaatactctggtcaaatttgatttgagtccatatctggtatcttctttgcctcataacggactcttccatgaatgtgctttgaaatcgatatgagattgaattttgtgcttagatagtattcccagcagtgcagggtcgtatcagctaaagattgaagacagaccatggactagagagagcgaacgtagaggatccctgtgattgtgagtttcttcagcagccagggagggacagtgccagcttcagaccagaagcctgttaactgccagctttcatgctgtgtagcagtggatgagagacttggatattatcatgtgaggtggacagagaaagctgttactgggttttggctgatcctggcagtggctccattgtttgcctggagttagacttgatcctttctaagacagatcagagatgatctgatccaccaaactgggattgtgtttgaaaaggagggaggtgcagatgctgatagtcattagtctactgctttgattacttactctgccaagtcatcgctcttgcaccctccccttgataggcagcctctatcggaaccacagtaccagcttcagtctttcaaacctcacactgcccaccaaaggtgcccgagagaaggccacgcccttccccagtctgaaaggtaactacagccttccttttgccaagccaggtttctccgggagatgtttcgggctgtgggttcatgtcaggagccctgcatctgctgaatcctttgacctggttgtcgtccctcatgttgctcctcatggctttcaccgcacatcctgggctctgatggttgtcagatggaaaccatctttgtagctagagacggccctgttatgtcatttaggacaatggcaactgtgggattactgctgcttcgcgggaggaccctgtcagggtatatgattaacatagggatcatcagctgcccccagtcgtctgctgggttgccactgcatgaacttagggcaaattccgtgccaaggagctggcccaccagagaatggttatggagagcctggcagcgttcatagagcacagcctctcacctctcacgcactcataagcctgtcaacccagggcttaatgagtgcgccaggtagtattggttagtttctaggggcagttaaaaccttatgtgaaagccaggcgcggtggctcacgcctgtaatcccagcactttgggaggccgaggcgggtggatcacgaggtcaggagttcgagaccagactgaccaacatggcgaaacgccgtctctgctaaaaatacaaaagttagccatctggtgtcacgcacctgtaatcccagctacttgggaggctgaggcaggagaatcgcttgaatccaggaggcggaggttgcagtgagccgaggtcgcgccactgcactccagcctgggtgacagagcaagactccgtcttaaaaaaacaaaaaacaaaaaacgaaaccttatttgaattggtttgtgctatctgacagtttcaggggcttttctgaatttgattttttattttttttattttctgagacagtgtcactccgtcacccaggctggatggagtgcaaggtggtgatcttggctcactgtaactgccgccatccaggctcaagtgattcacatgcttcagcctcccgtgtagttggaattataggcacataccacctcgcctggctaattgttgtatttttagtagagacggggtttcaccatgttggccaggctggtcttgaactcctgaccttgagtgatctgcccaccttggcctcccaaagtgccaggattacaggtgtgagccactgcacctggcctgatttttttgttttctctggatggtatgacgaaatatttaactgtggtaggaagtgcagtgagaaacatgtattttttttttttttttttttttttgagacaagagtctcgctctgttgcccaggctggagtgcagtggtgcaatcttgcctcactgcaagctccgcctcccgggttcacaccattctgcctcagcctcctgagcagccgggactataggagcctgccaccacgcctgcctaattttttgtatttttagtagagacaaggtttcaccgtgttagccaggatggtctcgatctcctgaccttgtgatctacccgccttggcctcccaaagggttgggattacaggcgtgagccaccgcacctggccaacctcatgtattctttaactgacctctcattcctagtggtaaaaaatgtcaggttacttgggtgcagtagctcacacctgtcatcctagctacttgttaggcagaggcaggaggttcatttgagcccaggagtttgaggtacagtgagctataattaggccagtgcactccagcctggacgacagagtgaaaccctgtctctaaaagaagccaacagaaacaaacaaagttgtcaggagtctaagacatgttcttaggtgaggatgggaacattggataaatgggcaaaaggacatcagagctggcagtgaaaggagcgaactagcactgccagggaatccacatgtggccgggtaggctaaggatggaagggtgtcagtgtcactggccttcatttggtacatttgaagagaagagcgattgaaactctttcattgcatgctgatgctttgtcgcatttgctgcacttaccctctcacccatctcccatcctcataccctgaccccactccccacaacagcatctgcaagatgggttgcttccctgcacataccctcaggcccctggccctctgtgctggatgttttctgaaaaccagcggtccctgtttcatgcatgtgtgtgttcagtacctgaaggctccctgtgtcatttacccgcccctggcttgagaggccagttttaagggtggtcttttcttagagccttggttgtctcctggtcacttggcttccagctctgaggtgcccaagaaccaaggttatgtgcattcctcaagctttgggagaatgctcagattatctggcttactgctcctcggaggggtagaggggttgcggtattgtggtacacctactaattgtgtattttgtgtcccagtatttgggctaaatactctaatggagattgttactgaagccggccccgggagtggtgaaggtgggtcttgcctgtgagctgtgcatgatcttttttttttctctagcatcttctgtgcctgcccgagggccatccttctcatggagcaagcagcgtcacatgagtgacctgcttgccccgtcccccgtgacgcccatgcttgcccatggggcttgctgctggtgcatgtggagtggcctgagtctccatccccacctcctccacattgccatggctggtttctacctacgtatgatgccttggtgctaccctcacccagcccttctgaggaacgggcatggaacatggctacttagggctgtgctggcatgagctcctgtactacaatagtgatgtctctcattcctgccttccctgccacaggaaacaggagggcgttagtggatcagaagtcatctgtcattaaacacagcccaacagtgaaaagagaacctccatcaccccagggtcgatccagcaattctaggtaataaatggtagagctgttttaaaagttctcaggcagaggtggggtggttcctctacagaactttagggatgctcaagagtgggagagaagctctcaatggggtagatgtaatcaatttcttgccagcacttctcattctggcttgatctccatgcaactgaaagcttacagtgttgaggggggttaatcagcagcggtgggtatttggacaaatcgcgtgctccagagaggtggggatgtggtgcacttggacattcagagacatggctttgtgttttacccctggaggcagacatctagtctgggtgaaaggtggggggtgctctgcaaaggagctgatgaccacagaagcggtgtgtggaccctgtagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggtcagtgttgggggtagggaatcggagtaactggagagagggatgtgaacaccacaggcaatttgccaacgctagcccctgggttattgttgcaggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaaggtagggatcgtacttgctgggcaccacgccatccctaactctgccacttgtctcctgaagagaaaatatatgtgtacccaggacacgtttcccagtgccacgctgcttcccattaggctttgggattttattttctaatgcatgtttatacgcagtgggtattctttgttacgaaaaataagacatcagctcatctttccttgaacttcttccattccgcaccctcctgtatcctggctcctcccacctcatatctgcgccttgattcctactcactacttctcttgacctcttgatatttttccctcagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattggtacgtatcagtgtgtttggtgtggtggaggggtcctggcttcttaaatatccctttctcctcaattcatccagaatcctgcctttctctgccccatgctttgcttcttagagagggaagggggcctgtgtccatttctggtggtgtttctttgtacttctctagtctttatgcttcatccacagccaccccccaccccgtatcttagatgaagaatggtaagttttgtttagagggcccaatgaggcttactgcagggggtgtgagctgtactcctggcccctccttttatttacgtctgcatttcttcacatagtggagagaattcctggaagtgctcaggaagtttatagatgcatctttgggctataaaattatgacatttgtgtctctgaagccagtgtcctcccatccaaccattatactcctctggaatgtgctcctctggggcatgcctggcaaccccatttccctgggttctggatctttgaggtataggtttccaagtcagttctttaaatgcttcttcactggacttgattataatctcgtttacatttggtgtttctccgttcccacaaaggcagtgccttagtgagctttctaggcatcacctctgtttggctcactccctgcttgaccttgagtcatcgaggttggatctttctttttctggttctaggtccctaggcactctgcttccagctgacatctcattgccatggccattagcagttgccatatgctcccataaatggtgacatggaaccagattcctttttaggggagctacacttccctagccagcagaatattattctagtagcagtcaactcctggctttctcctgcctcatgtgatgttgtagaaaatgtactgacctgctagtctggagatctggagttttagtcccatatcagcctccaactaggaatgcaactttgggcaaataacttcacctctcagggtatctgtctcttcatctgggaaatgaggaaatcatactaagtacactctgaagttccttccaggaaaagaattgctgtggttgccattctgtctgcttttccctatgaagatgctggtcttgaccattttatgttctctgtcacctcaactggaggcatttttccagatcactggtgggtagggcaggtaggggtgagttggtttcttgaggagcaatgaggagggatgctaactgcctgcatgaattggcctttgttcagtccagtgaatcaagcaaagattggtgttcttccttctgaaactctggctgcttgaggtgttcatctgtctcatctggaatctgaaaaattgcccttccccagctcatttggtagagagagtgtgtggcatggtgggagtttaaatggatcctaagttacatgatcttgatcaagtgctccagcctctttaggaccagttcctcatgcaaaaatgaaggagctttgttaagggcacttccagctctaacattctgcagggtttttactgccacattgggattggaattagaaatttggaatctgttcatgagtttgggtggaggggttagatctcttgttttctgccccttctccccatgaagatatctttgtatctcttggttggtaatccagtgcctgagactgaatcgacttgggtgggtgggtttccatttcgtctgtctgaccagcctctgactttctgtctttctctcctgcttgcattgcatctggggtagaattgtggaacaagcaccaggaagtgaaaaagcaaaaagctttggaaaaacagagtaaggaacaaatgccctttcctgttcccaagtcctccatacctgccaactccccaggcccagttggggcaggctccctttgtcagccccaccccaaatttgctcttagagcgtgtttggaatggcagcaggtaggtagcatgtgactcctaggtgtgtgtaggccgcttctttccccctcccctcgtgtcaatcaggctataaccaggtgtctactgaatacaactccccagaacttggttctctgttgcttcagagttggtggggagaatgtttgcctattttagtgccccccattggctgatatctcccacacctgttagaaggcctgtgggcacagttggcagagatggttgctgtccctccatgttgagtctgtagctgccccactctctggtggcttgcctaggcacgctttcttgctttctgtcattctgtctttctgccataccattgtgggtgggtgggggacaaggggggtggttttcatctcaaacatagaagttgtaggatggaggtaggcagtgcccaccaaaacagctggtgtttcttatctcatcgggcccaaccttttctacctcctttagacacatttgtttgggaagcattaagggacctggggaccattaaatggtttcaggtaccagtgaagctcagactcttgagtgccatggaatgtggtttagacatttgttcgtggagcttttctttttttttttttttgagatggagtcttgctctgctgctcaggctggagtgcagtggtacgatcttgcctcactgcaacctctgcctccagggctcaagcaattgtcgtgcctcaacctcccgagtagctgagattacaggtgtgcatcaccacgcccggctaatttttgtattttttggtagagacagggtttcatcatgttggccaggctggtctcaaactcctgacttcaggtgatctacctgcctcagcctcccaaagtgctgggattacagtcgtgagccaccatgcccagccttgtggagcttctctgttttaagatgatttgctcagaattttctcaggttgagaagatggctggagaacccattgagaccaggtctgatttgtcctacttggttcttaaggcatctggggtcctctttttccagtgggtcctgagtggggggtagtccttggaaaggtgactaggatgggctgaacgggtctgggaacagcctgtgctgccgtcccaccccctttaccagcctgcccctagcctttgtgcacggagtaacagaagtcttcccctactcagggcctgaagtaatcaaacctgtctttgaccttggtgagacagaggagaaaaagtcccagatcagcgcagacagtggtgtgagcctgacgtctagttcccaggtttgtgacaaccttgttgaaatttgcaagtattaaatatgctgtctcagaatacttctttaagttaaaatagaacagtcagacagccgggcacagtggctcatgcttgtaatcccagcactttgggaggccgaggcgggtgggtcacctgaggtcgggagttcgagaccagcctgaccaacatggtgaaaccccgcccctatgaaaaatacaaaattagccaggcatggtggcgcatgcctgtaatcccagctactcgggaggctgaggcaggagaaatgctttaaccggtgggcggaggttgtggtgagccgagattgtgctgttgcactccagcctgggcaacaaaggtgaaactccatctcaaaaaaaaataaaaataaaaataaaaataaaatagccaggtgcggtggttcatgcctgtaatcacaggactttgggaggccgaggcaggtgggtcacttgaggtcaggagttggagttggagaccagcctggccaacgtagtgaaaccccgtctctactaaaaatacaaaagttagctgggtgtggtggcgggcacctgtaatcccagctacttaggaggctgaggcaggagaatcactggaacccgggaggcagaggttgcagcgagctgagattgcgccactgcactccagcctgtgccgcagagtgagactccgtctcaaaaaaaaaaaaaaaaaaaaaaaatgaacaacctcaaaacaatataaataactaatgataagggaattattaaataagtataatagatccatgtaatgcaatattagtatccattaaagattgtgttttcaaaaatttagtgacatgggaaactgtttaacaaagctacctatagtgtgactccaattttatttttaaaatgtattgagaaaaaactgaaaggaaatatactaaaaacagtggttaacgtgggaggtagatttacagcttgttcttatttccttattctttcatgtattttctacagtgagcatgtacttctttaacgcattgttttttgtttttttgtttttttttttgagacagggtctcattctgtcgctgcagctggagagcagtggtgtgctctctgctcactgcagcctcaaactcctgggctcaagtgatgctcccacctcagcgtcctgagcatctgggaccgcaggcacccaccaccatgcctggctaagtttgtgtattttttgtagagatggggtttcgccatgttgcccagcctggtctccaactcctgggctgaaatgatcctcccacctcagcctcccaaagtgctaggactacaggcgtgagccactgtgcccggcctatttcttttttttattacataagttgtacatattttatattctggaaacaaaagttgctcgtgacttctctaaggatgataacagaagggtggggatgaggagaaagaaaaaggtacagtatttctgtgggaaactgagaggagattggacacctcccctaatgttcctgtgtcttgtttcagaggactgatcaagactctgtcatcggcgtgagtccagctgttatgatccgcagctcaagtcaggattctgaagttagcaccgtggtaggggaacaccacactggcatcttggtgggtggggtgtggatttcccctttggaaaagggtgctactttctctttggaggctgctctgagtctcaggtcagcatggttctcatggtggagatgtttaccatcataggtgtgtgtatacgagatttcacccagagcttctcatcttataaagaaggtacttccagaggctatctgacacacttttgaaatttaatacttttttatggtggcagggagctctaacagcttggtatttctggggcccatccctggggactgtctcttactaccttttttcctttccaggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttgtaagctttgtttattaacaaaagaaaaccatttctttaatgggggagggaagcaggcaagaaaagaatgaaagttaagagacgctaaagaggtaaaggttaaataaggaagaggtaatcttcttatatttggctttaaggaaaacatttcttaaggctttgttcagagtcatttgactcacaatctggggcttttagaaccctctcctgaatcattgatgagttaggctccgtgcccagtcacgtaagggctttgaatcctatgtagtattaacccccaggtttaacacaggcaaagtaatacctttgtggcaatgtcaggacaattacagctctcgtttagtaccagtctgcctatttctatggactatccagttttattttggtcactgctctatttataaataaaatagcattttattttagtatattcctaacagttatttgaagttttcattcattaataaacatccatgaagtgatttactaagtgccagattttgtgctaaagaaacagggatgaaaaaggcatggtttctactcaagaagtttgtgattcactatattgctgtgagtagtctcttctaataggtgaggggaacaatgccttaggaaaaaagaacttccctagatcacacagtaagcccatgatcagctggaaggagatgaattctttttagtccttgccgtagacatctgttttttgttgtttttttttttttttttttttacacagggtctcactctgttgcccaggctggagtgtagtggcacagtcactgctcaactgctcactgcagctttgacctgttaggctcaagtgatcctcccacctcagcctcccaagtagctgggactgcaggcatacaccaccatgcctggctaattttttagttttttgtagagatggggtttccctctgttgtctaggccagtctcaaactcctgggttaagtgagcctcctgccttggcctcttaaagtggcatgagccactgtgcccagcctctgctttttaatgtgtatgtgcctctataggctgtgttaaaacactgatagacttgttactttattaaacagagatgagaatggatgttctctacaagagcttatacgcataggtccttatctttaaggcctatggggagaaaggaagataaaagttaaatgaaaccaactatttaaaactggttatcattcccacccccagagccttctgtatgtgtgtttttaatagagtcagtgacctcccagagtggagattgggaataggactgagaggctactcaagttaatgggccttaactctctctcagtctgaacagactgattggctgattgagtgattgatttttcttttgtgctgacagtttattaggggttttcttttcttttcttttttttttttttgagatggagtctcgctgtgtcacccaggctggagtgcagtggtgcgatctcggctcacggcaagctccgcctcctgggttcacactcttctcttgcctcagcctcccaagtagctgggactacgggtgcccgccaccacgcccagctaattttttgtatttttagtggagatggggtttcaccatgttagccaggacggtcttgatctcctgacttcgtgatctgctcgccttggcctaccaaagtgctgggattacaggcgtgagccactgctcccggccaagggttttcaataatgttttcttttcttttctttctttctttctttttttttttttttttgagatagaatcttgctctgtcgcccaggctggagtgcagtggcgcgatctctgctcactgcaatctccacctcccaggttcacaccattctccttcctcagcctcccgagtagctgggactacaggcgcccaccaccatgcccggctaattttttgtatttttaggagagatggggtttcaccgtgttagccaggatggtatcaatctcctgaccttgtgatctgcccacctcggcctcccaaaatgctgggattacaggcatgagccaccgcgcccggccttctttacatattagttcaaccttcaccacaaaatctaaccatggatcgtaaaaattaaattggcaacggggctagcctgctatacttcctgtttacttttagatgcttttcaaaccaataaggatgacatttgtggtggaaggagccagagtaataggaaaattacttctcttcgcttagaagaaaatcctccaccttgagcatcttctgaactttttactataagacatctcagtgcttgcttgtactcttcagccgcataactgtgaagatagcaaccatcagtttctcataaatggaagcggcagtgagaaccgtctacagcagtttggcttcaaggcctgtgtagaggcccattattccaaaacacctgttagccatttgtatgtcttcttttgagagagatctattcagctcatttgcccatttttaaatagattatttgtgtttttttgctgttgagttttttctttcttgtatattctggctattaatcccttgtcagatgaatagtttgtaaatattttctcccattctgcagactgtctcttcactcatttcatcgtgtcctttgttgtgtagaagctttttagtttaatataatcctgtttttgcttttgcttttgttgcctgtacttttgaggtctccataaactttttgcccagaccaatgtcctgaagcatttctgctacgttttcttctagtagttttatagttttgggtcttacagttaagtctttaatccattttgggttgatttttgtatatggtgagagctaaggggtctagttttatttttctgaataatggatatcaagttttccgagcagcatttattgaagagactgtccctatccccagtgaatattcttggttcctttgtcaaaaaacagttggctataaatatatggatttctttctgggttctctattctgttccattggtctatgggtctgttttttatgccagtagcatgcagttatggttactatagctttgtcttatattttgaagtctagtagtgtgattcctttttgtccaggattgttttggctatctggggtcttttgtggttccatatgaattttaggattttttttctatttctgtgaagaataccgttggtattttggtagggattgcattgaatctgtagatcacttttggtagtatggtcattttcacaatattcgtccaatccatgaacatggtatatctttccattttttccctatactctttcttacatcagtgttttttatttttcctcatggagatcttttacctccttcataaaagataaatttctcctaagaatttattcttagggcattaatttgtggctatcgtaaatgagattgccttcttgatttctttttctgctattttattgttggtatatagacacactactgatttttatgttgattttgtatcctgcaagtttattgaattcacttattagttctgagttttctagtggagattttagggctttttttttttttttttttttttttttagatggaaccaggctcaagcagtccttccatctcagtctcccgagtagctgggactgtaggcatgcaccaccgtgcccagctgatttttgtattctttgtagagacaaggtgttgccatgttgcccaggctggtctagaactcctgggctcaagcagtccacccgccttggccacccaaagtgctaggattaacaggtgtgaagcacaacacccagcctaattttagggacagtttgacttccttctgtccaagttggatgccctttatttctttctctggccaattgctttgattagcatttccagttgaataaaagtggtggaagtagacatccttgtcttgctacagattgtagaggaaaaactttcatctttccccattcagtatgatgttggttgtgggtttgtcatatatgacttttattgttttgaggtatgttcgctctgtacctaacttgttgagagcttttatcatgaaggaatgttgacttttatcaaatacttttgtatttggtattcgttcttctttaaatgtttttagaattctgcattgaagctattgggtcctgaggctttcttttcttttttctttcttttttttttttttttttaagacggagtcttgctctgttgcccaggctggagtgcagttgtgcgatctcggctcactgctacccccgcctcccgggttcaagcagttctcctgcctcagtctcccaagtagctgggattacaggcgcccacgaccacgcctggctaatttttgtattttcagtagagacagggtttcaccatgttggccagggtggtctcgaactcctgacctcaagtgatctaccccccgcccgccccaaagtgctgggattacaggcgtgagccactgcgcccagctttttttctttgagacagagtctcgctctgttgctcaggctggagtgcaatggtgtgatgttggctcactgcaacctctgcctcccaggttcaagcaattctcatacctcagcctcttgagtagctgggattacaggtattcaccaccatgcctggctaatttttgtatttttagtagagacagagtttcaccacgttggccaggctagtcttgaactccaggcctcaagtgatctgcccgcctcagcctcccaaagtgctgggattataggcgtgaaccaccgtgccctgtgatgggaagctttttattacagattcaatctcattacttgaaattggactattcaggtttctgtttcttggttaaatcttggtaggttgtctatgtctaaatttatccgtttctaatttgttggcatatagttatagtctccagtgattttttgtttttctgtgatgtcaattgtaatgtttacttttttgtttttggtgttttcttggtggaggtcttttcactctctctctttttttttttttggttagtctagctctaatggtttgtggattttgtttatctttacaaagatgaacttttcattttgttgattattaatttatttattttgagatggagttttgctcttgttgcccaggctggagtgcagtggtgcaatcttggctcactgcagtctccacctcccaggttcaagtgattcttctgcctcagcttcccaagtagctgagattacaggtgcccaccaccacaaccggctaaatttttttttgtatttttagtagagatggggttttgccatgttggccaggctggtctcaaactcctggcctaaggtgatccacccatctcagcctcccaaaatgctgggattataggcatgagccaccacgcccggcctatttttttaagtctcaagttttatttctgctctgatcttgattatttcttctaattttgggtttggtttgttcttgctttcacaattctttgagctgcatcattaagttgatttgaaatcttcctacttttttgatgtgacgtttattgctataagcttctttcttaatactgcttttggtgtatcccataggttttggtatgctgtgtttttatgttcatttgtgtgaagaaatttttaaatttccttcttaatttctttgttgacccattggtcactcaggagcatattgtttaatttccatttatttgtatgattttaaaagtttcttgttatttatttctaattttcagagcacagtgttcctttgtggtctgaaaagatacttgctgtgatttcagttttcttaaatttctcattatacttattttgtggcctcatatgtggtctgtcctagagaatgttctgggtgttgatgaaaagaatgtgtattctacacctgttggatggaatgttctgtaaatgtctgttaggtccatttggtctaaaatgcaatctaaatgtaaaatgtagtataaatccggtatttctgtgttgattttctgtctagatgatctgtccaatgctgagagtggggtattgaagtccccaactgttattgtattggtgtgtatctctccctttagatctaataatacttgctttatatagctgttctgtgttgaatgcatatatatttgcaattgttatatcctcttattgttattacataattactttctttgtctctttttaggttttttttgtgtgtgtgagacagagtctcactctgtcgcccaggctggagtgcagtggcgcaatctccgctcactgcaacctccacctcctgggttcaagcgattctcctgcctcagcctcccaagtagctgggactacaggtgtctgctgccatgcccagctaatttttgtatttttagtaaagacagggtttcaccatgttggccaggctggtctcaaactcctgaccttgtgatctgcccgcttcggcctcccaaagtgctgggattacaggcgtgagccaccgtgctcagcctctttttagtttttgacataaagtctgttttatctgatataattatagctactcttgcttgcttttggtttctatttgtgtgaaatatctttctccatcccttcactttcagtctgtatgtgtctttgctagtgaaatgagtttcttgtaggcagcatatagttaggtcaagtattttttttttttaatccattcagccagtctaccccttttaagtgagggaatttaatctatttacattcaaggttgttattgatagtgtggacttacttctgttgttttgttaattgttttctgattattttgtatgtcctttgtttcttcctctcatttatcattatggtttggtggttttctgtagagataaggtttgattcttttctttttctcctttgtgtgtctgttctacaagtggatttcatacttttgtgtattttcatgatagtaattatcatctttttacttccagatgtaggactcccttgagcatgtcttgtaagggtgtgatgacttcctcattttttttttcatgtctgggaaagacttagtttatccttcatttctgaagcacaactttgctgggtatagtattcttgactgagattctttttcttgcagcgctttgaatatatcatcccattctctactggcttgtaaagtttctgcagagaaatctgttagtttaatagagattcccttaaatgtgacttaacacttttctcttgctgttttttttttttttttttttgagacggagtctcactctgtcacccaggctggagtacagtggtgcaatctcggctcactgcaagctccgcctcctgggttcacaccattctacctcagcctcctgagtagctaggactaaggtgcctgctaccatgcctggctaatttttatgtatttttagtagagacggggtttcaccatgttagccaggatggtctcgatctcctgacctcgtgatctgcctgcctcggcctcccaaagtgctgggattacaggcgtgagccactgcacccggccttctctggctgtttttagaattctctctttgacttttgacaatttgactgtaatgtaccttggagaggccttttttttttttttttttgagacagtctcactctgtcacccaggctggagtgtagtagtgtgatctcagctcactgcaacctgcgccgcttgggttcaagcttttctcctgcctcagcttcctgagtagctgggattacaggcatgcaccaccacgctcggctaatttttttgtatttttagtagagataggatttcaccgtgttggtcaggctggtctcgaactcctgacttcaaatgatctgcccgccttggcctcccaaagtgctgggattacaggcgtgagccaccgcatctggctggagaggacttttttgggttgaatctgtttggggacttttgagcttcctggatctggctgtccatctctctccccagacttgggaagttttcagctattatttcattaaataagttttttatgcctttccccttctctctttggaaatccaataatatgaatatttgtttacttaatgagatcccctaagtgttgtagaccttcttgactgttttccattctaacttttttccctctgactaatttcgaatgacttatcttcaaatatagagtcattcttctgcttgatcaagtctgctgttgtagttctctattgtattttttccttttttttttttttgagacggagtttcgctcttgttgcctaggctggaatgcaatggcactatctcggctcaccgcaacctctgactcgtgggttaaagcaattctcctgcctcagcctcccaagtagctgggattacaggcatgcgccaccacacctggctaattttgtattttttaatagggacggggtttctccatgttgcttcggctggccttgagctcccaacctcaggcgatccacccacctcacctcccaaagtgttgggattacaggtgtgagcccccacgcctggccctctattgtattttttaaactttgttcattgaattattcagctgcaagatttctgtttttttgttatgatttttatctctttgttgaatttctaattcatatcatgaactgttcttctgattttgttgaatcatctatctgtattttcttgtatctcattgcatttccttaagatcattacttttaatttattttctggcaattaattgatttccttttcattggggtctattaccaaagagttattatgttcctgtggtggagtcatatgtccttgtttttttcatgtttcttatgtctctgtgttgataccccacatctggcagaacagtcacttcttccaaactctctggagtggctttcatagagaaagactttcacatgcagttgggttttagtgtgccagttgggaagggtatggcaactctgtttctggatagatgtagtggtatgttttctgtgtagcttcttcagctgcattcaacatgagcaataactatgggtgcctcaagagtcctaggctatagaagtgtggcagtggcagtggtggtatatgttgttaatatccttggtgtcaaggagttttggagtcctcctattctcattttcctcacaatggagtgactcagccaagagaatccctcttggtgtcaggtctgactgacatggcctacaagcagctgcagaggcactgggttccaggtacagatgcgtggagtagctgtggagtcaggtttccaggcttagggtctcacaaacctattgtggcacctgggtattggggtacagatttgctctctgtggcaaggttggatgtaggttgcccacagagccaggatctgaggcacccgctagcagctcaggcccaggggactggctcataactgtgattctaatactgggggataggccatagcactggccttactctgtggaagaaggggtgctctggaggtttgggcctagggagcagggtacagctgcaattcagggatctgagccaatagggctcagtggcagctcaggtcccacggaatgaggcaccatgtagtagtgactctagactccaggatggtggggcttggctgtatcctagactctgtgaagccaagtgcaatggcagcgaataccccagcgtggcagagcacagctgtcatttgggccctgggggtcagggagcagcacagcaatgactccactccccaggaagagggtatcttagcagctcagactctaggggcaagtccagttccagggaagcagggtactggagttgtttggctagggcaaggtatctcagctcagccactgctctgtttcctgggacatggggtactgtgtcagctcagccctggaatgcgtagctgctcagcttggccagccaccaattcccctggggacaatgtgctgctttagcacaggcctagtgtgggcatgactgttctgggtgacccaggcacagtatcattggaatgcagggtgccgcttcaagttaggtgctaggatgcatgactgccctgggtggccaaggcaccatttcctgggatacagattgcttcttcaccttaggcaccagggaggcctgactgctctgagcagtctaagtactgttttcatagtggatagggtactgcttcagctgcagcccaaggggagtggggaggggtaggtggagtggctctgcctccacttggccccttggggaatcatgtaatagctgctcacagcttggcttagattgtcaagacatcaggctagagtggtttgttggtggcttagcctcaggaatgaaggggagctgtggccatctgtccccagagcaaaacacaatcccactgtagctccacttccaagatggcatagcacagtagctgcacaggccacaggggctggcgcatagtattggctccttctctggagggagcacagctgtatggactccaggcagctccttcagctgggcttagtgcctagaggactgtagggaagccagtggtgaagtctgtaggtgtccaaggtgctggtggcagtttctagaattgtcttgcttacttccttgctgtggggagaagttcctccttgttcccagctgatcctagatgggggaagggggatgggggggaggcctgatattgccatctgttctctatgtggccatcctgagtttctgtgctcatcagcattcctgtcacccttctgatacacccccacagtctccctcagttatttttgttaaaagtatagctgtttattactctacctctctttgtgagggggatgtgctttaggggctgctcggccatcttgctgacattactcccctaggctgtttttttttgttgtaactttttaaaaatgtttatttatttacttttgagacaaggtcttgctctggtgcccagactgcagtgcagggtgcagtcatggcttggtgcagtcatggcttactccagcctcaaacttctgggctcaagcaatccacccacctcagcctcccaagtagctgggactgtaggcatgcaccatccctcctggctgagatttttatacttttttttttttttggtagaaacaggttcttgctatgttgcccaggctggtcttgaacttctgggcttaagtgatcctcctgtttcatcctaccaaagtgccaggactatagatgtgagctatcatgcctggccaaagtgagctgctttaataagagtatttgaaattattccagtgtgttttaattccaaatgtattaaaataggtatgatggagtatcggtcttgcaggaagccattcagcttcagtgtgctaccttttctggcatctttctgggacaaattcgtatttgttctatgctggtgagcaagggctctttatacagagctgctgagtgtagcgacctaaatttttttgctcaaacaaggctgttttaataagaaataaattatataaagtcacgtgatccatttagtaaaatattgggctgtgaaccaggagactggtatttagtcacactgattaggtcttacccaataacctttgatcagttgcctctctacttactctatttcatgtgttgtgaaatggcatgatattacctacctctgatctagttgaaaatcttttttttttttttgtgagatggagtctcattctgtcacccaagttggagtctcactctgtcacccaagctggagtgcagtggtgcaatcttggctcactgcaacctccgcctccagggttcaagcgattctcctgccttagcctcccgagtagctgggactataggtgcatgccaccacacccagctaattttttgtatttttaatagagacagggtttcaccatgttagccaggatggtctcaatctcctgacgtggtgatcccaaccaccttggcctcccaaagtgttgggattacaggcgtgagccactgcacccagctgaaaatcttttaatgaatagaaaatctactcagaagtagcagatgaagttagtgatattttttagggtcagtaagagttgataggaaagaagaaatgaacatttctcagttactggccaggtgctaggcactgttaggtgccttatatgtatcttcaaatttaattcttgtaaagtagtcctatgaggtaggtattataaccttcctttgacagataaggaaaatgaggctcagcgaagctgatttctgtacctaaggtcacacagctaataagaggcacggatctgaactttggtcagtctgatggcaaaccctgggttctttctgctgtgttatgttgctacacagagaattaatctgattgttgtttttgttgctttaaagagaaaataaccttacagagactaaggagtaaagataagtcaaaaatgaaaactttattgtatagtttaggaggcagtaacagaaagcagcgtaagtggacttgcagaagcaggggtactggagtttatgttgctaatggatggtgactggtgtgagagcctcttagtgaagtgcgtggtttcctttgtctctattcattgctacctctggccactgacctatcacctcttctctctagggtaaagcccacagcttgaagccaagcataaaggagaagctggcaggcagccccattcgtacttctgaagatgtgagccagcgagtctatctctatgagggactcctaggtgagaaacacactgggaaggccctttgcactggagaaagctgactcagccaggggagagggtcacactgaacaagtagctggttgtctttctgctgatcttaatgctaacattagatagcagttttatacctgaagcaagcgacttactgggtccagaacaagcagtgggtgaaaactggacaagattgggttttggtgttaatcaacagcctttgcctttctgtcttcctttctttcctttcttgctaccatggtccttcctgctctcaaattggcaggaagggacaaaggatccatgtgggaccagttagaggatgcagctatggagaccttttctataagtaaccacatttatttgtgtgctgtgttcatccctcctccttgggagggactgggccttacttggaggcatctggggctggtggcaggcatgttagatctggggtagaaagattgtgtttcctttgccctggaatttgtaattattcccttttatctggattttactctttatttttgtttggcagctatattcttaaatgttaaataggccccctaagaaacctttattctatgcaggcaaagagcgttctactttatgggaccaaatgcaattctgggaagatgccttcttagatgctgtgatgttggagagagaagggatgggtatggaccagggtccccaggaaatgatcgacaggtatggggcttaggaaaccattgggaatcagcaaactcagcctcctcccagttagttctgtggtctcccacttgagggctgacttgtgcttggtcttctccttaggtacctgtcccttggagaacatgaccggaagcgcctggaagatgatgaagatcgcttgctggccacacttctgcacaacctcatctcctacatgctgctgatgaaggtaatgtcaattttgctgtgtccagctccgctgatcctagaggggcaaggcttgttcctgtcgcctaaatttcggggtagctgggaagctatcaaggtatcttaacttagggctatcttcttgattgaaagtctgaggcctctctgccagcttacaaatgttccatttatctgaagctgccagccagttttactaaggagtgttgtaggaagaactgatgattctctttttttttttttttttttttgagacggagtcttgctctgtcacccaggcaggagtgcagtggcgcaatctcagctcactgcaacctctgcctccccagttcaagtgattcttgtgcctcagcctcccaagtagctgcgattacaggcgcacaccaccatacccagctagtttttgtatttttagtagagacagggtttcaccatgttggccaggctggtctcaaactcctgacctcaagtggtccacccaccttggcctcccaaagcgctgggattacaggcgtgagccagtgcgcccgaccaagaactgatgattccatagtatttatttatttatttattttcattttctttttttttgagacagagtcacactctgtcacccaggctggagtacagtggcacgatcttggctcaccacatcctctgcctcccgggttcaagcaattctcctgcctcagcctcccaagtagctgggattacaggcatctaccaccatgcctggctaatttttctatttttagtagagacggggtttcacaatgttggccaggctggtctctcgtacttctgacctcaagtgatcctcctgcctcagcctcccaaagtgctgggattacaggcaggagccaccacacccagccattatttatttattttgagatttatgtggtctctctttactaagtagttttagggtgccaatagagcttcccacaaaatacaatgaattaatttttttttttacaatagtagattttaaaaccttagaaaggatgctcaggaccaggcgcggtggctcatgcctgtaatccaagcactttgggagaacagggcgggcagatcacctgaggtcaggagttcgagaccagccttgaccaatatggtgaaatcctgtctctactaaaaatacaaaagttagctgggcatggtggctcatgcctctaatcccagctacttgggaggctgagacaggagaattgcttgaacctgagagaaggaggttgcagtgagccgagattccaccattgtactccagcctgggcaacaagagcgaaaatccatctcaaaaaaaaaaaaaaaagaaatgatgctcagaatttgtttttcagcacagccctatatcttacagaattttctatagttataaaaagagccactcattaacaaagtaatagtagattttaacttgatttggttgtacttggttttatagctgtggaagaagtatgttaccaagtagaagagttctgctctgaaagggaaacataaatctggagttgatgggtagaagagaattgtttggagaacgagccactgggtttctcctccttctgttctccccaacctccctaagtgtgaagggatcagttgatcaaatgcagagaatgcccccagcccctcttggtgtgcttcatttcctggtgtaagttgcactgtactctgtggaatttggagggtaccagttgactctggctgagaaaggatgatgatccctaaccttcagagatgtcttggctacccagtctggtgttgccactctaagtcattgtttctgaattacactatgaagagccttgggtgtttttagagcccttgtaggggtgaatgttgtggtattgagtggggatagggagaaagtgtcccctggaaccagaaccgctctaagagccacttttctgcagaagctaactagagacagagccaggacttttcttcccctcatggtggcagaatacacagttgaaagttttctcccatgttcagtgatgtggtctttcagaattccacttctctcagatggtgggaagcccacttgtacattctcttttctctacctcagtcgggaggagagcagatcccttgttaagagtcatgtgttggcttttcaggtaaataagaatgacatccgcaagaaggtgaggcgcctaatgggaaagtcgcacattgggcttgtgtacagccagcaaatcaatgaggtgcttgatcagctggcgaacctggtaagcacgtctggccaccccttaggcttccccatgggtcatttcttggtttgtgtcacttgcagtccagttcaccccgtttttgaaaatggagcagttgtctttgactgtaaatgaggcattagtccctgtgttctgtgatgggattctctgtataaaaccatcgtagtgcatcagttttgatgtgtggtctgtgaactgctgagggttcagaaggtgaaaacgatttcaaatgattctaaaatgttatttgctgttttcacggggttacatttgcactgatggtaccaacgcagtgatgggtaaaactgctggcactgtaacccaagtgaagacaatggccccaaactatgccagcagccattgcattccttgccttcatatactctcagtttttcgtttttgttttgtttgtttgttttttgagactgactctcactctgtcgcccaggctggagtgcagtagcgcaatcttggctcactgcaacctccacctcctgggttcaagcgattctcatgcctcagcctcccaagtagctgggattacaggcatgtgcccgcccacccagctaatttttgtatatacatatatattttttgagacagagtttcactctcttgttgcccagactggagtgcaatggcgcaattttggctcactgcaacctctgcctcccgagttcaagcagttttcctgcttcagcctcccgagtagctgaagctcctgaggttacaggcatgcaccaccacgcccagctaatttttgtattttcagtagagatgggcattccccatgttggccaggctgatcttgaactcctgacctcaagtgatctgcctgccttagctcccaaagttctgggattacgggtgtgaaccaccgcacctggcttacactcttagttttttaaaaatgccagttgtgcttgtaaatgtccttgaagaagcagtgaagactgttactcttattagattgattaattataaatgtttttaatattctttgtgacaaaatgggaagtacacataaagcatctctgttgcaaacccagtatgatggttgttttgaagaaaagcaatttgcagccttgatttgttcaccttgagttgcaagtgaacttaatcgctttgttcattgaacatcatttttactggaaaggacaattaataaaccatggttattcagagtacccaactggcagacattttccttcagttaatcaagtgagcctgttgtttcagggaaaacaactgacagtatttgttgccaatgataagattcagcttttaagtgaaaataagaattttggcagagttttgaacttgaagcttcccaatatttaaagacttttctaatgagattggtggtgatattaatgaatgtgattttttaaacattgatttaatattacaaaatatgtcaacatttggaagagctgtgtaactcagtgaaacactattttctttctttttttttttttggagacggagtctcgctctgtggcccaggctggagtgcagtggcaggatgctggctcactgctacctccgcctcctgggctcctgggttcaagcaattctcctgcctcagcctcctgagcagctgggagtacaggcgtatgctgccacacctggctagtttttttttttttttgtattttaatagagacggggtttcaccatcttgcccaggctgtggtcttgaactcctgagtttagtcaatccgcccaccttggccttccaaagttctaggattacaggcacccagccaacagtattttctaaataccaatgtatgatgttgtaaattcaagtatggataaaagatctactcaaaatgcaaggcagagatatggatcttaatttttaaataacattttttttcagtctggggaacatagaccccatttctttttgtttgtttgtttgtttttgagacggagtctcactctgtcacccgggctggagtgcagcggcgcgatctcggctcactacaacctccgcctcccaggttcaagctattctcctgcctcagcctcatgagtagctgggattacaggtgcccgccacaacgcccggctaatttttatgtttttagtagagatggggtttcaccacgctggtcaggctggtctccaactcctgaccttttgatccgcccacctcggcctcccaaagtgctgggattacaggtgtgagccaccgcgcccagccaagggagaccccatttctacaaaaaataaaaaaattagctaggcatggtggcatgcacctgtagtcccagctacttgggaggctgaggtgggaggatcacttgagctcaggaggttgaggctgccgtgagcaccactgcactccagcctgggtgacagaatgagaccctgtctcaaaaaaaaaaaaaaagtgtatggagaatagggtctcactttgttgcccaggctggtctccaactcctgcctgggctcaaacggtactcctgacttggcctcccaaagtgttgggattataggaatgagccaccatgtctggcctaaatggattttaatgtaacaatgtaaaatgttcattgatgtgctttcagattccacactgcaactaactttcaaaagctgcttttgctgggtgttgtggtttatgcctgtaattccaggtacttgggaggctgaggcaggagtgtcacttaagcccaggagttcagagctgtggtgggctatggtcatgccactgcactccagcctggatgacagagcgaaaccttgtctctaaaaaaaaagaagcttctgcttcccaagttctggtgtagtgttaaagaagaatacgtctatttatctgaaaaggctatgaaaatcctcttccattttccaaatacgtatctctgaggtcaagtttttttcatatacctcaaccaaagcaacatactgcaacagactcaatgcagaggcagataggagaatgcaactatttgattctaagccaaacattaaagagatttgcaaaaatgtgaaacagtgccttttttttgaaaatatagttattttattaaaaatgtttatattactatgtaatgggttatattaatcaattattaattgtttttataattaatcatttgagaaatttctgtttaaatttctagtatgtaaatatctataaatataactcacataaacaaaagctctttggaatcttcaataaattttaagagatatagggcctctgagaccaaaacatctgaaaccacttccctggtgaccagtggccagcagatgagactgtgctgaggaagccgatatgaatttgattgctggatggggaattcttggcccagagccctctgagagggatgtatgactgtccctaaaaaatctctctttcatcagaatggacgcgatctctctatctggtccagtggcagccggcacatgaagaagcagacatttgtggtacatgcagggacagatacaaacggagatatctttttcatggaggtaggtgctggttcatgctgggggcccaaagggctattgagagtcacagggaactcataggaccgatgccaggatatttttctcatttatctcattcatcttcatgatctatttatcattaaattatcagattggtttttttgttttttgcgtgtgtgtttttttgagatagtgtctcgctctgtcacccaggctggagtgtagtggcttgatctcggctcactgcaacctccgcctcccgggttcaagcagttctcctgccacagcctcccaagtagctgggattacaggcgccagccaccaagcccaggtgatttttctatttttaatagagatggggtttgatcatgttggccaggctggtctcaaactcctgacctcaagtaatccacccaccttggccttccaaaatgctggtattataggcatgagccaccgcacccggccaaattatcagattgttattcaaataattaaattttatatagtagatgatacccatttctttttttttttttttttgagacagagtatcgctctgtcacccaggctggagtgcagtggtgtgatcttggctcactgcagcctccacctcccaggttcaagcaattctcctgcctcagcttcctgagtagctaggattacaggcatgcgccaccatgcccggccaattttttgtattttagtagaggtggggtttcaccatgttcgttggccaggctggtcttgaactcctgacctcaagtgatccacctgcctcgacctcccaaagtgctgggattacaggtgtgagccactgcgcccggccccatttcttttatacacgtgcgcgcgcacacacacgcgcacacacatatacataaagatatctatatatagatgatatagtcacattgttcataaatcagaataacagaaaatagtacacattgggaggtcttgcactcattcttgtccccttccactgaatttcccactcccctcaccccttcatcctatagacaaccacttttattggtttcctttgtaaattccagtggattttttttttctttttctttttttttttttttttttttgagacggagtctcactctgtcgcccaggctggagtgcaatggcttgatctcagctcactgcaacctccacctcctgggttcaagcgattctcctgcctcaggctcccaagtagctgggattacaggcgcccaccaccgcacccagctaattttttgtatttttagtagggatggggtttcaccatgttggtcaggctggtctccaactcctgacctcactgatccacccgcctcggcctcccaaagtgctgagatcataggcgtgagccggtgcacccggccttccagtggacttttatgcaaacaataaaatatgaacacaaattcttattttcctcctttcttttttttctttgagacagagtgttgctcttttgctcaggctggagtgcagtggtccaaactcagctcactgcaacctctgccccttgggttcaagtgattctcctgcctcagctgcctgagtagctgggattacagtcgcccaccaccatgcccagataatttttctatttttagtagagacggggcttcaccatattggccaggctggtctcaaactcctgacctcaagtgatctgcccaccttagcctcacaaagtgctgggattataggcgtgagccaccccgcctggcctatttttctcctttctttcagaaagatagcacatcttatccattgctttatcccttgcttttttcatttaacattgtcctggtcctcttctgtatcagtaccaagaaagctttcccattggttttatggctacatgtattccactgtgtgactgtgccttaatttatttaaccagtcagtacatatggatccttgggttgcttccaaatttgctgttactgatagtcatactgtgaatgatgctgtgcctgcttcatttcatacatgtgcaagtgtgtctaagg

SEQ ID NO: 720 - DNA, 52289 bp, Human
gaaaaatattacctatattatgtctaatattggccacttgaagtatggctagcctaaattgatctatgttgtaagtataaaattcacaccagcttgtgaaaacaaattatgaaaaaaaagtctttaagatatcattaacaattttatattggctaaatgttgaaatgatcatattttggatatattggattaaataaaatacactattaaaattaatttaatgtttctctttatgtggttactagaaaatttaaaatttaaaattacacagggcgatcacattctatttctagtagaccacactgctgtaagctcaagattcaaatgtcaaactcctgtgaatattaatacgtgaatatcccacaagcacttactccatcttcccaaccctcagcccttctgtcctccttctgctcccaccaatctgtgtttcttctgtttcactcacccagctaaaggcaacacaattcactccgtgacgagccaggaaaatggaaagacacattttcctttattcctcacattgatatattcactgagcactataattacctcttaaatatgatataaatctgcaagctcttttcaataccaccacaaattccatagttcaaaatgccatcagctttcacctatattattacaccagctcccatctggtcttcctgcatcctggatcacctctttctagctgccctttcaaatttcaataagagcaagctttccaggaaacaaacctgaagtcaatccactgagtactcctctgaataccttaatattgttgacaaattcctttctgatttgaagtatcagaaaggaatatttcctccataccaaatagttttcatttcatgcatgtgccgtgattcttctccctcctttgcatctgtcattcgttatgcttagaaagctcttttcatctctttgttcttcgagacaaccactactcatacttcagagcttaatttacattttgctttccctcaaaatttttttaaaaggttccaggtctgggttatgtgctctcttatgtgctcccagagcatcctgaacttctgcaataatatgtttggctactgtattttatacagtagttttatattgtattttaactgtattttatacagtaggtgttatattgtattttatacagtagttgtttttctgtctgtttttgccccaacaagaatgtaaaatctttaagtgcctgttttcatacttatttgaccaccctatctctagaatcttgcatgatgtctagccctagtaggatcaaaaaatacttacaaagcaactgaatagctacatgaatagatggatgaataaatgcatgggtggatggatggattaatgaaatcatttatatgacttaaagtttgcagaggagtatcatatttggaaggcagtaaggaagtctgtgtagtcgatggtaaaggcaattgggaagtttgttaggcacaataggtcaaaatttgtttttgaagtcctgttacttcacgtttctttgtttcactttcttaaaacaggaaactcttttctatgatcattcttccagggcctggctcttcatctgcaacccagtaatatccctaatgtcaaaaagctactggtttaattcgtgccattttcaaagaggactactgaattctgatgtggcttcaaacatttaggttaggcatatctaatggagaacttgcagccacactgacttgtagtgaaatatctattttgagcctgcccagtgttgcttaaattgtagttttccttgccagctattcatacaagagatgtgagaagcaccataaaaggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagtccttcatttattgcagatttttctttatatcattcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaaccaaacatggaacaatgccctggagtataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactaggtgatttttggcatgtaatgcagaagttgcaagaagtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacagctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcaccagaggaccatttttggatggagccattgtctaatcatgagctgaaaggcaaatatttaaaatgcaaacatccatggttaggtaacactcttaagaccttattagctgcttaccacaactgagactgtgaagtaatggctcactttctttgaggctcagattccatatctgtggagtggaagcgagtgcttaccatacaattttcacagggctgctgaatgtgtgtatgtatgtatgtgtgtatatatattttaatgaaaattctataatttgattagtttttgtaatgtccgcatgactgagagcttgcttactttttacagcaacttgaaggtaaaaatagattttacaacatgaacaaatgtaactacatatttttatttgaattcagatgttcacaaattgttccttaaagtgaagcatgcctacaagttttaatctgtttaagacctacctcaagtaaaatgttcactgccatggcatgtgagggaaaagggaaataattcttatgcatggccttcaacggccaaatttcatgctcatcagtacatcttctcttggtgtagaactgatgatgataattatgatgatggaaaaaagtgctgttgatagcaatgcctctcttccttcactttcctctaactgaaccgtctcattcccaggcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtgagtgtggctgtttgacttaatatacttggttcttttagtcagggtcatagggatctagtattctgtcagatgaggctttgggaggttggtaagaactgcaggaaggaatccaaatgtagcaaactaagtatagaaattaaggagcaatgcatgactctccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggactgacaggaacacatcactccacactacttctaagagtaaaaattgtagaaattaccctgagcaaaggtgtaatatctcttcagagttgtccacatgtgagatgcttacagcctagtgtcagtaaaatacggggtttttttccatagcctgtaaaacatgcttcgaccatgcccttttagcatgtaatatcagcctggtaaagctcagcgtataattgaatcaagactgtttctgtgagctgtatgaaggtgtgaatctcacttacaacctctcttactgatttattttcctccaccttgtgtcctgtctccccatttgtaaaatggcagaagtgattcctgtccatgccaactttccctgctgagaacaagggagtgaagttaagtaagaagggcaagatctccagggaagagtgcaacagcaaataggggaggagacctgcgggtgctgaatggggtttcaggatcggtcctgtatttcaggtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacaggtatgaagaagcctacagacaggacaacttcaaaaaggaaagatcttcttcccctggatgttccccaggcaaagttcctataatcttggttccttaatagcttgtcttaccagcctacaggcctactttgggtttgggggctcatgaaaaatatttctgtttcagtgaaatttcgtgttgtctccatggatgaaaactttcaccccctgaatgagttggtgagttttctattatctacataaaatgattgtctgtataaacaggctgggaacctgttttttgtgctgagggaagaccagggagaggaagaatctggtatcattaacagtaacttctggcattacaacagcacaagatcctaatctaaaacatcattccaggtaaagaaagtaggtaattctttctgtcttggtgctggtactcagtcagttgtcacacaattaaatttacttttcggatggttcttaattaggacaattagaaagatacattcaatagcagacacagaaaaatcctcaaagaacctaagctcaaaaaacattttaaagatttagattttttctatacacatctaccaaaatcttcactataaaggaaagtcagggtaattaatttgttcctcaagactaactcttggtatctgtgataagaaacagttctttctattgtaatgcagacatcaacccaaagtcttcatttttctctcccaaattaacttcttcacattttcttatctcaaaaagaggcaactcttctcttctagctccaaagacaaaagattatggcctagttcttgtttctctttctctcatacccacatccacttcactggaaaatcatgttggcttaaaatatattcagactatttcttatcatctgaactactgctgcaagctagtcctagtcaatgtcatctctaaataagatcattacaataaccttcaaagtggtctcccagcttctactttcactcctctgtctaaaatgaggcaccacacccatcactctgtcagcctaacttggctttgtttttctatttgcacttaccaccattctatacgtattgatttttaaaaatctgcctatttctattataacataagctccattaaaacatggtttattgttcttttgtgcgtggttatattctcaatacctagaatgatacacagcgcatgagaaggtacttaataaagattagtttttaaaaatgaataaacattcatagtagcttcttatcaatgtttattcatttttaaaagtaatatttattaaactaaatttattaatgaaatatgtccattcctcctcattcttagaactacataagaattctatgacccatcttaatgattacatctgaacatatttacttatagttacataagtgtttatttctcaacctgtaaaattgcatagcaaaggattgatcttcactaggatgctataagcacttaagacatgttaatccatttttagtaaatggcactttacatgtatatttgttgctgaaggcctagtaagttcttaacattatttattaattgcttaaaatagattaatgaaaagttctataaaatttaatctggaatatttctgtatttcactatagagggaattattctatatgaaactaatttagattttttaaactttttattgtttttaatttttgtggaaacatagcaggtatatatatttatgggttacatgagatattttgatacaggcatgcagtgcacgataatgattatggatgataatcattatcattatccatatcattatccaatcatggataatgattattatcatgcattgcatgcctgtatcaataaatggagtacccatcccctcaaacatttattctttgtgttacgaacaaatccaattatacttttagttatttttaaatgtacaattaaattattttttactatactcaccctgttatgctagcaaatactagctgctttgcttataaatgagatttaagaatatttgaaaataattataaacttcttttttcttttgtctttcagattccactagtatacattcaggtaagcaacatgaaacattccatattaaaaggaaagcaatacatatagggaaaatgttcttatttcagaggtttttacaatatctcagaaacttgtcattaaaggagaagccttcaaactcccatagagctagatggctataactcatctcctctactcaccctttactactaccccatttgacctttttgtagataacttagggtttccatagatatcttttattagctccaatgctccaggtgcttttgtaagttataattaatttactcatataggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttggtatggatcatgaaaagtcatcaagcattatttttcttcatatttaaactcttaggtcctggaatttaagttcatttggagtctttccatttcccatgggtgacattgggcttggagtagaattaattacacctaagtccaatgaggacatcagtgatctgtgaataggacttcacatagcttcgttattttctgtagcaatatttaataccaacccccaaaattaaaacattcttgttttaatggagttttccataattaattaagcacacagtgatctctcatagtccctcaactgaaatcttcatttgagaggaggatagataagaatagattggagagcagagctaccttttcagagccctaaaatattattagggaactgttacagggaacctgaaaataggaattcccccaaagttgaaaaccaatcaccaaccttctttatcaccaatcaacagttcttcccaagtttgaagtacaagtaacagtgccaaagataatcaccatcttggaagaagagatgaatgtatcagtgtgtggcctgtgagttcattttttaaaaatcttttgtgggggattatttaaaagagactcaccatttgggatattttaactactctctccgggagcagtggcaacacaaaaattttaagtgctttgacagcatcctcatctgtagaatgttattctcctgttgcttttctatttttattttctttcacgttcttatcagtattattctatcatgaggtaagaaactgtttctagagaggttatgctaataggattgattctgaaagtgacaaaactgcacacacacacacacacaaaatgggaagggtggatagtgttgaagggtattggttctgccttaaccaaaaataaccaaacgtatattagggagataattaacacatggctataggggaaattcaatcatcaacagatcatttacctgaccttgcatgcttactggaaaaatcacttagattcagaatttgtagagataggcatacaactgaaatctcatctaactcactagtccacctaaggcgggtctacatacctgtctgcactgacatttttacgaagagactgaacgtgatttctcaagacagtctgttccaaccttgaaaagtcttgtttcctggatcttatgttcccatccatggtggcacacagtagcagtagcaggaagagcaggtatagtcctgtccaaagatcacacatgtaatacacctactattcagctaggcccctgctccagttctgtctcacagtgatggccaagttcctggttcctcataactggtgtgatcttgcaaatagacatacagaggacattctcaaataggaaaggagacaaatgcacttggaaacccagcaattgtctatgacatatttacgacacaatcccacttttgtaaaaaagtaaacaggcccggcgtggtggctcacgcctgtaatcccagcactttgggaggctgaggtgggcagatcacgaggtcaggagatcaagaccatcctggctaacatggtgaaaccccgtctctactaaaaaatacaaaaaattagccaggcatggtggccagcgcctgtagtcccagctacttgggaagctgaggcaggagaatggcatgaacccaggaggtggaggttgcagtgagccaagatcgcaccactgcactccagcctgggcgacagagcgagactccatctcaaaaataaaataaaataaaataaaataaaataaacaagtgaaactcgatatagagatggctgcacatggggagaggatgatggaagaagagacactatcgtactaatagtttgtattcctaggtagacttgagggcgtttgggttttttttgttctgttttgttttgtttgtttcgtcttgctggtattgtttctcttttaagaacgggtttaagttttataataagaaagacttttttaagataaaactaaaaaaaaacgaggaaaaaaaagaaatgataaaagaagaatgtaaatttcagcatgttgcaatggagatttctataagagccattagtgactcttgtcttcaatattgtgtgagcccagcagagagcagagggaagtacagacagggaatatactgtagctaaaggggagatataaatagctagaaaatggggaggttcggtgtctgctctgattcctttgggaatgttctcatgacagatacacatatgggaagcctgtccctggacatgtgactgtgagcatttgcagaaagtatagtgacgcttccgactgccacggtgaagattcacaggctttctgtgagaaattcagtggacaggtaggttgaacactattttttctagagaatagcgataaaggcattgttgaaaagcagtgagttgcagcatttttctgacgcaggaagagaacaatctagaagagaattccatgttggctattgtaatttttcaaaaaaaatcatgaacttagcacaatgggaattatttatttctcgtaattgcccattgtgagtgtttcagaacgatagacgctgagccatctaaagcctccatgggcattcacttctacaaaggaaggaaaaaaccatacacctcttaattgccttagctggccaggccatcagttctgctctctctgtgaacaagaacctatcacatggccccaccaagatgccagagagttgacaaacacagtccccatatagaaggccgcttcccagccacagctgaatattatggaggaggaaccagactttgatgaggagttctaatggtcaagagcagatgtactgtgtatttcaaaatagcaagtggacaggacttgaactatttccaacacatagaaatgatacatacttgagttggtaggcaccctaaatcccgcgatgtgatcattacacattctctgcatgtaacaaaatatctcgtgtaccccataaatatgtataaatattatgcatcctttgtacaaaaaaaattactcctcaaattttaagacatttctatcgcaatatatctagggaatttcagataccaaggaatacatctgtcaattatacatgagatattgttgtgaaatttaatatttagttgctagagaatattttattgtgtcctcgtcatagaaaatgcctacatgatgttgtccccccacaaaaatcacaccggttatctgaccactgatctatttagtataatatgcattatatttttgtattttattttctcccttcttagctaaacagccatggctgcttctatcagcaagtaaaaaccaaggtcttccagctgaagaggaaggagtatgaaatgaaacttcacactgaggcccagatccaagaagaaggaacaggtttgtgtactacatgggtataagagaaaacacaacaggcattgattttcttagccaaataatgaattgtaagttggggggaggtgatagaattttagagacatcattcttcccaaaaataacagatttttttctcttttttcagtggtggaattgactggaaggcagtccagtgaaatcacaagaaccataaccaaactctcatttgtgaaagtggactcacactttcgacagggaattcccttctttgggcaggtggagtattttccagttcactcatcaacccatgtactgttacctaattagcacaatagttatggtttgtgctaaaaccatgcctggttaatgttatcatttaatataaccaaaagtataaaatatcaccaaggcttgattagtataaccaaaggtataaaactacataaaaatagatttattcttctgtaaatttgtgtatgaaatgtatgtaattatcctaaggccttattaaaattagtagagttttccccccttcttttgaaacagcattgtacaagtcactcaatctccttctcatggtttaccaggcagtctcaggtttttatgacattttctcacaagaatctcaaaattcatgctgaccagtttcattacgatgctaacactaactttgtatggaaacaggtgggtaggtggttttaatttttattttgaagtattaaagattctacaataatgtttatttcatggatagtatatttacactatttttctataacaagtatatttctaaaacagtgaacatggggtaaaacactgctatttaaggttctcagatttttgaattatgaattttcatgttatctaccaaaaaaatcttctcttacaatttttctgttgtcagcagatgtgcaaatggatctttatgactctagaagtctgagatcacagttacatgtgcctcaatgtgtatttactgtgtatcattttcttaatgtaaatgttacaggatttcagctatgaagggtgtaaaagaggcatagactcaacaaagtggagtacattctagaaggcttggttatgtcatgacaccaaaatgtattcaacttcctaaaatgaaagtgtagctcatttgtaaatttctcagaaagatagtgtactttgtaagtacattttattgctgttaaatatcctatttgtcataagactctctagctagaagaaaatcagaattatgtgcctattcttgtctttgtacatgcagccaacatttcactggcaaacttagattttgtaaatcaattatgagtactgatgggggtcagcctattgttcttcctgctaccaactgtagcttatactgaaaaagaattgccacctttacaatctgaactggactactcaactgccaatacaatattagcagtaaattagatttggcaacttatttaatactgtgtgcctcttttcaattttatatttttcacatgggaagtgtgtcataaaatctgcctaccttccaaaaggctgaagatctaggttgagaagcagagaccatgtctaaggcaactggagaaacacacaggacaatgtattggcaattgtttacttgtgcacttatgagacttcagacactaatctataggaagttaatggtccactccaaaataggtgtttggggcacaaataaatttagttaatagattaatagattaaaatatttcattatcatattactctagtgctctgtgactctctaagagttatatataataatacacagcacttccaaaatatctagaagacatttttcaggtcactcttgttattatccctatcactctctatcccttcacactgctctgtttttcttcttaggattgattactactaaattagtgtatgttatgtatatatttatttagcatctatctctttcactagacagtaagctctgtgatggaagaaacttcgtttttttttcactgctgtgtcctcagtgcctggaaccatgttcaacatagaggaggcactaaaaaatgtgataaatgaatatgtttggtgcctattagttattaccaatataactaatccacagcttttaatcttcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtaagtttggaaagaaattaccaatgacatgaagtagccttggaaacaaggttgcaacctaagggtgagaaaatttccaaactgtgtctagttctatggagagaaaaaaactagcaattagaaaccaattgaaggttaacttttttaaagtttatgaaaagaaggcagtatattgtgattaaaagtgcgggttagactttagcagtgttgctgggaacgtaaaatggcggagccactatgaaaaacagtatagtagttcctgaaaaaattaaaaaatagaattaccaaatgatccagtaatcctacttctggacatatattcaaaagaatcgaaaacggggtctcaaagagctatttgcacacccgtgttcatagccgcactattcacaatagctgagagatcgaggctacccaaatgtccatcaagggatgaacaggtaaacaaaatgtggtatataaatacaacagaatattatgcagtctgagaagggaagaaaatcctgtcacatgctacagcatgaatgatccttgaggacgttatggtaagtgaaataagctagtcacaaaaagaccaatactatatgattcacgtacatggggtttctaaagtagtcaaagtcatagaaacagaaaacaggatggtggttgccaagggctagggaaagagagaaatggggaattcctcttattggtattcaggtttagttttacaagatgaaaagttctggagatctgttgcacaacagatatacttaatactaccaaactgtacactaaagaataatgaagatggtaattttatgttgtgtgtgtgtgtgtgtttataataacttttttgaaaagtgtgaattccagaatctgaatcagataaagtggttaaaaatactggctcaaccctattttaaggaattaactaaaacctctgtgcttcatttccttatctgtaaaatgattgcaatactaacacctgactcttggggtggttgtgaagattaagtgaaatcatacatgttgaatcacttagtaagccccctttaactgttagatacttttactataaaagccaattctaacataattagcatttagttttaaatatatatactccaaaaattattaccttactttattttgtcttgctattctaattttctccagatgacctgttcataccaatataagttattcggtatagcatgcagtcctctattcatcaagagagatgtagacatgtctatagatacatggatatacaatacatatttaatatatattacataatcatggtaatggaaaacgcctgcctctttagagttttaccttgttatagagaaataaataatacattttatttatttagctttaatagatggcataaaagcacctccctctaatttgaatgtttactcatttcaaaaagtgtcttgaatgctttccacgtgccagcactgtgctagtcttgacaatgaaattattatttctacctgttccctgtttggggtgatcatatatgtgttgtcaccaaaatatacattaagatatgaacaaaatgttttgctcaaggattcactagtgctattgggagctggggatgaaggtagaggaagcctgaaaggagctaaggaataacttctacaggaagaaaagttggaaatataacccaaatagggcctctgaggtattagaatccagattgcagggagcattaaaaatagtcagcctaggccaggcacggtagctcacgcctgtaatcccagcactttgggaggctgaggtgggtggattgcgtgaggccaggagttcgagacgagcctaggcaacgtggtgaaaccctgtctctacaaaatatacaaaaaattagctgggtggggtggcatgcacctgtagtcctagcaactcaggaggctgactgggaggatcacttgagccccagaggcagagattgcactgagccaagattgtgccactgtactccagcatgggcgccagagcaaaaccctgtctcaaaaaaataataataatagcaatcagcctaagatagcccagaagagctagacttcagctaattcatcagctcagctcttaaaccaatgctttctaccaatgtcttctcagacccctaaggttacaatattttatttattcataatacccattcaaaatccaccctaaaagaggcagctgctttctgaaagcacagttcttccatttctagagattatttactctcctcaatgaagtttcatagctccagtgtctctaattgcacaggtaaagcagtcaaagaaatttcaagcaagctaatcagagcaaaggatgcctccttttatgctcttaagaaatataaatctcaatcccaggaggctctgcagtgtaaagtcacaaagcatgcctacatttgaagcagagaaacaaaatcaggggtccttctcccacttttcattgtggaacaaaagatttctagctactagttaaggtaggacagtaaacttacgtagttttgtgagaacattaatctttatgacgtataatctaaaaataatataatttttctaattcattaggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctggtgagaagggaggttactgcgttgacttcactgtagacaaaagctctctgtggagcaagtaatcatgaagctctttagatgtcattacttcaacttcttatccatgttccttttgaaagtttgatttctcttgaggtgaattattgccagcagggactcaataaaacaagtatattgaagtgagactgaagcgtgttctctctggcacatttaatttctttttatttccttttttgcagataatggcaaagggaggcattgtccgaactgggactcatggactgcttgtgaagcaggaagacagtgagtatttccatcatctctgcattgctgccccattctgacccattcagccttacaccacggaagtatcagaatactttccctttttttccataggtttttgggggaacaggtggtgtttggtcacatgaatgaataaattctttggtagtgatttccgagattttggtgcacccatcacccgagcagtatacattgtacccaatttgcagtcttttatccctcacccccttccacccttccccctgaatccacaaagtccattgtatcattcttatgcctttgcatcctcataacttagctcccacttcctaatagcttagctgccacttcctaatagcttagctcctacttctgagtgagaagatatgatgtttggttttccattcctgagctgggaatatcaggaatactttcaagtaatgagagaccatttccatctaatattaattaaaagaaagttgagggagggaaaacaataatggtttttttctcaccctttatcaaatatgtgttgtcttttttttcagcctattttctttgcgttatttaaaatattggtgtgggccagctatgatggcttacgcctgtaatcccagtactttgggagaacgggatgggaggatctcttgaggtcaggagtttgagaccagcctggtcaacatagtgagaccccatctctataaaagtaaataaataaataaataaataaataagaacaaagggggaaaaataaaatacataaaatattgttgtgtataatctatgcttattccagatttttaaaccataaatattcttgaacctcttctcaaaatgagaattgtgttagagaatggggtggagaaaatgtacgatttcaaggtatgttgtatataccaggtcttgtgctgagtcatttatgtcatttatattattataaatatcttttttccctttcaagatagttatgatttatgaagcattaaattgggtacttctaccgactgaagcggactcttgccatgagcaaatatgtcataatataaacctttgaaggttgctcctagtctagtagactctaaaagataacttgctagaaaagtatcagtaatctactctctcattagttcttgtagcaacacagaagcaccatagcagactgaaggaaacttaatgcaacctctaaagaatctacataggcatcaaaaaataacttctgaaggagcatggtgttcctcttatggagaaagaaccaaatattggctcatagaaggttaaagagcatgtagcatgaatacaatgtgttgaactcttactcttacatctcataacttcaggttctatttccctcttctagtatgaggcctagatcaaatggtagtgaattggatgtcttcatacccttaactagcatcagaacattaggtgggtgagctgaagcttaaagctggtgaaaaatcaacagagtatatgatttatgagaggagagagggctttgatagggtttttttctaaagctagagtccttagaggtaatcatccatttgttacatctactgtttattatgtctgttacatctactaatggaaatagtcattaacctatgatggcttcctctcattctctttgtgccccagtgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtgtgtgttttagatcataaaatcttcaacatgtaaaactagaagttactattgttatcatttgttttacacatgtgaacattagggccaaaagggttaaacaaattccccagagacattcagcaaggtagtggcagagtcacactaagaagcagaatcacttgattccttatacaaaactctcaaacttctcctagcagtgcctcttaccaattacacagttcagagtatgttattcccttcttctatgatgaaacgttgggaaatatgtaagcaagtttttaagactactaaggagccaaaagaaaaatgcaagagcacctagacccatgcatgtcccaccacaattaatgagcaccttgccgtgtatcaaagataaaaatggcatttcatgactagtaatttataagaataattagaaataattctactggctcaagtgattcttgagaatgaaagagaagtgtagggaacaaaaagcttcaggattgacacaatgccaaccctccacgaagtcaagcagagtggttatacattgtacatgaggaacactctgcaaatgcgagtgaatgcatgggtaaacctggaaatttgcttttctgaccttttgttccaatttcacaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtgagttcctggcagcctcaggaatcaagaagggccgtgccaggggctcagagcaaggaaaaatgactggataagtaggataagatcaattaaaattatatttatctaggaattaattgctttgagctctcttgtgggctttcattggtaaggaattttatatatatatatatataactactcacttctgcagttaaaaaaataaacaaaatacaatatattgaatcaaataaaagaatttttaaaaggacaaaatgtgatgaaaattaacaaccaaaaaaggactcgttattcagacacgttaagcttcttgctcaagagcacatagcaatacaaattcaaatcttctgattgtgtcaggacatccgtatatgcaaggctggagagaatacagagcagattgtgaaaagtgctatatgagaagtgcagttatgcaaaataaaagaaaggattaactgagcaaccggggaagccgttcgaaaattatatatttaaaatgtaaaaagaccatacagtacccaaagtccttaaaatcccagagctccatgcaaccagtaataggagttgtcaaactagtttcaacatttcaaaaagcctaacaaaagtgatacatatacctgcactgaggctatacaggctaaatgaaatatcagatttccgtttttataagaattatggctgggcctggtggctcacgcctgtaatcccaacactgggaggccaaggcaggcagataacttgagatcaggagtttgagaccagtctggccaatataatgaaaccccgtatctactaaaaatacaaaaattagtcagacgtggtggcgggcgcctgtcatcccagctactcaggaggctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaaacttagggaaattgaactactatataattgacattgataactgaactctttgaaaatatggagctaatagaagaaataccaaaaggatatgctgaattggaacaacaaaaactagttaatagcatgtactaatagtagtttgctcacatcttcaaatttttaatatgagaccaattgtaataacctcttactgaagctttttctactaccataatttaacaaagagaaatttatatttttattttcctgaaatagaaacttataaaaaaatgtttcttacttgtttgtccttctaatgggattttaactgaaaatattagaatacttctaaaggaagcatcaagtacatttcaacagtaggatctcaagaggatatgtgggaaaataatatacatgttttatacttttataatataattttataattctcaaagaatttttcaaattataacaaccctgatgggtagataaggcagacagtcctatttattaataataaagcagaagctttcagggatttagtagtagacctgagttaaaacaccaactcttctcaagctttgattagtgtcttaccaatgaaacactttgctgctactagtgtaggtcattcattcaacacatttatttaatgcccactgtgttctaggtattatactaagtgctagtagagatcaagcagtgagctactggaaagataaaaatgtatgtctcatggaacttacattgtctgtcccatagatgagacagacaataattatgcaatatgccacaataaaagcagggagaggaaatgagaaatgttaagatactttgagaaagtgtctaatttcatcacaccactcactttgctcatctgttcttgtcaatcagttttaaactcctacgaatataatgcaatgtaactatcacaatttttatgtctgtcttacttctcaccttcaaatggacttgaaagcatcatgcctagaattttacggttaaagttgtatgtattatatgaagatctggagcattttgtttccactaataatacctaagaaaatgccatcgtgtcctgtggagagaggatattcctattcgtgtgcctgtttagaacatgcacccattaactttgctatatactgagtcagttgctcaccacaagataagcacaaaactatcatttccttctatcatctcaaagctttgtgcaatgtcacaaatacagcagacctcgatttttcaattaataaagttttatttcattccagtgttgagtctagtggtggcctctgaactgtgtaacgaagtagtacttagtacttagatgagtacttagatggagtgtttggtttttcctaaaattgttaaacatcttcaaaatgaaaacactgtgtcaagaaaatgatccataccctctataaatcatcaaagcaatgagagcgctcaaagaaagacggatgttcattattcctgttcttttctccttgaacttaaaaaatgtcacaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtccggcctgggcgacagagcgagactccgtctcaaaaaaaaaaaaaaaaaaaaaaaaaaagtcacaaataagtttgcctttttgtctttcgtatttgtacaggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggtaaactccttatgttgcagatggtctgatcttaagcttcttaaaatattacacatggaaaagagtctgtatttgaatgccttcatgtcctagttgagggtaatgggatataaagaggtaagtggcttctctactaatagcagcagatctgcgaaaagctgctgaactaagctggaactttttggagtattattcaagttttcttttttcacaggaattaattgctctgtgatgtttattaaaatcacatatacaaaataattactgttgaaagagtttaatgaaaagaataaaattacatccttaagtatataaatatcccttctacagatgtgaatgttaaaagtttaatttaagttaactggattgcttgtcaaattcaataaaaagaagtagctacctatgtatattttataatatatatttactgattagatgataattttctttgcaggacatgggcttaaaggcattcaccaactcaaagattcgtaaacccaaaatgtgtccacagcttcaacagtatgaaatgcatggacctgaaggtctacgtgtaggtttttatggtaaacaaaaaattaataaatatatattgcctaatatattcaccaaattttaaattttttaaaagatacaatgtgacaaaaattaacaaacaaaaaggacatgtgagtcatacatattaaggttattgctcaaggtcatatagtaatataaactcaaattctagtaaatggaggtacatgtgttaggctgaaaggaaagagaaagtttccaagcgtaggattagtgtaaacagaaatagaaatgttcacacaacaacactacattctccatcagtcaggtaaaaaagctgttcaacttccccaaaacatcagccaatatttatgttggaaccacacacattcatcaatgacatgagctacttctttgatgaactgaatagtaatcaagcatttatttatagtcccatattgtcaaatcatgattgaggataagttgagtacagagaaaagagggtcaaaaatcaaggaaagcatttaaggagaatcagttggctctatggaattcactatgaagcctaccgcatattttattatttataaattatattgtataatcctttatcagtaagatatatagtaaatttatgcatgtataggtatatatatatatatatatatatatatatatatatgcacaatttttttttccagagagctggttgtgaaatattgaccagcacacccttaatagaaggtgaatagagtgaaggaaactaactgtaatcttctgacacgatagagaataaaaagtctttattattattaaacttttccctcctgtaaactgtttctcaaagccactgtcataacatgtgtgtcagtttttccttgctcctgcagaggagcacaccaatggaaacttggattcctgcccctcttcacggccttgtgtcataacactctccacttagcacagcggcagcagccacataggactccacagagtccttgtgccccacagacaatccaagcctctgtctgccaaagtctctatagcctctgcttatgaccctcctcccccagctcactcctagcttattcttgtttttttttgttgtttgtttgtttgtttgtttgtttgagacgaagtctcactctgtcgctcaggtcgcccaggctggagtgcagtggcgccgtctcggcctcggcctctcaaagtgctgggattacaggcatgagccaccgcgcccggcctctcctggcttgttaagtcaaccaacatatttcctcctcaaagaagctttccttgatgacccaagcgccctctcctccttcctctctatttcatcagacgatttgttttttgttttttttttttggtggcaactattacattctctcataagctttatctgtatgtttattgtaatgtcttcttcctcactcaccatagagtcagatgtaatgggaagaggccatgcacgcctggtgcatgttgaagagcctcacacggagaccgtacgaaagtacttccctgagacatggatctgggatttggtggtggtaaagtaagtaacttcctgcatatgcaatatgcaacaatagaggtccctgactattttcaactctttgctagtttttctgtttttattgttttatatgtttatgatgtacaacatgatgttttgatatatatatatacacatacacatagtgaaatgattactacagtcaagcaaattaacacatccattagctcacattgttacctatttttgtgtgcatagcaagcacacctaaaatctatcctcttagccaagtttcagtatccaatacagtattatcaactgcagtcctcatgctgtactttagatttctaaatttattcatcctacgtaacttcaactttgtaccctttgacctgcttcttcccatccctgcaaccccaaccacctttctactctctgttcctatgtattcaacttcttttagcatccacatacaagtaagatcacgcagtacttgtcctgtgtctggcttatttcacttagcataatctcccccaggttcatccatgttgtcacaagtggcaggatcttcttccacttaaggctgaataatattccattacgcatagccacaatttatttatccattcacccagacacttaggttgtttttatatcttggcaactgtgaataatgctgtaatgaacaccaaaacacatatatctctacaaggtgcttatttcatttcctttgggagtatacccagaagagggatttctgggacatatggtagtttccattttaaaatttttgaggtatctccatactgttttccataatggctgtggcaatgtacatttgcaccaaggggagtgaacaaattccttccagagagacactggaaacagagttttatccgtgaaacaagccagtggggcaggtggagagaaagagccggaatggccatatactccctttcaggctcctggagtcttgtttacttctccctttcactcccagatgcaggctgtttagaagcccaacccttaggagacagccagaaatgggagattttgcctgttctctctgtattgagccaaggggtggtgggggcgggtagccactggcattgctcaaaggcctatttaaaaccacctctgtgttcactgtggtctagggagactcctgattgcagagctccatctactcctggagctaggtgatttaggagccagacccttaggtacgagctgtaaacattggggtgcttgatgcatagacaaattattcccaggggtatgttcagacctggttttatccgtggggcgagccaggggaaggaggcatgggaagtgcccttactgcttttcagccttcctgtaagtctgtcgtttccctgctccttctgcttcccagtgcaggctagttagaagcccaacactcagtcagcaactgataaagtgggtagacgaagcccttccagggagaaactgggagctgttagctaatttttcagtactgaagtacttctttcaaacgcattgctaatttcaggagatgtttaacataaatacatcagctaagaagtcttactaatctaattgcatcagagctaaaaaattttgtgcaaatttaattctaagatttccagaaaatgggcataaggacctaatacaaccaaggactgcacagattgcctgtaagagatccctcactggttagcaatcctgagttaaatacagattcagtcaggcccactatacacaatagtagtagaatttaaaattataaagcagccctcagtgaaatagcattttagagaagagaacttaagaacaatctcaaactgcatgttaaatttataactatattgtctgtaaaagattatgctacaattctgatatactacaattaaaaacagttggaagaaaaggacttatattcccatctcaatccttgattatactctccattattggtatttctattgagtgtttttaagtcatggcagtagaatcattcctagggattctctccctagaaaggatgtatttaactgcttactttctgttcttcacttacactcctctccagctcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtaaggatctctttcctaaattaaatacaaggtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggggtgacaaaagtcagtactctattctcatgacagattctacaaggtttcaacctctacgatctcatatatttaacttttcgtagctcattcattatattaaacctaattttaaaagtcgtttgtgagcatcttacctttgctgaaaccataactgtttataagtcttgtatcctctgccgggagatccgggggaatggtcaaagttccagaccaaagaggtagagcagcatgccatcattacctttcccttcctctggtcccatcatgtgaaagagcaggttgcttccaaaataactcagatttacctgtgtaaatctgatacattaagatccacttaaatatatttcaggtacttgatcttcatttatatcatctttaatgtgaggcaacctgaaatctaaccaattcctcaagatgctttacttcaaacccattctccctctgttctccttccctctctactccctttcttatgtgtggtttcaggtcagtgtgcagctggaagcctctcccgccttcctagctgtcccagtggagaaggaacaagcgcctcactgcatctgtgcaaacgggcggcaaactgtgtcctgggcagtaaccccaaagtcattaggtgagcaaaaaactgctagagataattgtctactcaaagattgtatatggcagtgggaaccttatattgagtgctacttccttcaggaaaagaccactagatgctgcgatttttttcctttgccttttattctaagatgcctacaaggatatcctcaacatctccaccttgaattctcagtatcattcacctctcatttgcatgtttccgttcctgcttctgtgttttaataaaacaaaagtttacagagcattgaacatttctaaatcttgagtttggaggcatggaggaaggggaagatgctattcatttctactggccttttttttcaggaaatgtgaatttcactgtgagcgcagaggcactagagtctcaagagctgtgtgggactgaggtgccttcagttcctgaacacggaaggaaagacacagtcatcaagcctctgttggttgaagtaagtaaacctaaataatatatagtccacaataatatataatatatgtgggtaatataataatatatggatattttataatattattctcatgtatctctctgtcctatctctctcttgatttactttctgttttgttgggggtttttgtttttgtttttgaggcagagtcttgctctgtcatccaggctggagtgcagtggcaggatctctgctcactgcaacctccgcctcctgggttcaagcaattctcgtgcctcagcctcctgagtagctgggattacaggtgtgcaccaccacgcccagctagtttttgtatttttagtagagacaggatttcaccacgttggccaggctggtctcgaactcctggcctcaagtgatctgcccacctcagcttcccaaagtgctgggattataggtgtgagccaccatgcacagcctccctttgatttactttcttaatttttccttcatttgttcatgcatcgaactacctcctacgtatattgcttatatgtacagaattttcttagataatacagttcaaatccttctcttcactatccaaatatctgtggtccctccattaaaacacatgttctgaaggtcagtccattctcactagcttttctttcttttacctaaagcctgaaggactagagaaggaaacaacattcaactccctactttgtccatcaggtaagagtcaaccatcataatttaaaaaacattaaagtctaacatttaaagttcaaagaacatttatatattattcctacactttctctgtgatctaagacctgaagcaccatcaatgcatttgacaaatgtggaaaatagttcttaggaaggccaagtaatttgatcagaatatccctaggcctgcattctgagtcttgatcttttgcagcacctgtgcaaacaccaaatgactttctgaccagtgtatggtatgggcataggtagaaagtgggtagaatcaaaattaatattaccaaaagggatgtttccttaaataattaataatgcaaactatggacggctgaatttagggcattctaacactgagttttacatagccaacagtatttgataacgggattgctatttcccaaaggaaaagttgtcatggcctttaccattattgtcatattaatatctgtttgatgcctatcccgtacctaatgccctatcaaacatttgagaaggaactgaagaaacttacaggaaaaatttaatacactaagaaatttatcagcacaatgcattctcaccccaaaccaacattgaatcaacatcatacataggttcattgcctttctctgactacctacaaatttagtatgtttttcgtactaaatactttatctattcatctgttgccaagatgtaacacataaaatgtaccctaaaaacataacttccttgtcatttagccttatttctacatttaagtgaactgattacctatcattcaatccttttatcatgacttctccgtttctgagttactcattttgatgtatctcttaagtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagatgtatatgtttgtggatgtgtgatttacatataataaactgtataagtttcattctataaatcactgtttgtttttcactcagcatcctgtcttggagatttacctatgttaaattgtagatctaggtctttccttggaattgcttttaagcctataatataaatacatcacaattctgcttagtgttttagtcttcctatattggttttttcaactattcactagctttaaaaaattagttagttaattataataagagcctcttaatgaacatatgcaagtacagctagggtagatccaaaatgttaaattcctgagtcagagagcatatgcatagatatgcatagttttgtttggttggttgttgttgttgttctttaattacattgtaaactgaccatttataattgtatatatatacagcatacaaagtgatgttatgatttatgaataaaatgtgaaataattaaatcaagctaacctgaaatacttatgttttgtggtgggaacatttgaaattctctaaccaagtttgaaacataaaatacactattattaactatattcaccatgctgtgcaatagatcccaaaaagaaaaaaatgtattccttctgtctgagactttgtgtcccttgaacaccaccttccttttactccagcttcatcctccataaccaccattctactctctgctcctgtgaatttgaatgttttagcttccacatacaaatgagaacatgcaatatttgttttcctatacctggcttatttcacataacataatctcctccagatttaatcatgctgccataaatagcagaatgttcttgttttttaaaatggaatggaattctatgtgtatataccaaattttctttatctgttcatctgttgatgacacttatgattccataactagacagacatcagtaatttgttagggattacattcaatatgtagattgctttgggtagtgtggacattttaacagtattaattcttccaatccatgaacattgtatttttttcatttatttgtgttctctttgatttctttcatcagtgttttataattttcactgtacatttcacctccttgattagatttatttctacatattgtttatagctattgtaaatgggattgtttttatttctttctcaatcattcattgttagtgaacagaaaatactactgatttttatgtgttaattttgtatcttgcaactttattgcattcatttataagttcttgcagccctttggtgaagtcttttgagcttccaatatataagataatgtcatcaccaacagtgaaaattttacttcttccttgtcaatttggatatttttcatttctttttcatgtttgattgctcttgctgctacttccagtgctactttgaaaataaatggtggcagtgggtatccttgtcttgttccagatcttaaaggaaagtctttcaattttccactgttaaatatgtaagctataggtttatcatacatgccctttattgtgttgaggaacattgcttgtatatctaatttggtgagagttttatcataaaagagcattgaattctgtcaaatactttttctccatctaacaagatgatggtatggtttttacccttcattctgtaaatgtaatgtatcacatttattgatatgcatatgttgaacaatttttgcatctcagggataaatcccacttgactaggtagatgatccttttactgtattgttggatttagtctgctagtttatttcgtgtggttggttggttggtttagttttttaagtgatgagcttttgctgtgttccccaggctggacttgaactcctgagttcaagcaatcctaccacctcagccacccacaggtgtatgccaccatgcttagctgctatgctagtattttattgaggatttttgcatctatattcatcaagaatattggtctgtaattcttttttgtaatgtctttttatgacattggtatcagggtaatgcttgcctcataaaatgagcttgaaagtattccttcctcttccagcttttggcagagtttgagaaggattggtattcattctttttaaatgataagtagaacctagcagtgaagccaacagttattaggcttttctttaatggaaaactttttattactgattcaatctctttactcattatttgtcagttcagattttctatttcttcatgattcagtcttggtagtatgtatatgtctaggaatgcattcatttcttctagatcatccaatttattggtgtatacttatgcataatagtctcttatgatcctttgtatttctgtggtatcagccataatttctctttcatttctgattttatatatttaaggcctccctcttttttcttagctaacctagctaaaagtttttgtctgtctttttaaaaaaacaattcagtttcattgatcttttgtattctttttctagtctctatttgatttatttctgctctaatctttattattttcctttcttctgccaattttgagcttactttgttcttcttttcctacttctctgaggaatatcattagtatctttattggaaatttttcttcttttttggtgtttattgttataagctttcctcttagaattgcttttactttatgctatgttttgttatgctccatttccatgttcatttgtcttaagatatttttgaatttccttttaaatttctttattgacccattggctgttcaggagcatgtcatttaattttcatatatttgtgaattttttctaattcctcctgttactcatttctagttttcatagtattgtggtcagaaaagatacttgatacgatgaaacgatttcagtcttcttaaatttgctaagacttgttttgtgggctaaaatatgatctatcttggagaatgtttcttgtgtgcttgagatgaaatgttctgtatgtatccattaggtctatttgatctaaagtgttggtcaagttcaacgttttcttattaattttctttctggataatctatccatttttaaaagtgagatgttgaaattccctgatattactgcattgcaacatatctctcccttcaacctttaatatttgttttatatatttaggtgctccaatgttggatatgtatagatttacaattgttatatccttttgatgaattgacccttttatcattatataatgttctcctttgtctctttgtacagtttttgactttaagtctgttttgttgaatataagtatagctacccctgctctcttttagtccccatttacctagaacatctttttccttctcttcactttcagtctatgtgtgtccttaaaaattaggtgagtctcttgtaattagcatatgtttcggtcctgtttttttaaatccattcagtcactttatgtcttttaaatggggaatttagtccatttgcattcaaggtaattattaatttaaaaatgacttggtactaccattttgttgttttctggttgttttgcttctttgttcctcttttgctgtcttcctttgtggtctgatgttctgtagtggtatgatttgaatcttttaaaatttttgttctgtgcttctattaaagatttttgccttgctgttactatggggtttacagtcaatttcaagctgataacaacttaactttgcattctttcactcccccacacacattttatgtcgttgatgtcagaatttacatattttgtaatgtgtatttattgacaatttatttttagctatgcttgttattaatattttgtcttttaacccttgtactagagataaaattgctttaaataccatcattacagtcatagagtattttgaatatggctctatattacttataccattaaattttgtgcttttgtgtttttgtattattaattaggggccttttgtttcagcttaaagaactcccttcagtaattcctgaaggcaggcctaatgttgacgactcccttagcttttagtttgtctgggaatgttttatttctccctcatttctgaaagacagctttgctggatgaagaattcttgattccatgttgtttttatttttgttttccttcagtactttgaatatattattccactctccctcagcctgccgggttactgctaaaaatccatggatagttgtattggaattcctttgtatgtgatatgtttctttatcaccttctgcttttcagaatttttttttgtctttgatttttgatagtttaattattgtgtcttagtgagcagttctttcatttgaatttcactggagacctctgtgcctcctgtacttggatgctagcatctatcccctaattagggaagttttcagcccttactgcttttttttttttctgattctatactcttttttttcattattgctttaaatgtgctttatagtctctttcttcttcttctggactttctttaatgcaaaggtttgatttcatgatgatgtcccataatttccataggctttcttcattcttttgtctttctgctcttctgcctggataattccaaatactctatctttgagctcactgattcttctgcttgatcaagtctgctgttgagcttactttgaatttttaattttagtcattgtattctttatttccaggatttctatttggtttctttttgattgtttctatttattttttattttacaatattagctaagttgcagataattgtttctatttcttttttttttatactttaagttctagggtacatgtgcacaatgtgcaggtttattacatatgtatacatgtgccatgttggtgtgctgcacccattaactcgtcatttacattagctatatctcctaatgctatccctcccccatcccctcaccccacaacaggccccggtgtgtgatgttccccttcctgtgtccaagtgttctcattgttcaattcccacctatgagtgagaacatgcggtgtttgtttttctgtccttgcaatagtttgctgagaatgatggtttccagcttcatccatgtcccaggaaacaacaggtgctggagaggatgtggagaaataggaacacttttacactgttggtgggactataaactagttcaaccactgtggaagtcaatgtggcgattcctcagggatctagaactagaaatacatttgacccagccatcccattactgggtatatacccaaaggattataaatcatgctgctataaagacacatgcacacatatgtttattgtggcactattcacaatcgtttctatgtcaaacttctcagtttgttggtgtattgttttgcaaatttcatttaattttgtatttatatattcttgtagtccactgaatttcttcaagaggattattctgaattctttgtcagtgatttcatagatctttatttctatgaggtcaattttttgagcttggccagtttcttttggaggtgtcatcattccttgattcttcataatcctgtgtccttgcattgtttgtgcatttgaggagaaagccacttcttctggtttttataggtattctttggcagggataaaggtttgctatttagtctagcctataattctggaaagatcagttggtgacaaccttgagcaggcagagttttcatgggttccctagttggctgggccactgcctttgctcttatgtttggtagggccactggttgggccttgctctctggcaagatcactgttttgtctctgctatctggtggagctgctggctgggtactacaatggcctctggtcaggccagtcacaagatgtgttgcctggctggatgattctgctatttgggacctgaagttaggcagggtcacaatccgggctgtgaggttaggtagagttgttgcttgggatgggcagaaataaatactatacttcttagatgtgcataatagaggattgctaccccacccttgtgaatggagccatggagtgaggttttggctgagttgagctaccctttagactcccaggtcaagcatatttaacccctacacttctatgaaatacacagaggtggtgtctgctacctgggtggggtcactggcataacctctgaagctgggcttacagactggccatctggaaactcaagctaggttgaacttcccaacatgcttctgaaagtgaccagctcagttttgcagatgggctatgcagttggctggtatctctgaatgggtgccatagctggcagaaacacagaagcactaccaaaatccacatgctggtcactgtgagctctgtccttctttgtttctacctgacctcattacttcctgtgttcccggtgaaatgagaccagagtgggcttcctgagaagtgtctttgaatacttgagaatcttgatgtctacccctggttctcttccccgctgtagaaactgtgaccccagggaactcctctctatctggcattgtgctaacctaaaggagtgggaacaatgacatggtcaaagtgagaccattcttcctactcttctaatttgtcttcactcagttctatgaacaatgtaggtgtcctagacttgtttccaagtattggggttttcaaaatagattttctgatctgtggatagcagctagttggactttctgtggagggaggaagatcctgagactttctagtccatcatcttgctttattctgaattttaattgaactacaaaacgaaaatcctcctctttattacctaaatgcatttatacttccaccaggatacatttccatagtgttatatttgccatcatctgttaccatcaaagtttttaattttaatttttgccaaaaatttagaaaaaaaaattttgctgttgttttaatttatattttcttaattacaaggatgaccttatttttgcatgtttattaattgcctttataatctttggctatttgtcttttgagtagtttttttctgactcagttgtatgacactaattctttatctgttgaatatgttgcagatattttctttcacttggtcatttttttaactttgtttatggcatctgtttttttacaaaagttttaacattaattttatgagaaagggaagataactgctacatttttcatttgtatataattcaccaatactaaaattgtagtaaatgtatgttcatcagtagcagttattttattttcagtgagtcaagcattttattttgcttagccatttgtcctttaactatgcttatggcttttttttaagaaacattttaatatgaattttatgaggaagggattcagtatgaaaataaatactatacttctctcattttcatttcatataatttaccaagattaaaatggaagtaaatgtatgttcatgagtagtaattattttattttcaatgcatcaaatactgttcgtcttcacttccttaccctcaattttctaggttttccataaaaatactatctttgtatatgaaatttgaagaaagaacatagcattattatagaattcaggaccttttgtgggtaattttacttatgtatacttatagggctttgttgttggtgttttctccatacaactgttgagtaaggaagttggtggtgggaactaaatagatcatcttgtgataaccgtcttgtgtcagccatcagatgacagcaactgaatcacaacatcaccaggctcttacaatttgttgtcttatttggcatgcgattctacataaattactgaaaagatcattgaagaagaaattctgaaaatcacaggaaaccagtagcccatttttaagatatttatatattactgttgtattaaaggcggacaacttttcaggaggagtttaggtataaggcatagtcctagcttctgggtcatagagctgtttagaaagatataatgcagaaataattttcatatgtctgatttgcttatttctctaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctcttcttctttgggcttgtttattgctttcaatcatacttctatccctggaagaatcatccttcctaaaaattctcaatttctaagctcaactaattatttctgcttaatgactttgatagatgataatctccaagctttatgacttcccatctctcccattctctaggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggtgagtgattacttgagtaagggaaaacttgaatgttatttcaactggatttcccagtaggtttcagttacttatgaatattatgatacattagcttagctcactatgatagctgctatgatagttaatttcaaggaaactatccactctccaacctccaataaaatatttaaggctcagaaactcctaatctatgacaacaaaatttaagaaatgtcacaagagaagccaaggtacttttagtaatttctccaccctcagcatgcacattaatccattgtgctgtttcgttaatcttcctttccaggttaccagagacagttgaactacaaacactatgatggctcctacagcacctttggggagcgatatggcaggaaccagggcaacacctggtaaggaaagaacaattttttgagcttctttttgtgtgccagctcttttacatgtattacctcaattatattcacagcaacactatcagatatgtattatcagaccgatggtttgttatactagataaatccaccaagattagcaaggtaatcagaagaaaacctgatatccaaatacatgttatgttaggcttgtttccaaaatggatcctattaataatgtaccaaggttttctttctgaaatggctattctttctaaagtagctaccataaccatgagttttaaaatgatattgccagtgaacatatataacttccagataaaccatgttaacttcagcttatattgtcacattctaagtcattcagcttgacttggaatgaattcattaataagaggaaacaattgagaaggaaacagtaatataaaacatttttttaaatccctaaagtaaagcaatattaaaatttactgcatgtaagagctgcatgtgagaagattctgtcatctgcagaaggaaatctctaaagataagagagatttaaagccttactcaagtaactaacaaaaataagtacattcaaattacttgaatgtaaatttgttcaaccattgtggaagacagtatggcgattcttcaaggatctagaaccagaaataccatttgacctagtaatcccattactgggtatatacccaaaggaatataaatcattctactataatgacacatgcacatgtatgtttatcgcggcactatttacaataacaaagtcatggaactaacccaaatgctcatcaatgacagactggataaagaaaatgtggtacatatacatcatggaatactatgcagcaataaaaagaaatgaaatcatgtcctttgcagggacatggatgaagctggaagccatcagcctcagcaaactaacacaggaacagaaaaccaaacaccacatttctcactcataagtgggagttaagcaatgagaacacacggacacagggacaggaacaacacacaccagggcctgttgggaggtgtggggtgacgggagggaactaagcggatgggtcaataggtgcaagaaaccaccatggcacacgtatacttatgtaacaaacctgcacgttctgcacatgtatctcggaactaaaataaaattaaatatactaagactccctgtggcaaagagagagttagcaaggaaatactacatctagcagattaatcaggcagactaaagattaatcaaggagataagctctctaagtacacaagaattttgttagctaactcacatcatatgaagcctgttgctgtgaagtggttataaaaccattttgacaacataaacatcatgattgcttcctccctggtcaggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaaggtgaatcattctggagctagttttgatttgtccattatgatatctgcaaggatgaggataggaagtgataatgtgaaaaattctaagggaaagcctcagaggaaaataaaacctggatggcaccaaaaaagaggggatagaacaaaagttgattgtgatactttgccctatagggatggatatgggtaaggatgaattccatgacacagcagaatagaaagaactaatcaatagcattctcagaagttgaattattcagatctctctctcgtattcacagggaggagtagaagatgaagtgaccctctccgcctatatcaccatcgcccttctggagattcctctcacagtcactgtaggtaccaccccattcctctgctgaaggagagttctggatgcaatgaaactgctgacctgctgtctgaaatactatcctattaaaagcaaagcatcagctttctttctatgcaatgccagtgcttcccagatctacagagaatttggtcagcccattaagaaaggtttaaattttcccagtaattcccctaggctatttaccaccaccactcaaaaaagaatcttaaagatgtatcttttgaatgtgagaataacagataaaaataatattatatctattgataagaatgaggaatcgttggaaaaatgcgtttgaaaaacttctgtgctgtgatccgtgtatttgcctgggaatgctaatatgcctgtttacatagcttagttcccttcttgttctgccttcacagcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaaggtgagagcacacctgagatccttctcctggcccatcctctgtatcaagaactgcatggcaaaaatccctcactcctacctcctgtgatccctgtctcctctcttcttttctatatatcatatatattttgtccatattgcatcttataaaatctaggatttcttaatcaaatcagaaatcagaagacaagaggccgtgcagatgcttctcaattacgatggggttatatcctgacaaactcattgtaaagtctaaaaaatcttaagtgggaccattgtaagtcagggaccatctctatagtatgctggtaagaagagcattctctggagactagctccaaaatgtgctacctatgtgagcttgggaaagtcattaacttccttgtgtttcagttccttcatcagtaaaatggggataataatagtatttacctcacagagctgttgtaataaatgaattggtacacgtaaaacacttagtagagtacatgtcacatagcaaatcctataaaagtactagttattacaattaacatatcagttctcaatatatgcccaacccttacctggtacattatataaccttaaacataagaaaataatcatggaagtaactccttgaatgaattctggtattttaagcccatttcataagaccaataatgttgaccaatctactcatattcacacagtacttctacatataccatggtctatatgagcggttgaagaaatagaaaataaaatgcaaatcacaagatgtccattaaaacagtctacctttttcctttgacagccattaattcttcttaaaatgtattgagaaatattttataatagatatacaaaagggcataagctataactagaaaacactgtacaactctctcatagattaagaaatagaaaattaccgacatgggaaaaataaatcccttgtgtatcactaccacctccagaggcaatcattatcctgaatttgtcgttacaattccatggatttccttatatttttgctgcatatgtatccctaactaatatttagaatcttcacatgtgtttcatcttgagagaaacaagatttttatttctctcttattcaagaaacaagagaaacatttttgaatatttcagcagcttagttttttgtttgtctgctttttattttctaagttcaacactatgttgatgaagacccctatacaagtatgtgcagagtcagctcattaattttcactgctgcataatatattacagtctataaattagtcataatttacacatcgagtttctcctcatggattttttttatgttttgctattaaaaaaaatgctgcaatgaatactcatgtgcctgttttcttgtgcatctgtgtttctccaaattatgctttgagaagcataatgactgattagtgggctaagcacatcttccccattgctgaatattgccaaagagcagttggcttcccacagcagtgtattttggttcccattgtttcacatccatgtcagcctttggtatttcaaggattactgtattttttttttcaatttaatgagtacaaactctactatttcatgtgatctgtgatcctcacaagaaactgataaagacacactttataggaaatgtaacaaactccagctatagtctaatataacatcataaataggaaatagccagactcaatgagacaactgctgtgccatttctttctcccaccaacccgactatagcaacgatttgaaaacatagataggcataggcttctgactccagcatcaatatctgccttagctgggctaaaacacaccaaattcagatttacatgaagggaaaagcatctacatacagtacaggggattataatgggcatgcaattctcatttcagcactggcttgggtactttcaccttgaattaaatataaatatgtaggcacttataaatatctttttctcatctttaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggttggtgatttgccaaaaccttttatttcaccttcaggtagcaaaagatttgaatgaaaaagaaacaaacacatccaagaagaaaaaaatacagatgacagtaacttgaaatgaggaaaagttttcagtatccaaggataatggaaataaaagcaaatcaaagtcaaagagggccaaaaggaaatgctcagaattccggcaccccatcgctgtgttattatccatctcctatttcccataacaacactgccttcctcaagcagcagtggagcaccagcagaatgaaggagatgtctcctgccattctcctgaaagctctagggtctctttcaaactgttcaaaggaactctactcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaagcgattctagtgcctcagcctcccaagtatctaggattacagtcatgtgcaatcatgcctggctaatttttgtatttttagtagagacgaggttttgccatgttgcccaggctgatctcgaagtcctgagctcaggcaatccatccgccttggcctcacaaagtgctaggattataggtgtgagccactgcgtccagccccctattcacctcttaatacacaaacatttattcatcaggagcataaagaactgtctttattcatccaacctcctaaatctagctatataaccatgtatctgaacaattcattgatatgtacacagcagaaagttttatcttcagagaattcggatgtttgcttatataccctaaaacggaaaaaatgtgacaaaatggcattccatcctatttccattgtattaatcttttatcatatgaatgaaaaaaactaagtaattttgttaaaggttatcattcatttattagaaacatattatttgaaggaggccaagcaggtttaatgttgttgaggatacataccagcagacattcactgggaacaggaaatcatccaataaaaagggaaagccaaataaaaatgtcattaaatccagaagataattataatactcatcttttatttcttttggagaaactgaagcatgactctgctcatggctgcaaagaaccttgggttctctccaggacactgacctcagcaactgagcaaagtttaatatgggagagagccagactgaactttgcttgagtggtggcagatatgagcatagttgtcaagaaagacatgttagcaaatagctgatgccaataactgattgccattcacatgttttccacattccatgtcccacatatacttacagagagaaaaggatcaattttctgataaataaaataaacatgtagggcatacagtccaaggtagatatgtgaatgttatggttcttcaactatctaaagattataatcaatcttgaaattacagctcctatatttaagtagtgagggaagtaggaaatcaaagtccctcacatgggtctttgaaaaatatctcagccctcaaagccttataatgcccaatgggttctctcactcatctgtctctaacaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccaggtgagactcttgggcaggtgaggacaggacagatgaggacagcagctgttctctctgagaagtcctaactcagaaaacaatgggacagatcagagaaagggttagggacgtggacaggaattctgggaaagggcaaaaaactgattttgtctttgatgttctatagacatccttgaaatacaatattctcccagaaaaggaagagttcccctttgctttaggagtgcagactctgcctcaaacttgtgatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaatagaaggaagtagtgactccttagttagaattcctactggcaataataaatctcaggttatatatgatataattaatttggggggaagatacacttatatgcatcaatatttaaatagctgcagatctgataaaaaactctctctccacaaacatattattacttggttggagatactattcaggaaaaaagttaggacaaaatacatgtaacaaataactggcacacatcaaaaagaatgagatcatgacctttgcaggaacatggatggagatggaggtcattatccttggcaaactagcacaggaatggaaaaccaaacactgcatgttctcatttgtaagtgggagctaaatgatgagaacatatggacacaaaaaggagaacaacagacaccagagcctacttgagggttaaggatgggaggagggagaagatcagaaaaaaacaacaattcagtgcaaaatttagtacccaagtgataaagtaatctgtacaccaaacccccatgacacgagtttacctatataacaaacctgcatgtgtacgcctgaacctaaaagttaagtatatatatatatatttttttcatttaatttggtgtatatatatgccaaaaaataaattaagcagtccaaatttcggatgcaaactctcggggacaagacgctaggtgtttctaagtgttttgttgaaagccagtgtttaagtaaacattataaattattgttgtttttgtaaataatgtagactgaaatttattattcataatatacatcattttgtcagctgaaagaaaataaaagtaaacaaataaataaaataactggcatagattagaggtcacaaacagcctgtgcatcacttgtagagctttcttaaaatgcagatcctcagccgggcgtggtggctcacgcctgtaatctcagcactttgggaggccaaggcgggcagattaccttaggtcgggagttcaagaccagcctgaccaacatggagaaaccccgtctgtactaaaaatacaaaattagtcggacgtggtggtgcatgcctgtaatcccagctactcgggaggctgaggcaggagaatcacttgaacccaggaggcggaggttgcggtgagccgaaatcatgccattgcactccagcctgggcaagaagagcgaaaaactccatcaaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatataatcacatgtgtttgtatgaatgctgaccatgtgcagagcactgcgctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaagggaacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaaatcttgacaaaatgtgtttattatgttgacaagttttttggatacccagtaatataaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagagcctctttgagtctacgcaagtattcctgcaagacagagaagtcaaactataccaaatctctggatattaaaaaatgaacacagttagtcatccaataaaaagtatatatcatttacccccatgaacagagctatgtattggcattgacagaggtatatgcgttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcttcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcccctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgtcccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcaccagaaaagactttttacattaaaatgaagtagaatgaaatacaacattgaacaggtcatattgagaggcaagataattgggacttgacctgaattgggagtgatgtgtcctatgttacaccaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttcttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggccccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagacagatgaagaggagcattactgagcaatggaacagaaggataaggaagatgaagaggaaggagacctgcagttagtagctcatttccacagtaaggatgtcctttccacagcaagtgtgtcccaacgagtgttcagcttctagcagaaaggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggctt

SEQ ID NO: 721 - DNA, 6898 bp, Human
tagtagagatggggcttcaccatgttggccaggctggtctcgaactcctgacctcagatgatctgccctccttggcctcccaaactcctgggattacagacgtgagccaccgcgcccgcccggctttcatttattaattaaaagaaattaaattaattaatctatttaggagacagtcttgctctgttgcccaggctggagtgcagtaacaatcacagctcacggcaatctcaatttcctggggtcaagtgattgtcctccctcagcctccagagtagctgggactacaggcacatgccacgaagcccagctaatttttgtatttttcgtagagacagaggtctcagtatgttgccccggctagtctcaaactcctgggctcaagcagtctgtcctcctcagcctccaaaagtggtgagattacaggcatgagtcgctgtgcctggcctccaagcactttcaaatgtatcaacttaatcctcacaaaaccctgtgaggtcggtactgttttcatacctattttatagttgaagaaacagacacagagaagcaaagtcacttgctcacagtcacgtggctaggagagcaaggatctgaagcaaggcgatctcttaattaccaagtgatgttcctggagtaaggctctgtttgtttcctttcctgtaaaatgctgcatgcaaaagtataacacagtaagtaaagaagtcagttagcctgcacatactaagacctaaccaaaggagcttattgtttttctccaacttccatgataggtaattagatagtggagacctctgctggccaatatggtagccactaaccgcagctggctcttccaattaaaattacataaagccagaaatgtaactcctctgtctcacttgttatatctccaaggctggatagccacatgtgactggtggtggctggattagctagtgcatataaaacatcactgcagaaagttcagctgagcagcactgagttagatggcctctgaagaggatgtcccacggagagaatccagaactcaggatctttttttttttttttctttgcgacagagtcttgctctgtcacccaggctggagtgcagtggcgtgatctcggctcactgcaacttctgcctcccaggttcaagcaattctcctgcctcagcctccctagtagctgggactacaggcctgtgccaacatccccagctaatttttgtgtctttttagtagagatggggtttcactatgttggccaggctggtctcgaactcctgacctcgtgatccgcccccccttggcctcccaaagtgctgggattacaggcgtgagccaccgcgcccggccagctcaggatcttttgggatggtctgttcacctcgcagaagtggctggcatgagcaataggagcccagagtggaaccagggccttctggttgtcaagtggacttgctgtgtgacctcctgtgagtctctgccctctctgagcctctcactcctcacctgagatgagggagttggctgaggtgatgccgatgcccctcacagctttgacctcctatgattcaggggcctgtgtgtcacctggtggcacacagatggcagggagggtgtgagatggccacacatgggtatgaggcagagccacagccccccccaacacgcacatgggctagtcactgggacacacacagagctcactcacggccacagagtgggcgtgggtttccctttttccttgtttctgtttctcttagcctcggcgcctccctccctccctctctctctctctctctctctctctctctctctctctggctcttttagccttggtttgttacaatctcccttttcaagccagcctctgtccctcctactcaacctgctttatctctaggccttcctccttcctcttccacagtctggcttctcacattgtcactctaggtatgcacttcccattgatttcctcttgctcagtggcctctcatcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacggtacaattagacagagggaaagggagggagcccgggggtgggggtaggggagggtggagaagcttccggactccttggggttaaaagggaaggtcccgccaggggtccctgggcagaggataccagcggcagaccacaggcagggcagaggcacgtctgggtcccctccctccttcctatcggcgactcccaggtgaagctacctgcaccccacccgggttggggtggattgcgagaggatgggtggggacccccgggccacaggcaggagccggcttagagcctcggtttctccacctgcgggacgcggaagtccccccgctgtgaggttgagaaagaggctcccactggctccgagcctcggatccccaccccgcgcgtgaaggagggggaaacctcgggcgcggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggtaaggtcgggggcagggggcggggagaggcgccggtgggaggcacgggcgggaggagaatgtgttcccgtcaccaagccccgcgcacctctcctcccccgagaccccagcacccacccagcgctccggagcacggcccgcccccaagtcagctgggcccttcttctggctcggcccctgggtgacccgccccactcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtgacgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcgtgagccaccgctcccggccacaccaccgtgttttatcctgagtcttgccttaccgctttttgccctctcccctcactttttttcttcctctttccctttctctctcttttttctttttctttctttcttttctttctttcgttcttcttttccttccttcctttccttccttcctttcgtttgtttcttctttcttgttttactttctctcttattttttcttctttctttcttgtttttttctttctctctctttttctttccttcttttttttttttttttttttttgagacagggcagtgctctgtctccgtggctggagtacagtggcccaatcagagctcactgcagcctcgacctcctgggctcaagcgatactcagcctccagagtagctggtaccacaggcatgcaccaccacatccggctttttttttttttttttttttttttgagacagggtctcactctgtcgcccagactggagtgcagtggcccaatctcggctcattgcaacctccacctcctgggctcaagcgatcctcccacctcagcctcccaggtagctgtgactacaggcgcatgcctccgcgactacttttttgttgttgttgttgttgtttgtttgtttttgtagagactgggtcttgctgtgttgcccgggctggtcttgaattcccgagctcaagcggtccaaccgcctcggcttcccaaagtgctgggattacaggcgtaaaccactgcgccccacccctctcctggttttcaatcccgttttgttattcacaccccttcctctccccgatccccgagttctatccccgcacccttacctccccgccgcgttcaatccccgcccctctatcgaccagcgacgttctagccagctctccaggcgcgctgcgttcagtccctgccctccagacccaccctattctgtctcattactccacgctaccctatcccagcttccttccactttcacgcgcttcttctcctcccattcccttcggtgcacgcgaaacccccaatatttccctaccaccctcgcgttctggctgcgtcccccgtccccgaacgcagtccagtgccacagcccagctccaaccccaaacccagaccctgccctccgtgctttgattccgtcccctttctttctccagccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccagggggcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaaaattttaaaaaaattaaaaaaaaaaaaaggctgggtgtggtggtgggtgcctgtaatcccagctactcaggaaggaggctgaggcaggagaactgcttgaacctgggaggtggaggttgcagtgagccgagattgcgccattgcattctagcctgggtgacaagagcgaaactctgtttcaacaaagaaaagaaaaagagaaaagaaaatgtggaaggcttacctaggtgtccaggcccccagccctcctcaattcctacagatcctcagagctcaaacaactgattcctcctccccatgtccactgaggtccccttctcccacaaggccctcttccctcagactcttcctatctccaggccctgcttcactgcccacctgctttcccagtccctgtgaagggtttgccttcacatgcctcttccttcccccaggccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagaggcaagagctggggctctgaggccggaacctcaggaggagggggctgagggcctgaacccctgggtctgaggaaggatgggctggggactggattcctggatctgagggaggacgggctggggtcctagatgcctgggtctgtgagtctgaggggaggaggggctgggggcctggactcctgggtctaagtggggaggggctggggccaggattcttgagtctgaaggaggaggggctggggcttaggatagaaacggtcttgtatctggactcctggctccccaaggattgggggctggacccagggattactggcatattctcccttcagtgaagtacaacaagggcctgacctgctccagcatcactatcctgagccctaaagagtgtgaggtcttctaccctggcgtggtcaccaacaacatgatatgtgctggactggaccggggccaggacccttgccaggtagggtctgaacagggagagtctctgactcctgggagggaggacagggaggttatgggaaaagagcagaccctgtgcccgatccccaactccattcccaaacccatccttgaccccaactcttacccagacctaaccccctcctcatccctatcctcaatcccatttccatcccaaccccaccccattcccatctccaagcccattttcatcccctcaccttccatgaactacaatcccaaccccagtctcactgtgccttcattctcatcccccagcccaacctcccataacctgaagtccacct

SEQ ID NO: 722 - DNA, 8050 bp, Human
tgagttcttagtggactcagctattggggctgttctcacactttttttttctttgcaagaatcagcaatgggtgcaagtggacctgtgtaggacgtccagtgaaacattgtgttggtgaatcagctagaatccatccaagaactcagccagcctggtgtggggtgagatctgatccttgaatgtccctcagtggcttttagggctggcaggttcagaagggccctctcatcacccccccagggcctcattccttgtttaacactttgctatcacagtcttgaatccttgtaattgaacaatggaccccacattttcactttgcactggtttctgattctgtaaccgatcctgtccccctctcttgtctcattcactctgggaattgtccccacattctgagacctttcagcagtgccccaacgaggttcctgcccttatctgaagctccaccctcacccccatggcggcaccgcaggcagccctgcttttgcgtcccgcgtaggcaggctgtgcaccggagtcacgaccccctgattcagcctaggcagccacagcttgactgctcccgccggacaagccctactgtgctatctgccgctcttcccttcctcttcccagggggtccgcgtcaggggaggcgcagctgtgtgcattccgggagcttcagacccccgtgtccagcagctccttcgtttcctgggtgctggggcggccttcccagcgaagagctcaactcagcgggacgtttggaggctctctgccccaaggcgctggggagtgtgcggcgggacagtcgtgcttgcctttttcactttcagagtgtccacgccccacccgtttggtcactgcaggtcagtccagtccagcccggcccaccccaccggtgcgtgtctgtcgcacgtggcagacgccatactctctgttcttgtttaaagcccaggatctactgggccctggaggcaagaggtgaacgcagcggaatccacgctgagctgcccgggaacggagcttccaaccccagaaggaggactctgtgctcctacaccttaaccctttttagcccgaaacttctccaacttccttggctttgtttagagctcgacagcgccgccccctggcgctcgttgtgaggacagtagaggagagaggcaagggtgtttttaaacagtttgcctctcaccattatgggggcgacccgagggggagacccactcttccgcattcccggtaagtgaaccaccggaagaggtcgaaagtgacggattcccatgtcctcctccagccccccccccaccctgcccatccacaggacggtggctcttcagtgccctttgccgagcaagtggcgtttctatgcacgtgggtatcaattcggactctggacgaaatggaaacctccttagccgacccgggtgggatcagctgggatcctgcgcgctcccctggggggttgccagccactctgttggggtgcaagaagcaccatccttcggaagctgggccgaaactggccaggctgactcgctcccacgcgcccgcccctacccggcgccgcagcaattcacctgccaccgcctctgagccgggtccggacttcggcgccctgacagtgtccccgcgacttccccacccgatgagatggggtctggcgttggccagtgcgtgtccagggactcgcgggtccctggccagccatggggcagagggcgctggtgttaggccagtcttccccaccctgccccgtcaccccagccacacccactgtcctgtgaggccaagcgcgctccgctggtttcctgagccaggcaccttggccgcggacaggatccagctgtctctccttgcgatcctgtcttcggggaagtccacgtcctaggcaggtcctcccaaagtgcccttggtgccgatcacccctcccagcgtcttgcaggtcctgtgcaccacctcccccactccccattcaaagccctcttctctgaagtctccggttcccagagctcttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtgatggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatcccagctgtgtgtccggtgtatggtttggcattatctcctctgcgagatatccaaattcactgtagtcatgaagggtctcagtttgtggctctcattcaaatattcatttctaaacgtctcatccagtatgaaatcattctcatctcttttggagattaacaacatcatcttttcaatgcacacgtttcttgggctcacttttctaaggtggtagggctggctgaatgcaatatgcagggctcggaaagattttttaaagaagaaattaaaagcaagtagagtccaggcaaatattcagatgctttatatgtctggataatgctgaactcatgagttttagtttgactgattattgtgaagaccgggttggagattttgacatccatcgcagaagaagtaatggctttagtgtgtgtgtgtgtgtgctggggaagctccatgcacagtgccctatggagataacaagctgagccatgctccccctaagtagcagactaagtctttgtgaaggaagagctacacaaatgggggcaggacaggtgcagataaatggggctgggagaccagaggagacagtgacaccttatagttcgccccctgttacccagccttctgtttgtcaaaagagtctgctcccagtcactgtcaaactgacttgtagggcctcattgcgttaggatttcttcttattccagaagaggggcattttcttaaggaacactggaagaccaaaacacactttcaaaacctagaggcaaaaacccttcatgcagcacttgggccccaggacattagttgtgcggggccctgagcttccctgtcctcctcacttcctgctgcctgggggatcagcagttctgtttataggtctcatctgaacttgagattctcaaaacgctaaatagccatagtgcctctcagggaaagataccaggaccacataaacaaatcagttagctttaaaaactatccctgagcatttaaaatcaggatagaccttgtgaaaccagagccatgggtcaacctgtgtgatctctgctttctgttcacatcattggacatccaggtctgagggagactcccagggaccagttgctggtgaaatttcatagcacaaaagtccggggcaagaaagccaaggtggtatttctggataagccagcattcaagtttgtttgtttgtttgtttgtttgtttttcctagcctgctgttttaaagtaaacagaatgcatttttttaagtcaaatgactttgttattttttttttccagttctcacctatttcttagattagttcagcaattatttactgagcatttactctgtgcctttcatagtgataggcacaatgacaagtccctaccatataagttagactctggcaggggagaaagatgcaaaacaactgatcacccccaaattgtacttaacttagaaacagtgataagtgcaggggaagaaaagcacagcacactctgaaaaggcgcacgaggaaggcaggatttagagtggaggactagagggagcttcctggacaagctgacacttaacaccagacctgaaggggaaggaggggtttgtcaaatgcaaactggaggggaagcagtccaggtgggaaggatcacacctgcaaaggcc

SEQ ID NO: 723 - DNA, 30649 bp, Human; identical to SEQ ID NO: 643
  misc_feature (1)...(30649): n = A,T,C or G

SEQ ID NO: 724 - DNA, 20677 bp, Human
agacacatgtaatattacttttaatattttttctcttatatacacataatttaagacacaatcttgtttccatgctgtagctgtgtttctaaaaggtggtaaaattcttatgagaatgtagaaaacttaagtcttcacattatttttctttattcccactgaagttatggctatggaaaacactgctagaaaacataatttatactttaaggttaattaaaagagatatcttgtttctttcttatgtgaagtcttatattagtaaataactgtgagattaagaacttcagactgacaaatttctacatggcaaaactcaccataatatgtatccttaaaagatacctgacaaatggaaaaaaatgtttgtaattcatagcatggccaaaaattttcccgatatataaagaatgcctacaaatcactaaaaaattctaacacctaatagaacaggcaaacatatttgaatagtttatagaaaaggaaatacaagtaaatcaagcatgtgaaaagatactttcaacctcactcaaaatgagagatataaattagaactactcagataggaacgcaaaatgatacagacactctggtaaacaatttgatagttcgttaccaagttaaaagcacaccataagacttggtatttccactccaaagagcgtactccccaaaataaaaacatatgcccacaataagacttatactcaaatgttcacagcagcttcattcataagtcccaaactggaaacaatccaaatgtccaccaactgctgaatgtataaacatacattcaaacaatggtagagacatataatagaatactactcagcaaacaaaaaaaaaagagtatgaactggtgatacatgcagtagtatgaatgaatctcaaaagcattacactgaataaacgaagccagacacaacaggttatacattgtataactctatttacaggaaattctttttttttttaagagatgggggtctcactatgttgcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtgggcagatcacttgaggtcaggagttcgagacgagcctggccaacatggtgaaaccccatctctattaaaaatacaaaaagtagcttggcgtggtggcgggtgtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctatttaaaaaaaaaaaaagactacatttgtcaaaattcactgaattctgtgtcaactgtttcaaaggcactgagattttaccttactttcaagctaacaagtcagcctaccacagtgtcatggatactggcaaaaggcatgacatttttgcgtcagaagcaaaggactgtattactcataacagtagtcagagtatcagcattttcttgcgccagctgcttgagtcccaactgtcacagggcattgtgaagtcagatgacacctgaacaggctgcttcacaggaaagaaagacagatcttaagtaaccctaaacttgaaaaatatgcaggaagcatgtctgccatttactctagagggagacattatctgtatctttgaagactgtaagtaagcctgtcctttgctccacggctctgagagtctaccttccaacattctttaaaaggtaagttggctgggcatggtggctcacgcctataatcccagcactttgggaggctgaggcgagtgaatcatgaggtcaggagttcaagaccagcctgaccaacatggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaacgcagaaatgttagactcatgggtttcctatcaagttgtaactaaaaaatggtgaattttattgtttataaattagaccttaaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcagcactttgggaggctgagggggaagaattgcttgaggccaggagttaagaggccagcctgcacaaaatagtgagaccctgactctacaaaaaaattttaaaagagaaaaaaggcaagaaagtacgctctgcatgatttattttacagaagttcaaaaagaggcaaaagtctacggtgtttggtgacagaggtcagagcagttgttttttgtgaggaagggtataaaaggggacattctgggtgctgagcatgttctgtatcttgatctggacagtgataaattcactgagctgtacacttatgagttctgttttgcagtatgtaacaaaaggtaaacaaaccaaaaattatcccaataccattcttacatattagtgttggcaaaaatataaaaacccaaaaagtatcaacagggtgttgtgagactaagcaacgaaagtatcgtcacacactacaggttatagtgtaaattggcataagcttcccaatacattgaacactttaaaaatggtcagttttgttgtttgtaaattagacctcacttaaaaacaaagaaaaaagctctacccaaacaaggcagagagccagttcggcaatatcaatcaaaattaaaacacacacatttgattctaatgattctactttattttatcctacagatatgaataaaacaacacatgtacaaagttattcactgcattgtttttaacagtaaaaggctgaaacaacctgattatgatgggacactagttaaatgatggtataccaaaaccatgtaaatgtaaatacttgtagccatttaaaaaaaatgaggaagctctatatgtacagaaacataaagttatctaaaatacattgttacattgttaaggtacagaacaacgcatttgctattatttgtgggcaaaacaatatacaagaaaacaaaacacacattcgtttttttatatatgcacagtatctctaggaggataaaagttcaaatactggctgtgacagggtatttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatactaaaaatacaaaaagtagctgggcgtggtggtgggcacctgtaatcccagctacttgggaggctgaggcaggagaatcacttgaacccgggaggcggaggttgcagtgaacggagatggcgccactgcactccaggctgggcgacagagtgaaactccgtctcaaaaaataaataaaataaataaatacttaaggttcaaactattgggtactatgctcaccaactgggtgacagttcaatcgtactccaaacctcagcatcacacaatatactcatgtaacctgtacatgaactccctgaacctaaaataaaagctaaaattattaaagacaaaatacttaatgtgtaatttttttcttctaaataaaactattaactcttcttgatgagaaatggcttcctagttctgcacttggaacacaatattgttttattaaatatacatactaacttgattttatgcactccctaatcatgtaacagcttgccagcatgcccagctaattttttaaaaatttttctgtaaagatgggggtctcactatgttgcacaggcaggtcccaaactcctggtctgaagcaatcctccttctttggccacccaaagtgctggaattacaggtgtgagccactgtgccaagccaaatgtactatattcttgcaacaaagctgctccagaacaagaggtccatgaaagaatttatgattacttcaaagcaattagatttgtttgagtagtaccatggaacacaagcaaagcgaactaggcaaaggtagattccacatttcacatttagaaagtaatctttcctaatttttaaaagattgtaatggagaggtgatgaagaaacatctattatgggacttgatttcatagtccaaatctaagagatgaagacacagtaacactatataaaatattatatgcaatacagttaacttcacttggggcttgcttaaaaattgacagaattatggccgggtgcggtggctcatgcctgtaatcccagcactttgggaagccaaggcaggcggatgacaaggtcaggagttcaagacgagcctaaccaatatgatgaagccccgtctctaataaaaatacaaaaattagccgggcatggtggcgcacacctatagtcccagctactcaggaggctgaggtaggagaatcacttgaacctgggaggcggaggttgcagcgagccaagatcgtgccattgcactccagcctgggtgacagagcgagactccatctcaaaaaaataaaaaaaaaaattgacagaattgacagtagtttgcttattttttccctcctttccttctgttgatactaatatttaatttaaaattatattaatagcactattacctcacctcttgcagagttttctatgcatatattataaccatacattgcatacactaaccttccttgaaatttgcaggtaacttgagaagcttctatgaagccaaaacctaactagtaaccataaatacaggaaagattatttctgaaaaccaaaagctgtaatcattcctcaactatggtgatataacatggtagtgtgccgaaaggagctagatgatgtataacaagtattgctacttttaatgttagagaaacaaagttcataaatgatttatttaaaatagaataaattcaagattatccctatagttgttcattctcatttactttcatttccatatgttttctcaagtgagagaaaaagcagtagagttacaatggataaatatttaatggttaggctctttataaattatttttgtcacctatggattgtgatttttttttcattttctaacttaacctaaggatgaaataaaaagcacgaatatatttagatttacattgcatgtgaaaaagaatgtcaatataaactttgttactatggtaacattactattacaattgtagaacagtatatgaactaaaattgccaaatagaaggcaaaataatgcttgttgaattaataagttgcgtggggatcaagatgaagaaaatttctatatatctttcacagtacagtgttactgtgaataaactgccagaagttggtaatacctacacaaaattaactaattattaaattagtttttaaattatccactctgttctcttccattagtatcaattatgagttcataacaattaacactaggatattattttacattacacaaaatgttgtcacataaattatttcactttagtctcctaatatcctaaagaatcaggtgagtagggcagggattatttattggaactttgtaaaataaaaaaacaaaaaattcagacaagatcaattacttacccaaatcacaaaattagtaagtgaaggagtagggatttgaagctaagtcttctacttctaaatgtcatgctttttccattgggtttcactgtaaagagaggagagtcttgttcagaaggctggctttgataattttattatatgtgtactttaaaaatccccatctgctcttaggcttttgggtttgcagaaagtatcctactttagatatgttctgagcttcagaataaaataaacccataaacacttgtataagagtattcaaatattctagtgctttttttttttttttttgagacaatgtctcactcccatcaccaggctgcagtgcagtagcacaattacagctcactgcagcttgaacttcccaggctcaggtaattctcccacctcagcctcccgagtagctgggactagagatggcaccatcatgcctagctaatttttttatttttagtacagatagtgttttgccatgttgcccaggctgagctcaaagggatctgcccacctcagactcccaaagtgttgggattacaggcatgagccaccgcgcccagccctagtgctatgatttgatatacgcttgcaaacattattggctcacccacacctaatgcaaacttccctgacgtctatgtaatgtcacagaaacatgacaggaacatttatgacagacggagttctttaacaatcacatatttcttcttctactagcactaaattaagcctgctaacaactattctatgtaaccagagataaaaatccattttaagatttgttcacttaaattctagcttaagtactagtgctcctctttgaaatacaacaagtaacttcaaacttaggcaaggagttgaatcttccattattgtttcatacacattaagcctttgatataacttaataacacataaggaattaaatttataaaaatattttttaaatgtctaatgaaaagaaactgaaaaaatgccatgtgaaagtgcactataatcccaccaagagataactaccatgaacattttggtggatattcttgcaaaattttttatacatgtattatataactttacattgtataaatatacacacttttctattttacaaagatgggatcatgtaagtgagaaatgttttataacctttttcacttaacactacatagtggacatcttcataagttaatatatagagagtaattccttgtagcctttgctcaaattcacctcctcatagagatcttccctaaccaccctgtgtttcttatacccctttactgattttttttttttctacaacacttaacaccttctaaaataggctagcaaacattttctgtaaagggccagataataaatattttagatttcgtgggctttaagttctctcttgcaattagttaactccgttattaaagtgcaaaagcagccatacacaatatgtaaataagtgggcataggtatattcccatgcaactttatttataaaaatggctgcaagctggatttggcttatgggctatagtttgccaacccctgttctaaatacaatataattaaattaattttctttttgtttgttatgggctgaactgttccccccaaaaaatatgttgaagtcttaaccccagtagcacaaaatgttactctatgggcagatttaattggatgttatagtggagtataataggcctttagtacaatatgactggtgtctttaaagagacagagccaggaagaataccatgtgaatacacaggcagagattggagttatgcagctgtaagctaaggaatctcaacgacgatggctaccaccagaagctaggagaggcaaaggaagattctatccaaagtctcaaaaggacttctagcctccaaaaccttgagagaataaatttgttgttttgagccacccaatttgtggtacaggttgaacatcccaaatctaaaaactgaaatgctctaattccaaaacgttttgagctctggcattttggatttcagattttaggatttgggatgcttaactttaagtatataatgcaaatacaacacaaactgaaaaaaaaaaatccaaaatccaatatacttctgttactaagtatttcaggtaagggatactgtaacaaagggatgctctattacagtagcccctaggaaactaacacatagtgtgtgtccccaaaatagaaggtaagtgaagagtggaatggctaggccctacggcaggtgtgtgcttggctatatcttctttgatgatgtgtctgttcaaacatattgatcaactgggtttcctgttttctcattaagttttgaaagttctaagaagatattctggcctttattagaaaatggatttacgcattattttcttgtatgcttgtcttttcattcttttaacagtatcttttgacgaataggaggtttaattttaataaagttcaattcatcaatttgtgtttttgatgtatctaagaagtctttgcttaatctaaaatcataaagggcccgacgcagtagctcacacttgtaatcccatcactttgggaggccgaagtgggtagatcacctgagttcagaagttcgagaccagcctgggtatatggtgaaaccctgtctctactaaaatattttaaaaattagccgggtgtggtggtgcacatctgtaatcccagctacacaggaagctgaggcaagagaactgcttgaacccgggaggcagaggaggctgcaagtgagcagagatagcaccactgcactccagcctgggtgacaaaatgagactccttctcaaaaaaaaaaaaatataaaaaataaaaataaagtcaaaaaggttttttcctacaagttttatagttttagggtcatttaggtctcagttatttcaagttaatatttatgtgtggtgtcaagctgaaatttgagttcattttgtatatacggataattgtttcaaaactatttgctgaaaaaattatcctttctcaagtgaattgcctttgcgtctttcttaaaaatcagttgttcacaggtgtgggtctatttggctactctcaattccagggtgggcaagcttttcatgtatgaggtaggaggtaaatattctaggtttgtgagccataaggtctctattggagctaccaatctactgttacgacacaaaagcaaccatagaaaatacataaacaaacaggggtggctgtgttctaacagtactttatgaaaacagaaggtaggatgactcctactctatttgttccactgatcaatttgcttatttatatgctaccaccacactgtcgtgatgactttagccttataaatcttgaaatcaatattctgtgtgcacttaaaaagcactgctgctgctggtagagtgttacataaatggtcattacgtgaatttggttgatagtgttcaaatcttccatatccttactgattttctgactactacttctatcattgttcaaaaagggatattgaaatccctgaatataactgtggatttacttctccttgcagtttttaccctgttgtgttttgaaactatgttatttggtagatccttttgataaattgacccttttatcattaggaaatgcccttctttaccactggtaacattctctgaaatctactttgatattactatagccaattctgtcttactttgattagtgttatcatgacatatcctctcccattcttttttgtttaatctgtatgtttcttcatatttaagtggcatctttagggggtaggcagcatgtggttgtatccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtcacctcaggcatagtatataatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagccttggaggtcgaggctgcagtgagttgtggttgcactactgcattccagcctgggtgacagagtgagactggcacatatttactcgtgtggttaccatttctagagcttttaattcctttgtatagatccgtatttccatctggtatcattttccttgggcctgaaaaactgcctttaacatttttttgtagtatggttagagaaaagtctaaatagatttgaaaacaaaaccaaagtgtgaatgctaacaagtatttagcctaaaataagcacagttcaaaatgagaaaagatactgctaattactatattaacagaccaaaggaaaatgacagggtcattccaacagatgtttgaaaagcatctgataacattcaacaactgttcatctaaaacttaaaaataacaacaaagtgtcagaaaactaagactgaaagagaccatccttaccttggtgaaggataacaaagatgatacagggactctagaaccagattgcttgtgttcaaatttcagtccctatattttaacatcttaggcaagtttttaaatagccttcacttttacttcctttatctgtaaacatggggtaccaccaccacctacccatctaggaatgttatgatgattaaataactcattatacataaagtgcttagaatcatttggctcattgtaactactcaataaaaggttaacagctgttattattagtgcagctcttgctgttgctgccacaggtactactataagaaacctacaaggccaggcatggtggcttacgcctgtaatcccagcactttgggaggccgaggcaggtggatcacaaggtcaggagtttgagaccagcctggccaatatggtgaaacgctgtctctactaaaaatatgaaaattagctggtcgtggtggtgggcacctatagtcccagctacttgggaggctgaggcagaagaattgctcgaacccgggaggcagaggttgcagtgagccgagaatgcaccactgcactccagcctgggcgacagagtgaggctctgcctccaaaaaaaaaaaaaaaaggaagaaagaaacctataataagcatctataggtttaaaggtaaaaattagaagcgttcctattaatgtcaagattcagacaagatgcttgaagtcatcagttattcaccactgctctaaagggcttaagcaaaaatataataaataagatctaaaaatggaaaataaattgtgaatgatatgatcatctatcaagaaagagtgagaatcacatgacaaactattaggactattgagaatttaacacagtagtcaaacaaaacatcatcaaaaaataataggactatttagagtttaacataacagtcaaacaaaacatcatcaaaaaatagctctccagctggcgcggtggctcacgcctataatcccagcactttgggaggccgagataggcagatcacctgaggttgggagttcgagaccagcctgaccaacatagagaaaccctgtctctaataacaatacaaaattagccgggagtggtggcgcacacctgtaatctcagctacttgggaggctgaggcaggagaatcacttgaacccagtaggcggaggttgcagtgagccgggatgtcgccactgcactccagcccaggcaacaagagcaaaactccatctccaaaaaaaaaaaaaaaagctctcctacataccagtaataactaattagaaaatgtaacagaaggctgggtgcagtggctcacggctgtaatcccagcactttgggaggccgaggtaggtagattgcttgagcccaggagttcaagaccagcctaagcaacatggcaaaaccccatctctataaaaaataaaaaaaaaataaaaaaaaaaatcagccgggcatggtggaccatgcctgtaatcccagctactcaggaagctgaggtgggacaaccacttgagcctgggcttatagaggctgcagcaagctaagaagccaagatcttgccattgtactccagcctgggtaacagtgcgaggctctgtctcaaaaaaaaaaaaagtctcgcagaaaaaaaaaaaaagggcagtctaaaggtaaagtaaacatagcactgattggcaaatgaatagacaactaaatcaatggtacaaaacaaaacacactcaagtgtatataagaatttagtatctgattttttaaaaggttgctcatttgctgggaaaataaaggactattcaataaatagtattgggacaactggctccataagcaaaaaagaaaaaaaagaaccccatttcatcagacaaaaagacacacactcatgcacgtgcacatgcatgtataagcatacactctctctccagattaaggacctaaatgcaaaagcaaaattataagcatattgaaaaacacatagaatatgcttatgaccttagggccttttaaaattagactattttagccaaatgaaaaggtttacagagcactttgatgaacatccatgttctcaccattgcttaagaaataaaagctcaagcttttattcaatttttattccgttacaaacataattgaagccatataaatagttcttgcctttaagaagtccaaagtttagagatgcagaatatgcacaaagtgccacaggagcacagaaaatacccaattcagacaggggccaggagcgcccagtcttaaaataagggtaggggttcctagatagagaaaatagcacacatatgaactctacatcatctttgactctaattgtcaagtgaagattaccaatgacaaaatcccagagcatgccagtctaaccagagctatgctatctgaaacatagctctgattaactcactttgcactagggggtggggttgggggtaatacataaaacagaacatccaaacaaaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaattttggcttggatctttcttttaattccagttacatttcatcttcttagatattctgtctctgagtcttatcaatttaagaggtctaaaaacaatacaccataggtacatgctcatgaacacatatacacataaatgcccacccactttttttgtttattatactttaagttctagggtacatgtgcacaacatgcaggttacatatgatacatgtgccatgttggtgtgctgcacccgttaactagtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggacatttgaattggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttcccacccatctcttctttttactctctaccacaaactaacctaatttggacattgatcacctcaataatttcaactgtgttcctgcttccagtctctttcctccccaccaagcattctgaacattgttggtggatcactctctctacaacacaactttaaacctgtcattcttctcctcaacagctttttaaagggtgaataataatgccaaatattctaactatttaagaacctaaaattttggctttgatgtgcctatccaatctatcttttccaatactcaagtttctctattctaaaaaaaaaaaaaaatcctttcctcagactcctccctcaagctaccttactactatacttctagagagaactgcttgcaattgcaagcaatctggcttttttactccaataatgctgaaattattcttgtagtttccaaactgcaaagcaaatacttaagctcctcattttgcttgaccacaccatgccatttataattcggtcttatctttcatcactccctactaaccatccctgtagactcagcaaaccactagacttcctctaacataccttgttctttcagtctgtgcttctacatatattattccaatgtctttcctgactctgctgtgcactacaaactgcttttgaagtatcatctcttatatggaatttccccccacttcaaacatctttgctgtcagtgtactcttacatcattccctaacaggactcagaacactgcacagtaattgtttcacatatcttgatatcctcagaatctaccatagtttgaggcacctggtggacaattaagggtgggtttttatagactttctggtatgatcttattttctatctactcgctgtcgctcaagcgtactgtatggagacgcaggatgtatcatggttaagaggtcagattctgaagccaggctgtctatgtatgacctttagatctaccacttagctgggcaaattaattaaccttcttgtgcctgggtttccctatgtgtaaaaagaggattttatcctattattattagacctacttcataatattatgaagattaaatgccttaatatgggcaaagtgctcaaaacagcaactggcacaacataagcactaaatatattgcctgttttaattaatagaccttagttactgctgatcctttccacaagctagtcctatattatgttctatattctccattctacattttgtcctccattcgctattattaatgggctgtcttcatttttccctttatccaaatcctacccaggtttcaaggccaacttctggtaaatcctttgctcattccaatccttaaatgctcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtaattgcttagtatttgctgtgtaaaataataaagcacaataggaacctcaactctgatcattctgcctttgcaatcaaagaaacggagaagctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagcgagactcctgtttccttctctataaaggggacattttaacacctacttcacatgtatttaactttcgccctaacactgaactgaagtgcaaagccttggaaacaaatttaaataaattgaaaatactgcaattcacaaataagagtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttcaaaaatacttccaaataggaattaacatgaatttaagaaattaacataatggcacacagctaaactgatgatctgagtccgtaatttcaaattaagagttgttccaacttgaagctggcagtcatacacagtttaaagggtttgtttacagcactgtcaaaagcaaataccacaatctttcagaaaattcaccctggcattctaataactagttattttaaggcagtataattgttgaaatacttcacaaactaagccaaaatgcgtttccttctgaaggcaaaaaaaaaaaaaaaaaaaaaaggtgacgtcttatttttaacctgtgattttttttttttttcagtttcggattatgaaataaaatgctgttcatccactgaagaacagacccttgcttcctgcactatcttcaaaagtttaggtcggaggaggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtccgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctcacctcaggccgcgccgcctcgaccctccgcgtctccacagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagaggtagcgcgccaccccagtcccgcggcggggcggggcgctccccaatcccgcccagctgcgcccccggccggccaacgctgcgccccgccccctaccgggacctaggcgctgattggcccctgagagaccctttgcgcccaggcattggtccagtggccgcctgtcgacgagggggcgggactccgaggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctcttggggaaagtgaagagctcggtggccgtgactccgcacgagactgcggcagattgtggcggcggcttctctccaagacttacgtaaacgagccttgccacagtacttttttaaattagtaaatgagtttgggtgcgattgatcagtgagccccagaggtggtggcccaccaagcgactagtgtttctttgcggtttgtacctccccgtttatgataaaaaataccgggtaaaaacctattcatcccgcctccgcccccccctttccctcagaaaatggacctcaaggctcatgatgtttgtttctccccaaaggaagatgagaatcttgagttaaaagataaggcatgtgcgtgcgtgcgtgtggggtgtgtgcgtgggtgtctgtaaaagtaaacacccaaaggtagaggtttttgtggaagaatgagaggatataggaaggaaataatggtttaatgaacttaaattatatccataaattaacaattataaagttcttcattatattgaggattcagatagagtaaaacatagatcgaattttaatctcttagttgttgatcagataatttataaaagggcaaagtgggcctgctaacggagtcgcaggcaaagtagatggtgctgcagctgatgtgttcagctcttgctcctccctgtcatcctatatctaacctatagattgtgaccagattctgttctagctttgccatttagaggggtgtttattttaaaacaaatttttataaaaatttgttaaattgaaaattttgtatagatccaggaaacttgatttttttgttgttgttcacagtctcactctgtcacccaggctggagtgcagtggctggatcatgctcaccgcacgttcaaattcctgggctctagcgatcctcccacctcaacctcccaagtatctcagactacaggtgcccctacaatacctggccaatttttaaaatttttggagagacaagattttggtatgctgacccggctggtcttgaactgctggcaacaaacgatcctccggccttagtggcctcccaaagtgctgagataacaggtgtgatgcaaagatgtatttaggggagatgtatagtggttaaatgtaccctctggttctagattgcctaggtttaaatgctgatgcctctatttctcatctctgtgaccttgggcaagtcttttcaaatttcttcatctgcaaaatgagaataacaataccaacctaacaggattgttgcaaggattaaatgagttaaaatacatacagtgtttggcacatagtaggtgctctgtaagtatcagctataatcattattgaatgtctactcggtcaacacttctgaaatattttagtatcacaacatatattaaaaatgatgatattttgctggacggggaagggcaggtacacagaagtggattgatatgtcacaacacaccagcctgccttggcaccattaggaaaacaaatgactgagttagtgcttttatggg

SEQ ID NO: 725 - DNA, 9732 bp, Human
cgaggagatgtccactcctggcaatggcccagtgcagggtgtcagaggataagattgaggagggtgtccatagtaggggtagcctgatgtgagaggtcagagtctgagaggtaaagaaggcatctatgtggtgggatagtcaggtgcagtgagttggagtgcaagcagggtgaggagggcatccatgtatgaggttaccttctatagggagtcagagtcgcaaatggctgagcagagtactctagggccagcctggtatgtatgtcagcatgtgggagaggtgaggagggcacccatgcctagtgttggcccagttggggttgggactcagcacttaagcaggatgaggagagagagcatccttgcagagggtagacctggtgtggtttcagagaccaagcatgataaggagggtgtccatgtggtggggtagcccagtgagggaactcagatcctaagtagggtaagatggacattattgctgggggatggaggacctgcatggagtgtcagagcccaagcaggatgaagaaagcttctatgcagagggaggacttggtgtgggtttcagaaacttagcaggataaggaggtggtccatgtggtaggatagcccggtgaggaaatcagacccctccagggtgaggagggcttccacccatagggtgaccttgtgtggagcattagaacctaagggggtctaagtggtgactaggggaccagcatcaggaatcagagtgcaagcagagtgaggagggctttcctgcagaggaatggcctagcacagggagtcagagccttggcagggtgagggggatgtttgttgggggatgttcatgggggtggggagtgggctggccctttgccggcactctcagagtgaggagggagggcatccgcgcaggggatggtggcttggactggggagtcagagcccaactaggaagagagggacatcttagcaggtgggagattgacgacatccaggagattgatcaaataaggaataagtgaaagacaatgaaagcaggtttcttagtgtcacagaaaggagttaggaatgtgggaagggagaaaactagaatgaaacttgtggtgttagattggaattagaggaattagtgtgaactcatggtgttcaatatatttagatatagaaataatatagaaatatagacgtgtgtgtttgtgtgtgtgtgcatgcatgtatgcatgtgtgttatgcaggagaaggaatcagctgggggagattaaaaggaggatcatttgcggagagttgagggcagagaatccaggtgtgagctgggagcatgtctatggagagattccacatgaaggatttaatatttggagtgttttcttctaggcctttggaaaaagtcatatttagtactttgtttaagtttatccccttctatactgtgattctatataattctcctaactgttaaaaaatagtcatatatattggaggtgatgtggcgattaaaaggttagggaagcatggaataaaggctggccttccctctcctccaacatccagtaaagggagctgctttctggagattctagcaagatgaatgcagacttttgatagagttagttaccaacaaggaaacacagagagcatggaggaacagcttcagaagacatggggtttaaactttgccatccccaccatgctacaggaaactaattcgtgaaggtggggaggctgatatgtgagttttgtgtcaatgatactcttagaatgtggtactaacaagttgcctgatcagtcaaaattgatgagatgaatgcaacataagtctatgttcaggttgtttggtcaaaagtaattacatttgtgtgtggaagcacagaaattgtattttttactggtgaaaaacgcagttctccagaaagactctaagtgcttggttcttcttttatttttcttcctctttccgcaaccctttgagttcccacttttattgcatttgcttgcatttgtttcaaggctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcaggtaaagatcattttctaggggtcagagtgaatgacgaggtgaaggatgaggagagggtttatgaataaggcataggtgttttcagttgctggttgtctgattgagtatgtctgggaaacacaagagtcccagaagattgagtggcctgcagatacgcattacggggtgtacatttgtattgtggagaagaaaagattttgtgccactctcttcagcctccactctgcttactgaaacagaggtgagagaaatccactccagttctgagctaaggcgagtgctctgatgcccctgtgttttctgaggctgagtggggctggggttaagagattgagtacagcttctgaaaccatcaatccagatgcagggggtcctgatgaatttgtgagatttgttttttgatcagttagagggaaagagtttgggtggacagtggtgagggtatatttgttggtaatggatggaaatgtaacaaaaggcctttgcaaatgaaagactagaaagtctacaaagaaagtctcttaaatctccaggaaactttttctgaaatcagagaacctattgcgtgttgcatctctgagacagactctgttacgtttgggagtagatgcaaggtgatttgggtgtcatgtgtgatatctcaagtatagagcaaaagagagaaaagaatgtatatagagtacaagaaactatgggggaaggggtcaggactatagttacgctttctaaaatacctctgtgaaggtgtggagagcacttagggaaattttttctccttaaaaactttatataatttctttattacacaagtattaatgttcattgtagaaaaaattaaccagaggtacacagatatttgaattataattactcttatcatctagagaaaatcataatttgcaatttagtgaatatccttccacatacaaatacatataatgtgcatatgtattttactaaaaatgtaatcatattatataatactgaatttttttcccccatcatttgacaaaatatcataactcgaagaaagtgattcctaaccatgagatggtaactaaaaagactgactttattctaaacatgtgatgaggaatgattataaagatttatttgctatagcattatttaaagttggaaaccattatttaaatatatgatgaaatactatgcaaccataataaggagtgttaaagaagaaaatataatggtatgaaaaatgttcatgatatagtgtaaaggaaaataataggtcagaaatcagtatttatggtatgtcaatcgtgggaaaatttgcatatgtgtatatatacattcaaaaaattgctagaaagatatataccaaaatattatggtatattataagttatatggcataacagttatcctcaattgtaggaattcgtacttttatgtattttttaaagtttctacagtgaatattattatatcctttctattcctattctcatgtgatttcaaatgtcataccgttagtaactgtgtgtcatccaagaaaagagagagaaagaggaggaggaagaagaggaagtaaagaccaaacttattactgataaaactaatttggcttcttcttcagcttccaaggagaggactgcccctcacaaaagtaataccggattccccaagctgctttgtgcctcactgttgatatttttcctgctattggcaatctcattctttattgcttttgtcagtaagtatgccaactgaaccaataagcaatatctgctgtccatgaacagagggtatcctttaaaaactgacttttgaaaatgagcttatccagaaatctgaaatgaaattttctctggggagacataattcatgggaatccactgtgaattttgctctttatttggatttagttactgtcctgtaaaaataatggaatcccttctcatttaaagaaactgaagcataaatgtgggtgtatgtatttgtgttgtagagtgaaatctatggggcatcatctctatactagacactatgtaagtgaggacaaatctatgtttccttggtagcatttattaggccagtctgatttgaatgcacagacctttatgtttttgggatgagcaggtagacaacaaggagatgggaagaaatatttcaggaaggagttctccactgggcttttactctgattattcctgccctgctcaagactgtgtgggatctaaaagtcaattttgcaaattaggtggattgctgcgtatctttggctttcagcatttgttgagttttattccccctggttctgtcacccaggctggagtgcattggtgcaatcttggctcactgcaacctccacctcccaggttcaagcgattctcccaccccagcctcccaagtagctgggattacaggtgtgcatcactatgctcagctaatttttttttttttttttttgtatttttagtagagacagggttttctcatgtttcctggccttgtcctgaactcctgggctcaagcagtctgcctacctcagcctcctaacgtgctgggattacaggcatgagtcactacgcctggctcaaaatttttaaaaggcataaaaagcagtatacatttaggtagattctttattaatttctttggtcatttcataagtattgtccatctactgtatgtcaggcactgtgccagacagagagtcaagacagagccacagcccctggtctcaagaaatttagagaatgataaaatgaaccagtggttataacattgtatggtaagtgttgtacagttaagaagtataataagtgcaagaggctgaggtaggctttccggaggaggtgacatctagagctgtgtgtaccaagaatgacctagagatatgagagagcatggaatttggggaaacgtaagtatgcatgactggaacatatggtgctaagtaaagaactaagaaatgaagttgtaggtggcagaaagaaacaggactcagatcatgaagactgctgtatatcatgataaagagtttggattttttccctcctaaaggttattttatcaattatcttttgctggttaataagccaatctaaaacttagtggattaaaacagcaactatttatttagctcataaatctgtgtcttggcaattgagactggtgtcagttgggagatttccccagtcctggctgaactcactcatgtatatgtggttgggtactggccacaggcaacttagcttctgaggaacaggatgttagatggaatggcaggagagatttggccacgtttctcttatcattcatcagggtagcctgggtttgttcacatggcaactggcaggcttttaagactgagagcggaagtaagcaaggccttttgaaatctcaccttggaactagcgcagagttgctcctgcacattctattggccaaaagaagtcttacaggcagcccagatccaggcggtggagaaatagaccacatttcttgattgaagaagctgcaaaatcacattgcaaagcagtgtagatacagggtatgttgaaagttgtggccatttttgcaatgtcacagtcatagagaaaattgaagaattttaagcagggaattgatataattggattggacttatagaaacatgatttttacagaggtgtggaaaatggataaatgaggacaaatttggagggaaagagaggttagaaggataattcattaattcaattgagaaatattgtcagactgatctatggctagtgttagcgaaaaaagagaagatgaagtaattttgaatgataaaggaggtagaggcttgatgaatattcagttctgggaaataagggacccagagaagtaaagtatggctccaatattctgactttgtaaactcagaaatcattaagtttttcaaagaggtagacaatataggatcagtagcaggtttgggttggaagatggtgatttaagttttgggcatgttgagttttatatggctgtgagaacctcaaatggatgtgtctactgggagacacatttgtctggatttagggagagaggtctgagctttggaagtccttcacatagaggtagcaggtgatgccatgggaatatatgatatcactcacggagataacttagtatgagaaagacggataaggatggaactctgggaaatgttacattttaaaaaaggtggatggaggaaacggagctcataaaagagtgtaagaagcagcagcaagaaaggtaagacaaaaacaacaaagagtagtgtcccaagagctaaggggaaaggcaactggggtcaagcctttaaggaagtcaaataggaagaggactaagtaaccctaggatattactgaggatccattttagggatggttttagtgaaatagtggaagtaaaacccagactatgatgggtcaaggagcaaatgaaaggtagggaggaaagacaaaaagttcaatttctttttttttttttttgagatggagtcttgctccgtcacccaggctggagtgcagtggcgcaatctcagctcaccgcaacctccgcctcccaggttcaagcaattctccttcctcagcttcccgagtagctgggattacaggcacctgccgctgcgcccagctgatttttgtactttgagtagagacgaggtttcaccatcttcgccaggctagtctcgaactcctgacctgcctcgacctcccaaagtgctgggattacaggcgtgagccactgtgcccggccaaaagttcagtttctagagggagaggtgggttagttttaaactgggagaaacatgagagcgttggtgtgctgaggagtaagagccagttgggatggagagagtaatggagagaagaggaagaaaataatgccctcttgatccatgtggggttctttttaaaattctccattcttcaaggtaacccagaactcctcagaattaatttgcccctctcccatctgctccaaagtcccagggtgcgcacatccttaaatacaagtgtttattgccctgcatccccccacccccaagagttagcctttgcatgcatcttatattaagtattgaaggagaatgtggagtccctttagatccattatgatggaactgttgtgtcctcttccaactactgatctttcagctattcctagagatatctatagtttcagtatgggaaatcttttccctctactccagtaatagggcatttgtaagttttatttcaataaagaatgcaagaaagtaacgataaagagcaaagtcataatgctaccaggaaaataaatggtctttattctcttttccagttttctttcaaaaatattctcagcttcttgaaaaaaagactacaaaagagctggttcatacaacattggagtgtgtgaaaaaaaatatgcccgtggaaggtaaaaattaatgtgcctagaattcagttgctgaatgtactatgtaaggatcccaaatcaatatttccagtaagattcccaggtagatcatactgaaaagttgagtctcacaataatttaagctacaaatgtacaaatatctaggacatgctgggcatggtggctcacacctgtaatcccagcactttgggaggctgaggcgtgtggatcacaaggtcaacagatcgagaccatcctagccaaaatggtgaaaccccgtctccactaaaagcacaaaaattagctaggcatggtggtacacacctgtaatcccagctactcgggaggctgaggcaggagagtcgcttgaacccgggaggcagaggttgcagtgagccgaggttgtgccactgcactccacctggcgacggagcaagattccgcctcaaaaaaacccaaaagacaaaaaaacaaatatataggacataaaattcttttgttgttgtttttttgagacagggtctcactttgttgcccaggctagagtgcagtagtgcgaacatggctcactacagcctcgacctcccgggctcaagtgatcctcccatttctgcctcctgagtagctgagactacaagcacacgccactacactcagctaatttttgtattttttgtagagatggagtttcaccatgttgcccaggctgatcttgaactcctaagcttaagtgatgtggctgtctcagcttcttgaagggctgggattataggcgtgagccacggtgcctggtcctaaaattcgtatatgtactcatatatctttaatttgtctatggaaaaaaatagaagcttaattgtgaaaaaggttacattgcttttagacttcttcgacctttgcttctttcggaactttctatacacatttgctctttttttcacatatcagttaaaaccatgtgatgaaaatgtgatgatgatttttttatggatgtgaattatttaaattatttaaattaatagattattgttattattattattatttttgagataggatctcactctgttttccaggctggaattcagtagtgtgaccacagctcacagtagccttgatctcctgggttccaagtaatcctccacctcagcctcccagtagctgggatcaaaggtgcccactaccacacttggccaattttatttttattttttgaatttttgtagagagaaggtcttgccatgttgccaggctgttcttgaattcctggcttcaagcaatcctcccacctcagcctccccgtgctgggattacaggagtgagctaccatgcccggccaataggttatttttaagaacagttttatatttacagaaaaattgagcagataatgcaaagagatctcattttacccttgctctgcacacatgctctcccctattgttaacatcttacatgaatatagtatacttcttacaactaatcaactaatattggtatattattaattaaaattcacaattttcaggtttccttagtgttcacctcattttcttttctgtaataggatccccatccagaacaccacgttacattgagttctcatgtctctttaggcacgtcttggctgtggtagtttctcagattttcctcatatttgatgaccctgacagttttgagcaatactggtcaggtatattatagaatgtccatctatcagaatttgtctgatgtttttctaataattagactgggattattggtttttgggaggaagatcacagatgtaaaatgctattttcattacatcatatcaagggcatatattatcaaaatgattcttgactattgatgttgaccttgatcacttggttaaggtagtgtttgtcaagtttctccactgtgaagttactctttccctccccacccctttccatactacactctttggaaggttcagtccacacttaaggactggggagttatgctctccattcatgagggtggattatggtatcagtc

SEQ ID NO: 726 - DNA, 23015 bp, Human
  misc_feature (1)...(23015): n = A,T,C or G
gtgatccacctgcctcagcctcccaaagtgctgggattacaggcatgagccaccgcacccatcctattcttctatctccttttcccaaatgggagacagtcctttgtgggcccttcaggccaagcctgcagttggcattgcataaaaggaggacattggttggtaggacccacaagctcttgaccaagagtgggtctcacggtcaagagtcagcactcttgactcatgaatgctgcatttcaggaccatgaacagtgtcctccttgggctctggtcactaagacgatcacagttacaactaagctacagcctgtgttatatggttggaatttggtcgatatgcacttagatctattccccactttccccctgctcccctctgtatcagggcaatggctcctgcaaattatctttctcaggttctctacacactacatttcccaggcttctttgcatctggttaggctcagccaatgggaggtctacaggcagattggagggtgccaagaaaggagaagccagagaatttccccccctccactttgagtgtctctagccatggctgctgtgcctcctctgtggtctcagtcccattaggtattccccaccatggtggggggtgggggcaggtgactggccaggtaactgcagctcctggattcaggtaactaccacctccctttgttgtttcagtccttgcaaagatgatagctagcaactagagttgattcacctgctccagtttgcgcttaaaaccaacctaatagggccaggtgcggtggctcatacctgtaatcccagcactttgggaggctgaagtgggtggatcacctgaggtcaggtgtttgagaccagcctgcccaacaaggcaaaatgctgtctctactaaaaatacaaaaaattagccaggcatggtagcaggtgtctgtaatgccagctactgaggaggctgaggcagaagaatcgcttgaacccaggaggtagagattgcagtgagctgagatcatgccattgcactccagcctgggcaacaatagtgaaactctgtctcaaaaaagaaaaaaacaaaaacaaaacctacctatcggctgagtgccatggctaacacttctaatcccaacactttgggaggctgaggcaggtggatggtttgagccaaggagttcaagaccagcctggccaacatctctgtagagatgctgcatctctaccaaaaatacaaaaatgagccaggcatggtggtgcacacctgtagtctcagctactcaggaggctgaggtgggacgatcatctgagcctgagaaggtcgagactgcagtgagctatgattactccactgcactccagcctgggcaacagagtgagaccctgtctcaaaaaaccccacaaaagcaaacaaacaaacaaacctacctacctaatacctcagtgtgtggctaattaaagtccccatattaaattctttctattgaatttgctgggatgggctgtttttctgactggaccttagtcaatgcattcgatgccgttggtcgttgactggtatggttagtggccctctgggtgtcctgatggcattgtggtttgtgtcctgttgaaccgggatctgtgctgccgtcaacatcctggttctgccagggtcagcattgtggtcagaattgtggtcactcctggtcattcttggttgtgttgtggtcagtgtggtgattagtactacagtcagtttcctggttatgctgtgctctgtcctagtgctatggtccttgtcctgagcttgctgtggataatgacctggccaagctatggtcaaaattatgattgagtcatactaaggtcaaagtcacactcagcatcctagttgcactgatatcagcttcaaggtcagcactgtggttaatgttaagaagagtgcactgtctatggtgcagtggtcagaattgtgggccatcattgaagagacatcaggatccgcttctcaaggatctattgtggcaaaatggatgaactggggactcagggtctggcactgggcacaggtcattctccatgacaggaagcagggaggcagggcgttggatcttgccatctggccattgggtttttctaattggcacttggacagccaattagacaggaacttggacagccatgggttcctgtcaccctctcacagcccacatctgtttcctcacaccctgcaccacccacttcatagagaaaatgatcatgaagtgaatgcctgccaacacatacctttgctcttgctaatccctgaatatattatttagaggtcctttggtagaatttagcagaaactcaacttgaactggattaagaaaaaaaatctattggctcatataacttaaacaaaaatgagggtagtggaattcagtcatggctggatccagggtttctgttatatcatcaggattctgtctctctccattcctcatctctcatttctcatctctcatttctcattccatgctgtcttttgggaaggattcacttttagccaagagatgacaaagatggtttccagaagcttctctcttccaagctcagcagcatcagcaaaaagagagcttgcaaaataatgtctcattatgcatcccaagttgtgtgcccatcctgaaccaattatgtattcagaggaattcattatttggcttggctaggtctggctcatagatcacccccacggagccagagagtgcagttagccttattcaacctacattggataggaagtgggaggtagagaaggatatagaatgttgaccactaaaagagagaaaggacactgtacaagcaaaaccaaaatatatggttttgggcagggggtggttcttggcatcatttcaaccccctagtatgcattccttattatagagcctgcaaagcgaaaatacttccagactcccttgcagctaaacttctgtaggccaattaggtttcatccattagaagcatgagaagtgggtggtggaagaaggtggaattaatcttcctgttatgctggtagaggcagctgctaagcacaattgggagacactggattttcctgcaggaatgttcctgtttccaattgtgagaacaacccgtttttgttgagagtccattgcagtaacaatgatgactgcctccgtatctctgaattgcaactttcctggtgttttcattgttttgttgttcctgttgctgttgttgttgttgttgtttttgagatagagtctcgctgtgtcacccaggctggagtgaagtgatgggatcttggctcactgcaacctccacctcccagactcaagcaatccttccacctcagtccatcccagtaaatgggactgcagttgcatgccaccacaccttgctaattttctgtattttctgtagagatggagtctctccatttgcctaggcttgtctcaaactcctgggctcaagggatccacccgcattggcctcccaaagtgctaggattacaggcgtgagtcaccacgcccagccatgctgttcctttttatggttcaataatattccattgtgtggatatcccatattttgttcattaattatggtgatgtagtcttaaagtcaaaaatccccactctaggggataattctccacctccctgctaataatagaggcagaagctcctgcttgggtgagttgggaggtgatggtttttgttttgtttttgtttttgttttgagatggagcctcgctctgttgcccaggctggagtgcagtggtacaatctcagctcactgcaacctccacctcctggattcaagcaattctcctgcttcagcctccagagtaactgggattacaggcacatgccatcacgcccagctagttttttgtatttttagtagagacagggtttcactatgttggccaggctggtcttgaactcctgacctcaagtgatgtgccttccttggcctcccaaagggataggattacaggggtgagccattgctcccagccgggaggtggtgttttgtagcaagtcattctatcggctttccctagatccctattctccagccttggttctgtaagcaccaagttccctggttttggttctcatttcctgcaactaaaccgtgattgatatgtgcttggaagattcattccctttatctgtctgaagagaacctcataattcacgaagccccaatactccaagctattcatgacctacctactcagtactccctcctggaccatgctggaaacatctctttaacaggaaccttcctgactcactgagctccagtgaagcacccaccactgggatacatcctctccatacattaattccttgagttcttacaacaaccctgtagggtaggcactgttatcccccatttaaaaatgcaggccaggtgcagcagctcatacctataatcccagcactttgggaggcagaggactgcagatcacttgagcccaggagtttgagaccagcctggcaacatggcaaaaccccatctctacaacaaatacaaaaagtagctaggcatggtggcttgcgcctgtagtactagctacttggaaggctgaggagggaagatcgtttgagcccaggaggtcgaggctgcagtgagctgcaattgcaccactgccctccagcctgggtgacagagcgagaccctgtctctaataaataaataaatgaaaactttgaggctcagagaggttaagtaatttgcccgaggtcacccagctataaagggcagacacaggattcagactcagttccatctgactcaaagccaacctattgaccgggtgcagtggctggcacctgtattcccagcactttaggagaccaaggtgggaggatcacttgagcccaggagttctaggctgcagtgacctgtgatggtgccactgtactccagcctgggtgacagagtaagaccttgtctcttttctttttttcaaaaaaagaaaaaaaaaaaggaagtagttggggtctcgcccaggtaattctttttttttttgggggggagatggagtcttgctcagtcgcccaggctggagtgcagtggcgcgatctcggttcactgcaagctctgcctcctgggttcacaccattctcctgcctcagcctcccgagtagctgggactaccggcacctgccaccacgcccagctaatttttttgtatttttagtagagacagggtttcaccatgttagccaggatggtctcgatctcctgacctcgtgatccacccaccttggcctcccaaagtgctgggattacaggcatgagccactatgcccaacctcacccaggtaattcttttaattaatgagagcccatctctactaaaaataaaaaattatctgagcatggtgccttgtgcctgtagtctcacctactctggaagctgaagcaggagaattgcttgagcctgagagattgaggcttcagtgagctgattgcaccactggactccagcctgggcaacagagtgagaccttgtctcaaaaaagaaagaaagaaaggggccaggcactgtggttcacaactgcaatcccagcactttgggaggccacggtgggtggattacttgaggtcagaagtttgagactagccgggccaacatgatgaaaccccgtctctactaaaaatacaaaaattagcctggcatggtggcgcatgcctgtaatcccagctactcgggaggctgaggcaggagaattgcttgaaaccgagagatggaggttgcagtaagctgagatcactgcactccagcctgggtgacagaataagacgaaagagagaaagagagagggaaagaaagaaagagagagagagagagagagaaagaaagaaagaaagaaagaaagaaagaaagaaagaaagaaagaaagaaagaagaaagcaagaaggaaggaaggaaggaaagaaagcagcagaaaaagaggaaggaagggaggaaggaaagaaggaaggaaggaagggagggagggagggaaggaaggaaggaaggaaggaaggaaagagagagagagaaagaaaatagacacacacacaactccacaaaacccacaattcagacacacagctcacacacaggtctccagcatagacatatttatacatccgtttactcaaacactcacaatacaatcacataaaacaggcagacagttcacatgccaacacactcttgcacagacacgcaaacagaagcatggaatttgtacagagcacgctcacagtgtctgatccataactcagacacggagtcacgcccacaaaggcacagtagaggcagagttcacacacaaacagacccgcggggacccacgacacagccctctgacacgaggacgccaggccagggcagcgtgggaatgaggctgcaaggagggagtgaggtggagaggatgactcaggaggcctctctgggggaggaggagggaagggggaggagggcaggcatccagcgcatgtggttcctattaggggcctgggaattgaggcatgagctggcgggacaaggagacccaggaacgcttcccagccttaccaaagcaggaaggagcagggccctgatctaaggccatgcggccggaacttggctcagaaccacagccgttctaaggcagagtggtctgccccaagccaggcccagcagggggctcatttcaacccctgcgatagtcctggagaagatttctttttattttttcttctttctttctttcttttttttttttttctgagacagagtttcgctcttgttgcccaggctgcagtgcaatggcgcgatctcagctcactggaacctccacctcccaggttcaagcgattctcctgcctcagctacccgagtagctgggattacaggctcctgccacatgcctggctaatttttgtatttttagtagagacagggtttcaccatgttggtcaggctggtcttcaactcctgacctcaggtgatacgcctgcctcggcctcccaaagtgctggaattacaggcatgagccaccaagctgggcccctttctttctttttttgagacagggcctcactctgtcacccaggctggagtgtggtagcacaatcacagctcattgtagcctcgacctccccaggctcaggtgatcctcctacctcagcctcccaggtagctggtactacaggtgcacaccgccaccatgcccagctaattcttgtattttttatagagatggggtttcaccatgttgcccaggctgttctggtcttgaactcctgggctcaagtgatcaactcgccttggtctcccaaagggttgggattacaggcatgagccacccggcctggacttttttcttttttttttttttttgagacagggtcttgctctgtcgcccaggctggagtacagtggtgcaatcatggctcactgcagcctcgacatcctggcctcaggcaatcctccttggagggtttcgtaggggaggaaagtgacattcagaaaggtgaagcaacttgcctgaggtcacacagcaaggaggtagaggagctaggattcaagcccttgtctctgtgcagcctcctctccccaccttgtagtagaggccaggacccctccatttaagctacaagcagagatcaagaactgacacctggaccaggctgcactggatttgtggctctgaaacagccagctctggccaggcgcggtggctcttgcaagtaatcccagcactttgggaggccaaggcagatggatcacttgaggccaggaatttgagaccagcctgaccaatatgatgaaaccctgtctttactaaaaataccaaaaattagtcaagcgtggtggtgtgtgcctgtagtcccagctactggggagactgaggcaggagaatcacttgaatccaggaggcggaggttggtgggccgagatcacgctactgcactccagcctggggagcagagtgaggctctgtctcaaaaaaaaaaagaaaaaaaaaagggaaagaaaaagccagccccatcctcaaataacttagagtcaagagcgtgctgtgtgcacatgtgggcaaggttctctgggcgtgtatgggaggccctgacgtagcctgggttgtttgccatgaggggcggatgctggagatgaaacctgaaggatgcagaggagctagcagggctcggtgggcagcaagaagaccctggggctgcaaggttcagagagttaggtcacctggtgagggacagtgacaggggaagcccaagattctaggtcagaggacttgggctttatcttagggttaacagggaagcctcagaagaatggtgagaggaaagggacagggtgaagtctgagtgaccagcacgaagtccacacccaggacagctgaacatgtgcctcccccataacccagaatttctattcttagcaatctatacaccctagagacacttatctatgtgcacaaaagacacacgctgtggccgggtgcagtggctcatgcctgcaatcccagcactttgggaggccaaggcgggaggatgggttgagcccaagagttccagaccagcctgggcaacagggcaagacctcctctctataaaataataataataataataataataataataataataataaaactacctggtcatggtgatttgcgccttctatttgggaggatgaggtgggagaatcacttgagcccaggagttgaaggctgcagtgagctatcattgcaccgctgcaccccagcctgggcaagagcaagaccctgtctcttaaaaaaaaaaaagacacatggctgggccgggtgcagtggcccatgcctgtaaccccagcactttgggaggccaaggtgggtggatcacaaggtcaggagtttgagaccagcctggccaacatggtgaaacccccgtctctactaaaaatacaaaaattagcagggcgtggtggtgcgcacctgtagtcctagctactcaggaggctgaggcaggagaatcgcttgaacccgcaaggcggaggttgcagtgagccgagatcaggccactgcattccagcctgggtgacagacggacaatctgtcccaaaaaaaaaaaaaaaagacacatggccaggcacagtggctcttgcctgtaatcccagcactttgggaggccaaggtgggtggatcacgaggtcaggagatcgataccatcctggctaacacggtgaaaccccatctctactaaaaatagaaaaaattagctgggcatggtggcgggcgcctgtagtcccagctactcaggaggctgaggcaagagaatggcgtgaacccgggaggcggagcttgcagtcagccgagatagcgccactgcactccagcctgggtgaaagagcgagactctgtctaaaaaaaaaaaaaaaaaaaaaaagacgcatgccagaatgtttaaacagaaacaaaatgggaaaaacctaagagttcatgcatagaatgagtaactatgcagaggtaaggtcacacgttaccactgcactttagcatgggcaagagagcaataccctgtctcagagagagagggagagagagagagagagagagagagagagagagagagatacttgtatctacaaggacaggcaaaacctccagttgagctaacaaagcaagttgcaaaagaacatgttcaaccttgaaccagttagagatcatttaaaaatctgccaaatcatgtgtgtcatccatggatacagcagtccatatgcagtacatttggaaaagcattctgggaacagccattcccacactcagaggggtgggataatggggaaagagtgtttcatggggacagtagttcagtctgggaagatgagaacattctggagatgagtggtggtgatggttgcacagtaatgcgatcgtactcaagccactggactatacacttgaaactagttacaatggaaaacgttatgttatatacatatatatatatttatttatttatttatttatttatttatttgagacgttgtctgcctttgtcaccaggctggagtgtagtggcaccatctcagctcactacaacctccgcctcccgggttcaagcaattcttctgcctcagcctcctgagtagctgggactacaggtgcacaccaccacacccacctaatttttgtttttttagtagagacggggtttcaccgtgttggccaggatggtctcaatctcttgacttcatgatctgtccacctcggcctcccaacgtgttgggcatgagccaccgcgcccagccctatgttatgcatattttacatacacatttggatacagttggtgagggaaagaaagagatgcagtcggataaatgtatacaaggggcatcaattatgtgcaaagcgttatttctcaggtgggtgtgtgagtaggtgagagttcatgataagagttctctctattattttctatttatgtattaattaattaacttttttttgagacggagtctcactctgtcacccagcgtggagtgcattggcatgatctcagctcactgcagcctccgcctcctgggttcaagcgattctcctgcctcagcctcctgagtagctgggattgcaggtgcacaccaccatgcccaactaatttttgtatttttagtagagacggggtttcaccatgttggccaagctggtctcgaactcctgacctcagatgatctggcctccttgacttcccaaagtgctgggattacaggcgtgagccaccatgcctggctggttattataaatagtgctgctatgcacatgggtgtacaaatatgtctttgagctttcgctctcaattcttttgctatatacccagaagtgggattgctctgcctggtacatttcttgttaaaattttgttttcattgaggcatatattatacacaataaaattcactaatctctatttttttttttttttttttagacagggtctcattctatcatccaggctggaacgcagtggcccagtcatggctcactgcagccttgacctcctgggctcaagtgatactgttgcctcagccgccctagaagctgggactacaggcacatgccattacacctggctaaagttttaagtttttgtagaaacagggtctcactatgttgccagggctaatcttgaactcctggcctcaagcgatcctcccaccttggcctcccaaagcgctaggattacaaacttgagccaccacccctggactcccctagcttttcttcatagcaccacttgatattatatatatacatatatatacacacatatatgtgtgtgtatatatacatatatgtgtgtgtgtgtgtgtgtatatgtgtgtgtgtgtatgtgtgtgtgtgtatatatatatgtatatatttgcttactgcctgtcaaccatcctaaagtgttaactccagcagggcaaggatctttgtttgtttcatggctgtctccccagagcctacgccattgcactctagtgcctggagcatagtaggtgctgaacaaatatttgttgaatgttatatgtgctgggatggggcctctgatatgtctacaagccagttttttggggtttttgttgtcgttgttgtcgtttttgagatggagtctcgctctgttgcccaggctggagtgtagtggtgcgacctcggctcactgcaacctccacctcccgggttcaaacgattctcctgcctcagcctcccgagtagctgggattacaggtgtgcaccaccatgcctcactaatttttgtatttttagtagagatggggtttcagcatgtccaccaggctggtcttgaactcctgacctcaggtgatctggcggcctcagcctcccaaagtgctgggattacaggcatgaaccaccatgactggcctacaagccagtttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacatgtgccagcaggtctcatgatgcagtagttttgtgtatgacaatgacagtctctctctccaggtgtggctctgtctctgcaaatggatttctgaacaccaatgtgtgtgtgtgaagggagctctgggtgtgtgttgtaaaccaataagtaggccgggtgcggtggctcacgcctgtaatcccagcactttgcaaggccgaggagggcggatccgaggtcaggagatagagaccgtcctggctaacacagtgaaactctgtctctactaaaaatacaaaaaattggcagggcgcggtggcgagcacctgtagtcccagctactcaggaggctgaggcaggaaaatggcgtgaacacgggaggcggagcttgcagtgagtcgagatggcaccgctgcactccagcctgggcgacagagcgagactctgtctcaataaataaataaataaataaataaataaataaataaaccaataagtaacagaggcagatctcaatcaatttagaggttgattttgccaaggttaaggacactcctgggaaaaagaaacacaagttacagtaggatctgccgcctgtgctttgtccaaagagagtttttaggacttcactatttaaaggggactgggtgtagtggttcatgcctgcaatcccagtgctctaggaggccgaagtgggaggatcacttgagcccgggagttcgaggctgcagtgagctgtgatggcaccattgcacttcagcctgggcaacacaacgagaccctatctccaaaaagaaattcttttaagaaaaaaaattagagtgggcacaatggctcatacctgtaatcccacactttgggaggtcaaggcgggcagatcacttgaggccaggagttcaagaccagcctggccaacatggtgaaaccccatctctactaaaaatacaaaaaattagccgaatgtggcagcatgtgcctgtaatcccagctacttgggaggctcaggtatgagaatcgcttgaactcgggaggcagaggttgcaatgaaccgagatcacatcattgcactccagcctgggtgacaaagcaagactccatctcaaagaagagaaaaaaattaaaacaaatttaaggggaaaaagcaaaaaggaggggaaggaggaagggaaaaataggggagagagtaggcaatgaggcaagtggtttcattcatgtgaggctttgattaccgcttagtgaatctgcattttacatgtgaaaagagaggggtagattatgcaatcggctccagctcagtaaatctacattttacgtaagacagagtaagcaagtgaaattacagctatctccttcggaacaaaaggaaagcagttttcgcctgactcagttcccaagcttcacttttcccttttgccacagttgagtttggagccccaagttgcaattttcctttcacagctgggagtgtgtgactgtgtgtgtgccctgctattggtgccagtgtgtctgaacctggctgaggatgtgggtgtgtgtacgggagtttggaacatgacctgcagccgtggcaggggtgacaagagaaaagtctgactttgagggtccttggttctgatatataattgtgtgtgagtgtccccatcaaagttgtggccgggcacggtggctcatgcctgtaatcccagcactttgagaggtcaaggcaggcggatcgcctgaggtcaggagtttgagactagcctcgccaacattgccaaaccccgtctctaataaaaatttaaaaaaaaaaaaaaaaaagctaggaatggtggcacacacctgtagtcccagctactcaggaggctgagtcagaggaattgcttgaacctgggaggcggaggttgcagtgagccaagattgtgccactgccactgcattccagcctgggcaacagggcaagacttcatctcaaacaaaacaaaacgaagttatgggtatgcgtgtgtaaaattccctgctaggcccggcaccctggctaacacctgtcatcccagcactttgagaggctgaggcaggagaaccgcttgagctcaggagttccagaccagcctgggcaacatagtgagcccttgtctctacaaaagatttaaaaattaggtgggtgtggtggcacgagcctgtggtcccagctactcaggaggctgagatgtgaggatctcttgagactgggatgttgaggctctactccagcccgggcaacagaacgagaccatctcaaaaacaacaacaacaacaaaagaaatagccgggcatggtggtgcgcacctgtagtcccagctatgagggaggctgaggcaggaggattgcttaaagccaggaatttgaggctgcagtgagctatgatcaagccactgaacttcagcttgggtgacagcacaggaccctgtctctaaaaaaataaattaaaaaccattagtgaggagaggtgggatgcacctgtggtcccagctactctggaggctgaggcaggaggatcacttgagcaggggaggtggaagctacagtgagccatgatcacaccactgcactccagcctggtgacagagcaagaccccaactcctaaacaaataaactcccctaccatatccgccccgcgcctgaccacagccatctctgtataaagccacaggcggcccccactctggccaccccactccacccctggctggaacactgggtgtcagtaattgctcagggagcactagcagtgtgattaattatggctgctaaatatgtaaatcagctgggggttttccgggcagccgcctgggtgctggcactaatgttgaataaacacaaggagcttagcaaggcccagaattcccttctcacacctttgtcaattaacgtttcatttatggggttgggtttctcattcattaacgagctttgggctcattaaagagtcctcattaaactctataaatcgtccctcctttccaaaacgcctgcactgggatgggaatggagttgcaaaaccgagacaggccgacctgcattcaaacgcctggctgtgtactgtgggcagacgcctcccctctctgaacctgtttccttcctgtaaaatgcaagcaaacagacatgggggcatgggggcaagcgccctgtggctcatgcctataatctcaacactttgggaggccaaggcgggaggatcgcctgaggacaggagtttgagaccagcctgggcaacatagcaagaccctttctctacaaaaaaaatttgaaaattagctgagcatggtgaagcgcacctgtagtcccagctactcaggaggtggaggcaagagggttggttgagcccaggtgttggaggctgcagtgagctatgatcgtgtgactgcactccagcctgggcaacagagcaagatcctgtttcaaaaaaataaaaggctggggtcaggagttcaagaccagcctggtcaacatagtgaaagccctgtctctactaaagatgcaaaaattagctgggtgtgatggcacgtgcctgtagtcccagttgctcaggaggctgagacaggagaattgcttgaacccaggaggcaaaggctgcagtgagctgagatcatgctactgtactccagcctggtcaacagagcaagactctgtctcaaaaaataaagaaatacaataaataaaataaaataaaagaaataggccgagcacggtggctcacacctgtaatcccagcactttgggaggctgaggcaagtggatcacctgaggtcaggagttcgagacctgcctgaccaacatggtgaaacccccgtctctactaaaaatacaaaaattagttgggcatggtggcacacgcccataatcccaggtacacgggagcctgaggcaggagaatcgcttgatctcaggaggcagaatttgcagtgagctgagctcacgccattgctctcaagcctgggtgacagagcgaaactccttctcaaaaataaataaataaataaataataataattaaaataaaataaatataaataaaaagaaagggagatattaaagtggactgtgataattaagaaagagaatacatgtaaagtgctgagcccaggggtgtaattttgaaaaacggcaacagccaaaattcccttaagagagagaatggctttttgtttagcaaaatgtttgtgttttttgtttttcgtttttaagagatgggatcttggtatgttgcccatgttgacttgaagtcctgggctcaaactcactccagatctcccaccttaggctcctaaatagcttgagctacaggtgcatgtcaccatgcccagctctgtttagcaaaatctgttgatgatcttcatcactttcttctttttttttttttttttgacggagtctcgctctgtcgcccaggctgcagtgcagtggtgcaatctcagctcactgcaagctccacctcccgggttcacgccattctcctgtctcagcctcccgagtagctgggactacaggcgcccgccaccacgccctgctaatttttcatatttttagtagagacggggtttcactgggttagccaggatggtctcgatctcctgacctcatgatccacccaccttggcctcccaaagtgctgggattacaggcgtgagccaccgcgtctggccgatggtcttcatcactttctagttctagactttggataaattattccacctctctctgttcctcagtttctttatctgcaccacagagataataatagaacatccctcaaaggttgttatgtgggataattaaattaatcgaggtaaaacatttgatgaacagtgtctggcatatgagtaataaatggcaactatgattaagattaatagtgttagttgaggctgggcatggtgtctcacgcctgtaatcccagcactttgggaagctgaggctgaatgatcccttgagcccaggagcttgagaccagcctgggcaacacagtgagaccttgtcttttttttttttttttgagacagagtctcgctctgtcacccaggttggagtgcagtggcacaatcttggctcactgcaacctccacctccctggttcaagcaattctcatagctcagcctccacagcagctgggactacaggcacatgccaccatgcccagctaatttttgtatttttagtagagacggggtttcaccatattggccaggctggtctcaaactcctgacctcatgatccacccgccttggcctcccaaagtgctgggattacaggtgtgagccactgtgcccagccgagaccctgtctctctgtttttttttttttaattatactttaagttctagggtacatgtgcacaacgtgcaggtttgttacataggtatacatgtgccatgttggtgtgctgcacccattaactcatttacattaggtatatctcctaatgctatccctcccccctccccccagaccctgtctctttaaaaaagtttaaaaattggctgggcgcggtggctcatgcctgtaatcccagcatttaggaggccaagatgtgtggatcatgaagtcaggagatcaagaccatcctggacaacatggtgaaaccccgtctctagtaaaatacaaaaaaaaaaattagccaggcatgatggcgcacacctatagtcccagctactagggaggctgaggcagggtagttgcttggaaccaggaggcagaggttgcaacgagccgagatcacgccactgcactccagcctggcgacagagcaagactctgtcaaaaaaaaaaaaaaagtttaaaaattagctgggcgtggtggcacatgaatatagtcccagctacttgagaggctgaggtgggaggatcacttgagtccaggagttggagactgcagtgagctatgattgcaccactgcactccagcctgggcaacagcaagaaaaaaaaatgcttctaaaaaaacatgaatgaacgaatcatcaacctctgggcaccaacagtcttcatggagtcaggactcttagcaacgttgattcaatgaatgaggacaagtattcaggtggccttaaggggctggtggcaggagtagtagggtgagagccttgggtttgagggagaaaactcaccccaacctgaagtttctacccacccaatcccatctgacccaactcaactcacaccatttctccatcactcctaactaaactcaatccaacagtgcccatcaacgatgaatgaattagctgaaggtgggagatgactgaatattacttggcaataaaaaggaatgaagtactgatgcatgctgcaaataaacctggaaaccagccaggcactgtggttaatgtctgtaatctcagcactttgggagatcgaggtgggtgaatcacttgaggccaggggttcgagaccagcctggccgacatggtgaaactccgtttctactaaaaatacaaaaattagccagggatggtggtgcgtgcctgtagtcccagctactcgggaggctgagaaaggagaattgcttgaaccctggagggggaggttgcagtgagccgagattgtgctactgcactccagcctgggtgacagagcgagactctgcccacaaaacaaaaaactcctggaaaccgttttgctgaaaatgccagatacaaagggccatatatcattatatcatttatttgtatttattccttttttttttttttttttagagacaaggtctcactctgtttcccaggctggagtgcagtggtgagatcacagctcactgcagcctccaactcctggcctccagtgattctcccgcctcagcctcttgggtagctgggactacagatatgcaccactgtacctggctaatgtttttattttcatttttgtagagatggggtcttgctatgttgcctaggctggtctggaactcctggcctcaagcgatcctcctgccttggcctcccaaaatgctggggttgcaggagtgagccacctcacctagcgtgattccatttatatgaaatggatatttctgtccagaataggcaaatccttagagacagaaagcagattcgtggttgcctacagctgggaggttggaaagacatgagtgaccactaatgggtataggatttcttttaattacacagcttaaatgggtgaattatatggtaatgaatggtaatgaattatatggtaatgggtaaatgaattctatctcaataaatcagttaaaaatatacctcaaaccaacatcttactcctaattcaaatcatcccaaaccaaatttttttttttttttgagacaagttcttgctgtggtgtcacccaggctggagcacagtggtgcaatctcagcttactgcaacctccgcctcccaggctcaagtcattctcccacctcagcctcctgagtagctgaaaccacaggcatgctcctccatgcctagctaattaaaaaaaatttttttgtaaagaggccaaacttctggtttaagctgacttgggcctcccagcccaagctgacaattttcaacttttcctctaggagcctgggtgaataaataggcctataatctccagtgagtctcattataattgcattcccaaaagacatacctaattaatacaggtggtgacaggtacctcagatgagacaagagccagatcccaagacagatatgggccacatcagatgaaagagatcaagagctgggtgaggtggctcgtacctgtaatctcagcagctcaggaggctgaggtgggaggattgcttgaggctagtagtttgagacaagcctgggcaacaaagaaagacaccatctgtacacaaacacacacacacacacacacacacaaaacaacccagctgggtgtgatggtgcatgcctgtggtcccaggtactcaggaggctgaagaaggaggatcactcgagtcccagagttggaggctgcagtgagccatgatcatgcccttgcactccagactgggcgacagagtgagacccagtctctaaaaacgagcaaacaagggctgagcgtggtggctcacatctgtaatcccagcactttgggagatcaaggcgggcggatcacctgaagtcaggagttcaagaccagcctggccaacaaggtgaaatcccatctctactaaaattataaaaattagccgggtgtggtggtgcatatctgcaaccccagcttctagggaggctgaggcaggagaattgtttgaacccgggaggcggaggttgcagtgagccaagcttgcaccactgcactccagcctgggcgacagagcaagactgcgtctcaaggataaataaataaaacaaacaaacaaacaaaaaaatttaaaaaagaaatacacagagacagaaacacagttcatcagtttattctcagatttgagatgcaaattatgccctatggcctggcggtggggggccaggcttgggctggaatctctcatcatatcccagccttccctaaggaggaagcagatgaaatctacaacaggggggactttcccttttaatacagacccaggtataaatagggcagcaccattaggatcctgattcacccccccaacatcttggtccccaaaccacctggcatggcaaggtgagcctggggaggtggggggcagggggaggggatttgcagagctgggctgaggcaggaaaagaaacacaacccagtcaagggaagtccctcttccctctgtagtccgacctcagtcctttcaccgtggaagtagaaaggatcaaagggggtgggggtaggggtcccagcctgggatcaggagacatccagtgcttaactctggggaggggtagcaccaaaaggtgtgaagggcagcgacggaggagtgaggaggcaggcattgggggtgggggggcttttgttcatcagctctgagttagaagctcattgcatgggggttcaaggggtggggaggtgaggcttgggtggggagggaggggagaaagagccagactgcagtatgccacctggaatggggtgagaggaggctggacccttgggccagggaaccccagcccccagcaccctggaaaggagaaggaatgactgtccgtgatgagcgaagtcacatcccattggctccatagtcacaggtaacgaaaaatacggtggcttcaaagcctcagcaccaaatgcaccccattctggggctccctcatggtccctcccaccccggacactctcagctgctgaagcagacggggcccagttcaaacccaaacttttggttcgtctggccaaagtcagtggccgccacatcccacaggggcagaaatcccgctcgagaagagctgaattcgaaaagggtcttcgtctgtcctttccggagctgtccccagagaagacagagacggtgagttaccgggaaggtggccgacatcttgcctcccctctctagctggccactgccccaccctcttacccggcagccatcctgggggacgctgacagtggctgctgtcgtctggttgaaagacagctcctctccattggtgccaaggaagcgggcggagtggctgtagtcacccgtggcttcgtccagccaggcagctgcattctggcaggagtaggtgaagttctggcgagctgtggcactcagcagtttcaggaagttcagctgcacgacattcactggggacccgtcggcgtccacgtaggagaactggtgagaggagggcaaggcagaggatgaggggctccatgagcctctttctgcagaagccaccccccggaatctccatccactggcagacaagccaccccccccatgtcaccatctctgaggaggtcccaccagccacctagagatccctggcagaatcccaagagtcacctgaacatccactctgtccacctctccatccagtaggcctccatgcccactccatctgacctcccaaattctgattgcttcatccaccaatccagggttttaacacactcatccccacccagaagacacaactctgcctccactcttgtgagtcgctggatctacagagctcactgtccctgataccagatttctgccctgtccaatatggcagccacatgtctaatagccacgtggcttttgagcacttgaaatgtggctgatttgaaggagggatttttttttactttatttaattttttttccttttttggggggtaagggttgggatcttgctctttcgcgcaagttggggtgcactggcacaatcctggctcattccagcctccatctcctgagctcaagtcatcctcccatctcagcctcccaagtagctgggactataggtgcacaccaccatgcctggctgggactttttttttttttaacttcatttaatttttttttttttttttgagacggagtcttgctctgtcgcccaggctggagtgcagtggcatggtctcagctcactgcaagctccgcctcccgggttcacgcctttctcctgcctcagcctcccaagtaactgggactacgggcgcctgccaccacgcccggctaattttttgtatttttagtagagacggggtttcaccatgttagccaggatggtctcgatctcctgacctcgtgatccgcccaccttggcctcccaaagtgctgggattacaggcgtgagccactgtgcctggccctgaattcttttacttaaaaaaattcacaactaatgactgagcttcaatccagttatcagaaagcttatgcttggaacaacttgagtctgaatctactttttgaactgttgttcaatggttttatgaaatctaaatatagagcaaatattcccaataaaatttagcattcaaattgtgatgtactataaatgtaaaatctccatcagattttgaagagctaatctgaaaaaaatacaaaatatctt

SEQ ID NO: 727 - DNA, 42411 bp, Human
actgtccaatatggtagccactagccacatgtggttatttaaatttaaattaagcaaagttaaatattctcttccttagtcataataaccatattttaaatcctcaatagtcacatattataaatggctaccatatctgacagcatagatagagaacatgttcgtattgcagaaagttctactggatagcactgttctgaggacgttaaaatgagtaagaaagagaaaaaggcagggaaggaggcaagggagagaaagtgattaacaaattccctctcccgctgtgtttaacatcgtattggctctcatgtaactgccaagacagacgctgctctgcagtattggagttctatcacacctcctctccagaaagatgtttgagagattgctgccttatgaatcccctagtcatataggattgttggagcaaggcattgagttaggggtggagccagggttaggtttaaggaaaggtaatttaatggatgaaggaggcccccatgcatgccctagcatcatgcccagaatccgagatgcataaaacattgactcgccactggaaagctgcaagagtaggtgcagttgtctctggtgcccagtgagtcttctgctattcatggtcagacaacatgatactaatatattgctcagactaagtcataggttaatacagtctattttatttgacatttctcattagagaaaatcggccagctcatctttctaaattttatttatttacatctgctatttacaatcataaacattcttattcactgcaaataaacatgggcagcctatctcctcccctccacactgtatgatggataatatggaaattcaaaccacacatcttctttgccacaaatctgtagtgaaatgacagccttctatagaccctctgaccctcagagattttcttccttttggagacattttgagtatctttttgaccataatcaacatcttatcaggtaggtctcttgttctaagtagccgtttcaaactctgagggtgtccagtgtctatgagcttcctgccactcacaatatttatactagacgttgccaggggaagagaagagagtccaaaaatatgtccaaatgctgccctgtgaaggttgctatttattttcacaaacctcagggctgcattcagtttcccgtctacctgtgtaggcagccatttcttcagtgtattccctatgttctaattggctcgctgtacagattcttggctctgtgcttaggaattgtcattgacttttaacccacctcacctgctgagcagctttctgtgttttcattagtatttcaggcaccgaatctcatttttaaagttattatcaggattttaattggtggttctcactattcacccttaagtttagtaatatttaaatttttattttgttgcatttaataaaagaatcataaagaaagaaaaataattagggagagaaaataatttctttagagggaaaatggaggattccttagactgaaggctggtcagttaatgggaattgtgacttatgcagaggatctaataattgtaagtatcatggttttacttgtttgaattaataactttaaaaaatctcagtcttgcattagcatattttctgtctcttaacaaccgaaaataactgaaactttcccaacatctactaaaatggaaagtttgtcattttctactatgacctgagggtttggctacaaacagataatggaatgaataagatgagcattcaagttatacctgcctgtttaatatggggagaaactaaaccacctgtaaagaaagcatggggtgagaagcccccatcacctgtataaccctcggtatttctgttcactttaagagcctgccactgaaaacattcagtaaaggagtgaatcttccttgccccatcaagagtcgcttttcagctggaggaagggtgtgtccccaagtttttacctgggagcaatgatgatcttgtcaagcatttcagtgagaccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcaatgctgttcatttttctggtgagtggattctggtaaaagtccttcataatcgtgcccattgtaaacaagtgaaaactttttagaaaatgttagtgggcattatttctaacctaaacccattgaaaatgtatattaatgacaagatgattttatgaactagatttttcaatagcatttctctctttaattgaagactcaagatcatgttaatgcctcagtgtcaactcattgtattacatctctgacactgaagtcattgctaagtcatgctgggaaaagactgaatttaggaaattcctatcgctagttagtagcactttgtcgttcaaaatctcttctgcaagagggcttttaaactaaatatcacaagtgtgtctggatttttaacctgtttttttttttattttttttgtgtgtttggtggtggaattactctaatttttaaaacataaaaatagcaccacataatttaaaatcgtagcagtttgtggctggtctcgctatccaaataaagtcatcagttgcatatttggttagaatctgtatcactactataaaaagccccgcactatttaactatgattttatttaaaacatttttaatttcaaaaaacggcagtacaggaggtttataaatgacatattaagtgaagaagtggctataattaaagagtaagtataattattattacactcgatcttactactggaatgtcagtgatgactgcgatataaaagttgtgcacttgatcgtctgacgaatgtaatgaaatactttatcattgcccccttacatgtaattagttttcttgctgtagagataatactaagtgcaccactaatgtattatgtcaatttcactttcagtgaaaatttgaaaattgtaatctctctcatagtaaggttaatgtaattcaaaaaggcaggtgccaagtaaattgccctccagcttggcaggatgtatagtgctgtggttcacatttgtttctacttgcttaatttttgaactggaatgttgggttggttggtataataagttagatctttgattcaaagtatgctggttagtttgaattcagttttattaactaaggcgggacataatcagtggatttagttataaatgagcatcagtaagctggtggctttggttccaagctttccttcaaacattagtcctatcccatgctcttttcagtggatatttaggatcagttgatttcattacttaggatttggtagggatcactgatcattatacagtatgtcatttgaaatatgagagtttcatattgtcagtaatcaagcacttttacttaaaatttcaaataaatttgatccattaagagctattatagttttagttgatcagcttgttcagataggtgtacactaactttcatagaatctctaagatgtgccttatttgttgatttatttatttcaaattaattatagcatatcaaatttctttaaacagccacttcctatttagtcattcttcaataaaatgtatcatcatcaaaatcatatatctttattgaactttctctagctgtgcctagatttttttttgttggcttatgggggtttttttgggaatgggggaagaggaggttaccttattttatattgaaattaatcacaagtctcccacatgccttatgaaaattttttctcaaagaacttacactatcatgaattacaatgtttcattttcacgttgacatcataggtttttttggaaaacatttcactttctaaggtttggaagatcaaaatttattttaagtacagattttaccacatgggataattttggtaattgtgctttggagtttcctaatctgtatttttctttaaaatactttttttcttcataaaacaaccaccactatagcaaattctttcagttatctttctcctagtctcattataaatgcatgcttttaccaaaaaatgaaaaaaaatttatgtaaagtctttatattcgtctctactcaaagtcaataagcgggaacctgcattaggaagcgtatttgtacaattgttaaggcctttaagatatttaaattggtagtgtcttttaagcaaatctacctgagaactgggtaactatttgtttgcaagcatactgtgtattcatctcaatgcatctgaaggttgtgaaccttgttcaaatgagtgggttgaatcagggagaacaaagctggaggagctgctcttacagcaatcaagatcgctctatggctattccattgttctgacaagtctcctggacaggcaagagattacacctgctataacactgcaagtcaaacacattttgttaattctgcatctatttttcattcttctttttgtttccatataatcagtgtatggagtagagaaaggagttagaatgtattttctctaggcctgagaacaatgcttcttatgcaccaaataaaagaaatctatgtgcatgtatatgacaatggtaaaaagtacagcatggtcactgtgggaaagcaaaacagagccagagggatctctatggttttaatgatttctgaaaattacttgcaactttgccaggtccaattagtccatttaagtcaatacaaatctgaagatgtctttttctaaaaaggtaaatttctgcagctcaagctcaaagaacagagaaaatgacttttatctatgaccatgaatgatctgattattttggttcattatagtaaccattttccccctctttctatgggttaatatttcatttcgaaacaaacaaacaaaaaaaaacccaaccctctgaccacctgataaactaactccacagtttgaaccgaactgaaattctgtaaaatatgagcaggagtttttaagagtactttcatcactcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgtttcagtaaaatattttgtagaaaatggaaggaatatttctgttcacgtattcagtgaaacttacaaattgcattcaagtgtcatcattaacagttatatggtgttcataaaagctttattatttcgctgtagatttaggattagcatcttctatcacctttacagaaacaaggagtacaaatttatcatcgctcaattggtttgagttgccacaaagtaaaaacattttgtcatccctgttttaggaaaagagtagaaactaaagcactgaagaatgctgtcttaaatctgaaaggctgaccctagaataagattcacttatttaacaaatctcatcaatctagaaaattatcttatctatacccagagcacttaatttctggtaactctttctccacaacacattcatcaaagacctggttgctgagtatccctgtgtcctaatagacattgcctaacatatcagcaggaagcctgctgtgccaggcaccgcaattagatttataatgctccctcatctcagggaacacccttgcccagtgctgggtcatgccacccttgctgattatgcttgatatgcaaattccttcaatagacttagacagatcaaatttttttaaatgccattggctgctgatccatgctcttaattggtctatgagaataggccacagtttttcatactcgtctaatgagaaatcatatctctacaaattaatggttgcctgttgctctcaaaactgcaagactgtaagttatttgaaggcaggttctgtgtctgatttgcctttgtatcccttatggtgccttgcaccagtgcaagattgctcaaaagatgtctaatcacacacagcagaggtaccacaaggaagtttctggatagtttatacagctcttcccccacacactccaaaaaattatcacgctattaaacatagaaataataatactggatttccccaacattttaatggtgtagtattaaattcattttacatttcacctgagacttactataatattttcaggcctttaaaagtcttaatctagtgttggatccacataatacacattcagtatgtacttgtaaaatacacaaacgaaaagaataaattagagaattcaacccattaaggtgctgtcaacctcagactgataccctttgtcagagcagtacaaaggaaagataagaggaggtttttaaataaagcaaattgtgatattttagctttgtttcaagtgcatccttgcgatgtatataaaagttaacaattacattagaattgaatgcttaacaaaaacgtaacaattatgttagaattcaacgcttagcaaaaagtgacttggaagaccatctcacaattattaaatgcaagagattttttaaataaaaatagcttgttactctcaaacccatttttattatgtgcaaggaagcatgaacttcaatattaaaaaggaaaacattaaaaattactgtaattggggatttattaaaattagcctgtgattttgtctcctgtagcttttaaaaagtacataaatggattggttcctaaaacagaaatgaaggggaaactcattgaggatgtatttcaggtgaattatttactgttttcatagaattttaggactagaggggacttttagtctcatatacagctgaggaaactgagcacagattgatttaatgacttaccccaaagtccctatccactgggcaaaacagctgagatatactcagtcagcctgataacctctgtgttcatctctaggtaaatctccatcacagcctccatagcacagactccaaactcatttgggaatccaaacttctcccctaattgtcagaaaataacctcacccttactccagggacaaggtctaggtcatttaggagagtgtcctccaatttcccttccccagtttattgattttaatctccatccacctcacccttactccagggacaaagtctaggtcatttagtacaatgtcttccaatttccctttcctaattgatcgattttaatctctatctttccttgcctttgtctttgaggtcctttctttttctgcccattctctcctgctctccctatcacaacacttctatgagaatcttcctgcagaacatctcttcttttaaatcaaaatctcctcctagcttctatcttaactttcaaaaatccttaggttaccctctctcaaaaaaaaatgctactgtcttgtccctctgttcccttttatcaccaatgtcttgaaaaagtgaccatctttatgtcctcctctcctcctctcatttcctaatcccttgctgtcaagcaagtgcatgttccatccagctaaaaatattctcttgaaggtccctcagaacctcaggatttcctcagaattcactctgctcaacttttttacctcatctctttcaaccccatctgtctttccgttttccttttcctctgacctccattataatgcattatattttcctattgtttctttcgccattccttctctctttcgccactccttctctccttccttttttttttttttttttttttctttttttgagacaaagtcttgctctgtccccaggagtgcagtggtgcaatctcggctcactgcaacctccgcctcctgggttccattgattctcctgcctcagcctcccaagtagctgggactacaggcacgcaccacgacgcccagctaatttttgtatttttagtggagacggggtttcaccatgttggccaggatgttctcagtctcctgacctcgtgatccacccgcctcggcctcccaaagtgctgggattacaggcgtgagccacagcgcccggccctctccttccttttttttttttttgtttgtttgttgtcgttgttcctagttctataaatgtaggaactcttctagttttatcctcaattgcaggctgattcttgactgtatcctctactttggaaatttcaaattctcacgatttcaactatcctgcctgagcagatctacctcaaatctacatatccagcttgaacttttgctcaagttttgatccatgtttccaattgctgatcatcttcacccaggcattatctggcatctcaaactcaatgtgttctaatctgctaaattctattactgtcttgttcccaatcccacagtttaaaactgccatcccctgagcttcctccctctctcgaacacccccatcccatttgttctcaagccctgccaatgctatgctgcagtatcccttgatctttccccatccattccctctgtctctgctccagcgtacctccttctcacctccagtctgctttgatacagagaccctcaactgctcaccgtctgtaatcactgcctcttcccactagtcctaccaactgttgtcagagttagctttaaaaccacaattttatcatgctcttctcacatctaaatacttcaatattttcctactgcacacaggcatttaatattacagctggaaagttacctgtataaaatttagtctactcttgtcattttacaagtgagaaaactaaagttcagagaattggggaaatacgttgaagattttccaactctatcaagagtcagatttcactattttgcctttgaaagtccaagagtgactttgtatcagagtttattctagactctgagcaacagaaaataagcttacaccaacccaccacatttttaagcagacttggcggtttttagattacaaatccaattgagagtttgactgtatggtgaaagctacttggtcttctgcccaaattgtctctcatgggaaaaagaatgacccagcttcataaagctggaaagatttcttagtcatctgcatagctttccaaaacaaacagcaagcactggcgctccaatgcagtaagggaagcgcaataacagataacagatccatgcacaattctgtagctatgaagaaatggctttcaaacacacaaataaggtatgcccatctcccatcccacactcacaaacaagagagagggaaaagtgttcataaattcacaggcagcaaggagcatgcatttacatgaacaccatttcatcatttcagttctgcacccaagatgggctctacagataacatttcagttacatgttttaaaatttgggccatttacttttcttttttttttcttcatgctgtattcctattgtcgtatgtaaatatcaccaatcacaaggataataggttagtttaaaatcagaattttttgagttcttgaagttgcaatataaattctttgtagcatgcttttcttagtagtaatttacttgagggaataggctatctcatattttattgtaaaacccacagctcaagtgaaaatttatgctaaattgtattgaattatatttagccataggttaatatccaagactcaatttcctcatctgtaaaatggagatagtattagtggtgaccacatgtatttgttgtaaagattaagtgcatagatttacataaatacataacctaatacctagctattatttaacaaattataagagtaataacaatcataattattaatattagatacacaatggatatgtaattctcataataaaaacattatctttttatacttctcatattgatcataaatacttattttctgaattatctattgtggcaatttttttaaagtagatacttagagacattaagttcatattttctttaatgctacaattaaaattaactataaaaagaacttttttatatttttaaattactactgttagtatttttaaatgtaaactataattttcttatatcagttatacaaataaagttttcatactttgcaattctgaataaattcaattaaaagttaaaaatttcttatttagggagaaatacaagtacaaaataatagtaataaaaagaagagtaaattgaaaggtaaaaacaaaaattcttagcatcatcatcagacccaagacataaaccaaatccacctgctatttggctgataaaataattttaatgactcacaagcctatggtttcatgttgtttttaaagtaactggataatataaattttaaagcatttaattaaaaaataactagtgtgattatcttattttttacaggtggtggtagaagttaacagtgaattccgaatccaggtaatatataacaaatccatttttccaaatttttaaacaagaaaataatttgagaataacaatatgttttctgaagaaaatgtattctcataagtcaagttcatataatgctaaaattaatagattaccaaaattaccaattttcccaattaaacatcctctatttctgagattataacctcttccaaaaatctcagtggaatttgaattacgaattcaaattaatatataccatttctttattgctgtcatttaaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaagtaggtatcaactccaaagcataacattgaaaatcagaatggataaagtttcaaaagaaactgtctgctaaatatttcatgaacatgtctcaccgagaagctacgatacagaacagaactatagtcacctagatgatgaaaactgaaactcataaggagaaattaagaaatgcaggtgctcagagaaacaggcaaacgttgactcacctcattggtgaaatgcatacacatgatcatgtgttatcccaaactccagatgaaaaaagatcattattttaataaagaatttggctttcagcacattcaaaggaattacttcaatgtgtgctctttttgcctcacaatgtattagaattgaattcctacttttttgtttgtttattaacattcacaaggtgccctctctcataccccttttctattcatttttccatatcttcctttctacatacacacacactcagaaacaccccccacaaattcatgaacatacagatgtacacgtccacagatacacacacgaatatacacattcatccacacagacactcacaaatactccccactaggatttgtttacagccaaacaatattttatttcaaagaaagagttctggtttctataaccatttattcgcgtggtctccttccttttctgctaatacacccttcccattttcagaattcagagcttccactcaaacccagataactcttgtcacctaaataaatctactttcttcgaaaactttacatttaaaacaaattgaagattaaagttgcatgatgacaacattgataaactccttaagagggcaaagagtttccttctgtagctccagtgcaagcacagaccctgcaaataatacaagatcaaattttaactgttgaatgaatgaagtcatgcatgatgattgcatagacttagatatagtagggtgatatttcgcattttttcatgtttcatagaagcagaaaccgaatttctttgattacattgtcagttaccattgaaaatattagagctgtaattgttactcttatctaggaaaataatctccattgacaacatttcctaaataacaaggtcatcacatgcaacaactctcaagaaagctgtcgtatatcaaatatagaactctatttgctccctctaatatttttacttgtgttccttctgcagattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattgtaagtggacttcatgtcaatatatatgttcatgcttaaattcttctcagaagttcttaatctcagatcatacttaatttgatttcaagagtctcaatatttggcatttttggttgtttcttaattcacgagcatcccacgactgaaaagaaatgcaaagattaagagagaaggaaatgtttcacttaagtgtcagcaaaaatgctaacctctatactgtcctcattggcaaactagagtatttgtttggaaggacaattacctaactttttaatttttccttttttaaaaaattcagtaaagaatgttaccttattttaagtctaatgtcaagtaatgattctagagctactgcaggactgttttctgagcaaatatactttattataaattcagtaaagaatgttaccttattttaggtctaatgacaagtaaatgattctagagctactgcaggactgttttctgagcaaatatactttactataaattcatattcctcaagctcacctgagctccaaatgcaccttgaaaatgcatccattcttaagtgaatctcactccattctttacaggagctgtcacatagcttaagtatcctatctcttcaaaccctcaacctcatttccactttaagcagttgaccttgtgaccaactttatgaaaaaggctgaggccatccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccaacacttcttaatattaaaaatagaaataaagaaaccctattttgctcctgttacctcttctattaaaaccccaccagtccgtatcccaaaataccttcaaataataatcgatatttgcagttttcactcacaccgcctgcctgtattcctcacacaactttaattctttagccttcaattccaaatctctatttctcccttctgtcccacaatgatcccccacaaactttaaaaaggcatgctaccctgttagcttttcttggggcataatgcatttttttacgtctttatttttttttagagacagggtctcattatattgcccaggctagtatcataatgcctttatatatgaaatatgccattttgtaaaatagtacacattacacttagggacgcttcaaatacaaataataatagtaataataataatcataataataatataaacccccatgtagctactacctagcttaagaatgccacatttgctttcccttagtgactgtaagtagggcttgtgcctatgttctaagtagacataataattcttttaattcgccacagtgctagcataatgctcaaagtaagaacttaataaatctgtgtttcactgtataattatttatcttttctctcccagatctactgccgagctctgaactcaatgggccaagatttagagaggcctctagagctcagagtcagggttttggatataaatgacaaccctccagtgttttcaatggctacatttgcaggacaaatagaagaaaattctaatgcaagtaagtaatgtagtggcttccaaatcactcctaacagccaggcacctaactggagactaaactatgtcaaagtacacatcatgaatgtaagagataaactatagaaaagatgcagaatagcaagtctttcctttcaactacggaagcagctccaaactgagggacacaaggcgtgattccaaagcaatgaggaggatttttctcacataactcgcaggccagccctgtagaagagtcctaacaagaaattttaaaggcattttgcacaatggtggcagaggcatcgggatgtgaatttagcctcccagtctaactgtgtagaaggacaatcccacccttttctgctcttactgcgttttttccccttttttaaagttagctactttaaaatcacttatagaaatcacttccacacaaaacttctttttgtgatttaacctttaagtgataaaatttcttgtgaattccaaaaatccctacactttacttttattcattaaaatactgtacctatactttcaacttttaaaagtgttattataaaatgctcattaaatttatgtaatatggaaagtaaaagggaacaaaaatctgctgtctgcatttcctagtaccattcttcagaggtatgcactgtgtacatgcgctccataattatgtaaacataaatcacatgttttttaacataaatggtatcatctgttacatgctaatccacaacatgaatttttatataaatatattttgaacatatttccatatcaggacacataattgtttcactgctttcaatagttgcatggaatttaattatataaattacataagtgtatataaatgttaattatctagtgaaaacattttaaaggttatgctacaataaatacaggtgggggatgacagatgccatgaagcatttgtaggaaaattgtatttaaaatggagttggagagtagagaacaattccaaagttatgaatgagcactggcagttttccacattctccaataatctaataatcttcatcaaaactacttataaaattaatgaaaagataagagacaggacaatatgtgtagttaagcaagcatttctttagatctactaattaccttgcacttgacgaaggatcacccaaaacaaaacagtagtaatgtatatttatcaaacgtgcattattcattaggaactttatatagttttctcttattaatgatttaattctcacatgaattcagtaaggatggcagtaatatcatccccatttatagatataaaaattgaggccaagatcatatagctagaaagtgttgagaaagttgggaaaatgttggtctggccttattatcattttgtttcgccacagcatcctttaaaaaagaagaaaatatgctagaagaagaaatagaaagccagaataacacatttcctttgtttcccagttatcaacaatgtctagattcctagtaaaatgtgatcttcttgttaggcaaagatatagaaaagagctaagatatccatatgttgaaggagtagaaagggaagacagtgaagtccacatcataaggatcaactaactctaacacttttttggaaaggtgatatactctactgtaacaaaaatgtaaatcacccatttgcaatcaattttccttaatttctagatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagaggtaattctttttctttaagtgggtttttggtctcaaaggaactgattctaaaagcaaggatactgaagagacaaagagatgaagaaaatgatggtttaaatttttacttgtataactttttcacataattctttcatgtaagaaatattttttaaatgaaaaagggaggatttttcaattacgttttgtactatttttcatataattaattgattaaaatttacttcaatttaagaaaactatattgtgaaagtacatgaaaatatgcctaaggtagaatctaaggtagaatcaaaagctccatttctctaaaaagtgtgttctataataaaatgaatttaggaatgacttgctatatgtccacgttttggtgagttacagtgcatgcgagtatgctggaggctccaggaatattgatacactaagttctctttctttaacctagcatatctaagctccattgacaacagaattcttgtttttcctatgtaacatctattgatagctcacccattcatttactttgggaaatgaaccacaggataagaatgatggataggaattaaatgacagactgaccaatctttttatttacaaataagaaaataactagtgatgttaacagagtaaaatcagcattatgaggtttctagcatgccttgtgattttatgatttagttttaaaataagtgctttttcattatttaaaaaaaattgtcttttaatagaatgttgcaacctaaatgtacattaggagcataagtgaggaagctttattttctgatggtattcaattaattttgttttaattattaaaaatgacaatcttcttgctgatgacttttaggtttaggataattcatattattttaatactctttaattatctaaatgttacaagtttctatgttacctaagtctccttttatacatgtttgaaaatcaacattagaagaaattgaatgtttacacttttctctctcaaactgtcttaaacagcccaatgaggtttctttcatgtcaaaagagctttcgtggtaaagcactgtaagaaagggctgtcagaaggaaagggactctgcagccattgggaagccaccagggcagatattctcaacctggggtcaatggagagacctcaagatgtctctataaaaccccctaaattatatccaccattttgaatgagtgtgcatttttgcatgagtcaaggaaagcctccatagattttaccagcttctagaaatataagcaccattgaatagagtcaagaatagatacatcaccaataattccactgccataacccactacctctcaaaacacaaagctttgttatctgtttatatgcttcttgcacactcgggggctgattatttaggttatggaatattcatgccataaatttttggtaaacttaatctctctccttgagatcattctggtttgttttaccctttataaactttttcaacctctggacatattattattaataagaaatgaagccttttaaaacgtgttgcatcttttaaataatgcgtgataagtattattgggaataatcatgtgaaacttgtggatttcccatattctgtgttaaccctacctctatcatagatttatgtaaacgttgagccaacttttcaaagaactttacataagacaaagtaaaggctgtctacgtcaagtgtgatattgcctgtaatatgtatttttagcaatacggccagtatgctcttgctgtaagaggctctgaccgagatggcggggcagatggcatgtcagcggaatgtgagtgcaacattaaaatcctcgatgtcaatgataatatcccttacatggaacagtcttcagtaagtatttgttcttggaattaataaatctaaattcgctatattctaaaacatatacgaacaattctgcttacagaggcacatgttatgtttattgacatacaacccaaatgtagacacatacttttttcttgtgtttatgcaagaataaatggagttaagcaatgaaaaatgagatgaaaaccacagatatcttttctaaataatgaagttatcaacattccagtataagcctactgtagttctctctctttcacacagtttgtgctaagagttttcacttcttgtttcagtataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaaggtatggtataattatcctaaatattttgttttcttaatcttttttcaaaatgttaaacttaaaataaaatgatgctaacatttcacaaacttggcttagtgaaagaataaaaattactgtgttttaaatatatatataacatagagctttttaatatagtctttctgcttataatcattttagaaaaacaggtattgaattttaactggagacagtttgtcaatacagtactcccaaatagatcatataaattgaaaacacttaaaaatatattttatgcttacaacaaagtataattaatccttaaggttaatgtcttaagaactttttaaagcatatttaatagaggctttaaaactgtgtccatgtcaacattgtaagtcaattattacacatgtagaatattcatcatgtaaataaaaatgtatttattcctcccgcgtgttttcataaaatttaagttaaattactataaatgtagaattatcacactcccatctcactgtggctgctgatcaaggcttattaggaacacagatatactggaaatttggtccaagtcaaccggtccagaacaactggatgccgttctcttatgtcctccccatattaatggtccacatttacctgcagtaaaatttcatctgagatgtgagaaaaaaaatttgcctcctagggagctgatagtcaaagtttcgccctgtgctacacaacttacacagtcgatttttaaaatctacaacagctgtttatggattgtatatgttgcatgcaatatatagtttcatggtaaaatataatccctatttaactatttcttttttcagactaggtctggaaaacagactctcaaacgactctgtccccatacgaatgtgtggctttttgcctcctgtgtcttcttaaagtgtcaccatgcctacagcttgtatttaatttgagacagtacgcaggtgctttagtttatccctcacagcatccctgcaaattaggttatattatttccatattgcagataaagacattgaggctccaagagagcacagaacctgcataagttctcatagctagtaagtagtgcagccaacatttaaacctagttttctctagatatgaagttcacattctttccatgatactatttaggattcaatactggggaaattggagtctaatctattttgccccaaactattatattactttagaaaattattcaacctatctgtcctcaatatctctatctgtaaaatgggaatgataattgtttgcccagacatatcatatattaaatcctttgttatagctatatacatatatatatattatgtgtgtgtaatgtatatatacttttgattttacatccattctttgaattgcaaataaaaccaatattagaacaaagattcaaaattttagctaaataggggagttcaatgcgtgaaattctatttttatctaaattactcttgtgaaattttagaaaaatatatttggtgtgtatgggcctaatggcataattgtttgtggattttatgtgttgtggatattaatatcatttttcataaagaaaatcactactttattattttatgaaataaatatttcctagaacatgttgaagaaaatagatttatttatattatatatatattacattatattatctgatttattcaaagagtcacacttacagatgtgaaatttcttgtaaatagttcttatggataaaaccactcaaatgattgaaactctagtatatttgacccatactgtgtaataaatagctactttctgaaaaacataaaatgattgaaggtaggataaattgtctttgcactaaaaaatacatacatttgactatctgtattattctaagtttttaatttgtttggtgaacaatcagagctcacgtcatatgttttcaactttttaacaatgaatctaggggaattgaattgtttcttactttatttgcacaaatttacatcaattaaagattaaaaatttaagaatggattgtgtatttgtgtgcatttgtgtttcataaaagaaagataataagttttttttgctattatcaaaggattttctttcacctggaacgttttattttcttataatgaaactattttactctgtattttctagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtaagaatgagattttcaactaattttccttacatattgaacttaagtacatatgttctttttatagattataagtatctgagttaaaatacttttcattatttttgaaactatcatttaattgtaaaaagtactataaactgtgcatttaaaatgtttaacttaagaaaacataaaaattcatgcaagatgtaagatgttaaactgtaaagatgtgatatgtgaaaataatatgtctcaaaagtatcgacactcctgtatttctatgtcttattgatcaattagctgattaccacaggccgtgattcgtctctcagaagagtttaaggaatgattttccgatggcaaatctgctcagcttgaaatcaattagattttattagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactctgtcacccaggctggagtgcagtggcacgatcccggttcactgccacctctgcctcccgggttcacgcgattctcctccctcagcctcccaagtagctgggattacaggcacctgctaccacgcccagctatttttgttttagtagagaaggggtttcaccatgttggccaggtcagtctcgaactccagagctcaggtgatccaccctcctcagcctcccaaagtgctgggattacaggcttaagccaccgcactcagcccacccatgtgttttataagttctttcttggtgttctcctcacatagtgtgagtagttctgttagaagtcctgtcacactgtaccatgttgctgatgagcgctcttgtaccccacaggagtgagttcactgaaggtagacgcaacccagagcttagcagaatgccagagagagagagagagaattacctaaccagtgtttgtttcacaaataatagatgagaagaaaaacaccgaagtcaaagatgagaaaagaatagaatagaggctcaaggcaaggccttagtttggaattcaaaagaggtcttgtcaagttccagtgcatgtgagaaggaggagcagaaacaggggggaagttcaggccaagctgatgaagtaacttctttgtaaaagaatagtttagaattaggagcagcctgggaaatcctaggatctgggtcttctgtaatagttctgctgctacttaaatcaaatgaaaatgagactgcaagcatcaaaggattattctgacatccaagtgggcataaaaagacattccatcagaaatgggtgctcagtaatttttttttcttaaatgtaaatcttgatatatccctgagtggctccatattgctaagactgccctgaaaaaaaataaagtctctagtaattgaaaactgtatctagggattataattactcactgaaaaaaacaatacattttaaattaaaatttctttttttagatagctgacattaatttgtatcattttctttcaaatacaggtatgtaatgggaaataatccagctgacctgctagctgttgattcaagaacaggcaaactcactttgaaaaataaagttaccaaggaacagtacaatatgctcggaggaaaataccaaggaacgattctctctatagatggtaagaaattaatttacatttttatcttttctagagaaagctgtatataccttaagatattaacattttaactatcacattttgaagtaacccctttccaacaaaagttgtcacactgggcattatagactcatatctttaacaacttgaggcagtataatttagtagctaagaccatgagtcctgaaatgagactagatttgtgtcttccaccatcacttactagctatagaatcttagagaagttatttaatccatctatagctgttgtctcttttttaaaatggaacaataacaatatatgtttagaaggatgtgatgataatgataaaaatagcaacaaaaacaaaacaacaggattagcatagttgagctgaaaggacatgggctttgatatcatatagactagatttaaacatatttctgttatatacttccagaatgtttttattcatttatttagaaagtgtataattgagtcctaactaaatgtcagccattgtgccagattctagggttacatcgattaataaagtcagacaactgagctcacatctatgtaataaagattacaaaaataacctcaaacaaattattcccatatttttgctgaataattccactttcaataatattaggaaaagtttaaatataacaagatgaatgcacaagatgttaattacagcactaataattaaatattgaaaaccacatcaataataggcaacagggtaagtaaaccatggtccatttgatataaaattatataaccatcaggaactatgttaatacaaagtttattaaaatacaaaagaatacttatagtttaaagtaaaaaaaatggaatgaaccatatgatcacatcaatgtaacataaataataagcaaccattcggcattataattaaggacaaaagatcatttttaaaaatatcagcaggtgtcgtccttgggtgctgctaccatgaatttggtttctggttttgttttgcttctttctgtaattctatacttttcaaattatatataatatccaactattggtaatgtaaagaaataatccaataaatagtattactatgactaataatgttagttataaataataatataataatttaactgatttttaaaaccgagtcaaaaacaagggatgattttcaagttaggagaaattatgggaataaagacactgaaataaatgttaatgtaaaaaataattctgtgttgtccaaccattcctacactaaatgtctaaaatatttcttccattttgaacgttattacagataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggatgtaagtactttagcaatcctatgtatatgtgtcccccaaaaaatgctgggggaggagttaagttttctgattctttgataaaacgtattttacaaattctcattttgtgcaattataaagaaacttctgtgtttggcactgggtttataagatgaaaaaattaaactttttgaccccttctaagactgtggaggataaaaatttatttgcagtaagtctcaatgtaatgggaaagtgccataacaagcaggctcaaattgctatttcagtgaagaagacaatcagaagaggctacagagggcggggtgtggtggctcatgcctgtaatcccagaactttgagaggccaaggctggcagatcacttgaggtcagaagttcaagaccagcctggccaatatggtgaagcccacgtctctactaaaaatacaaaaatgatccgggcatggtggtaggtgcctctaatcccagctactaaagaggccgaggcaggagaagtgcttgaacccaggaggcgggggttcagtctcaaaaaaaaaaaaaagaaaagaaaaggctacagagaaagagtaaactctgagttgcattttaaaagatgaataagaattagcctgatggacaagagaaagggaacacaatacaaggggaaaaaaatctatgtgcaaaaacctaaaagaatgagagtgcaaagtactgcgatgaagaactccagtgtgcaagaaataaaagatgcgcatgacagcatggtgaaagtttagactaaaagataggcaggggccaggtctcaaagagattttatttatactaacactgcatagtattaataaaaggatagtcaaatagaccgagggttaaactctggtttctaagcctaatcgtctgagtcttccgaaggtcacctaacctttctgagccttgcttttgccatgtatgaaataatacttaccttaaaacagtgctttgatgatgaaaaagaagtaccacacatgaagcatttagcatgttctatggccactagggtagcactagtcaagggtctagctataaaggtagaatccagtggactctccaggtggctgttaacattacctcgaatgatgatagaaattagagcaagataaaccacatggcacagtcttcgggaaatgagaacaggagctctaaagtaagtaggttgcagtctgcacattacaattaaattaatgcaaacattgtcattttcaaatgtggaatcataaaatcttaatgtcagaaggtacctcagatatttaaatcaaacgctcacacaaaatgtgaagtcagagcgcttatgtataaaatatcttttctactttcatttttcttggcacgtgaacagtggcagatatgttttgctacatttatttgtgaactgggttttctctgattttaaataactcatgtttttgaagttttcatcaacattgggctcatctaaacaacgagtctggccatggtgataacacagcttagagctggagttctttttccaaaatttaaaacgtatttccaaaaaatgaaatttttacattaacaaataagagtttattcttactggctcataattaattgaagtaataaccaggaaaagttctatgaaacagagaaaagggaaagagagaaagaaaaaagcattctcatcaaaatgaaccaagacaagataaaggcaaaaatgctagtgaagttgcagaatataacataaaatacatatgaaaagagttcattctctctgttatttattaccaactaacattgtaaaatgtttaaatttaatacttcataagagtaacgtaattacccaagtgctcattatcactactgtaaataatacctaactttcatgttgagttttgtttgtttgttttctgggttttttttgttcttttgtttttttgtttttttgtttttttttgagatggagtctcactctcacccaggctggagtacagtggtgcaatctcgtctcactgtaacctttgcctcccaggttcaagcgattctcctgcctcagcctcctgagtagctgggactacccatgtgcaccaccacacccggctaatttttgtatttttagtaaagatggggtttcaccatattggccaggatgatctcgatctcctgacctcgtgatccacccgctttggcctctcaaagtgctggaattacaggcgtgagccaccgcgcccgtcctgagttgtttttttacattgcggactacctctgggtactgtagtaaataaaagatttataaattatatatgggccttagtcatcactacctgtagacccaaagtttcctctagtagattttcagaaaaccaatacatgggcttcttttcctctttttttcttttttcttctctccctctctcccttatgtctatccttactaccttccttcttccctaatttacttccttcttttttcctttcctccttcttcacaattttaatttacacattctttctttcatccatttattcaaaaccatttaccaagattagattatataagaggctgataataaatagataaataagaaaactccacttaacagcaaaagacagtgctaagcagtgtgatgttttctatttgtataagagttattgaaagaaaagacacttgcatagggggaaatagcctcacagagaattgttggaagcatgaataagattttactgttgaaataaaggcaagcatatgttaaaggaagacaataaagacatggaggagagaacacaaaggatcaaatatattgcctgaccttttcatctttccttgttctctcctttaatattttcctaaataatgacatggaaagattaatcggttttaataatgtaatactatctgtgatttttttttttttttttttgagagagggtctcactctgtcactcaggctggagtgcagtggcacaaccaccgcccacctccctggttgagcagcctcaacctccctggctcaagccatcctcccacctcagcctccagagtagctaagactgcaggcaaaagcccccatacacgcctaatttttgtattttttggtagagatagggtttcaccatgttgctcaggcttgtctcaagctcctgggctctagtgatccacccacttccacctcccaaagtgctggaattacaggtgtgagccaccatgccaggcccactatttgtaatttttaatactataaaataaactaaaattgactgcagtctaatatacagaagctcccatttactttggggtctgaccatcattcagcttgtattctgaaactttcataattttagaaccaaccagaattatattacgaattcaaatttaaccataaaaaatcaggttgttttgttttttatttgcacccagtgctaactctagtattactatccctccaccaccagtggtcccatttttgatgatctgttgtgattgtggaggtgctcctcgtagtgcagctggctttgagcctgttcccgaatgttcagatggagcaattcattcatgggcagtagaaggaccacagcctgaacccagggtaagtgccacattctaagaaatagccgttggtagtcactgaaattcagtctttacacatgaaccaagatggccgccatcactcacagtctatgctgttttttgtgctgagaaagctaatggagaaaatgaagaggaatcagaaacacaacaaaattagatggaagtaaccagggaagattttctaagtgaagttcaaattttaaatggatttcagaatttcctaaatagtattttttttttaggaaatctgaggtaatttaagaataaaccaaatgtatgactgcagaaagattatagtcattggtcactacaaatggaaatgttgtttcctgtcttttaggatataaccactgtcataccacaaataccacctgataacgcaaatataattgaatgcattgacaactcaggtaagaaaaaagaatttgtttaacatctcaaatgcttaagtaggaagtctattttctctctttgattattgttttttaattatcttatttttcttcaaaagtgtttatatcattcttttttaaatgactaacttgtaaattaaatggcaaggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcattaacatacatacacacacatatttcatacacatatatacactaattaaaattaaagtacaacccaactaaaatagagccgtgctcatttattgaggctaaaatctttatacacaattaatttaaggattcaaaattgctttgactttagctgcttattataacaaagaaaaaaactgcatccattttcagtatcatcacaaatattacctaaaaaatatttgtccaatttctttaattgaaagcaagtagatgaaacactatcaaaatctttctaagctctcaactgagattgtgtgcacatggtggagttttttccagcacgtgggtaagactgtataaatacaacttgccttaaaacaggaatctagaccagttcacaggcagaacccagggaataattagaatttcacagtgagtggataactaccattataataaaagaacaattaaaataacatctcatatctgtgaaaatagttgtatcacattacttttctcaaggtaaataaatactattggttagcttatttttctcatagtctttttaaacagtaaccattgttttctactttaaactaacaggcatagaaatgtgtataacttgtagaactggaccttattcaaagaactcgacacagtagtctttaaatctatttctccacctgatttgtccattttcattaataaccccaatgtcttctcacctcaaaagcagaatctcattgttgactcgtcgtattcactgacaccaaatcagttctcaagacatttatcaaatcatcaaatccatcagtatttatttacacatttgttcccattaaatctacaaacttttgcacaaattttgaacaaagcaccataagaggcaccaaggaaaactgaagcatgaaaaacagactgttcccaaactcaagatccttcacatactaaagccagtggatacatatcccactgacaacattcttcattccacagcagttccacggtcccggccatcattttatctcacctacctcaaatatttcttttttttttaatttaaaaaagatgaaacacttgaccaatttgcgtatcatcctgtgcaggggcaatcctaatgttctctatatagttctaattttagtatacgtgctactgaagcgagtacctacctcaaatatagtaacaggcttccacttactcctcacatccaagtgcaaacccaagattcttcatgaaaacctttctcctcacatagccatggcctcctctctgaaagccagtggttctcatgtctttttctggatgtcctgtgcttctagttatacactggggcttctagttatacactgtttttttaactttcagaatttgagtattttttctccaatttcctacaggttgaaatcaaatgctttaggacatagattttttttaagtcctctgcagccttcacttccagcagagaatatagtaatctctcaacagataattatcaaattaacaaattaataatattattttgagttcaatattgtatttatatctcctttctttatgtattatctttttatttctttgttcacaaatgcatacctaaatgaaaaaatcacatattacaaggcaagttgttactttttagtttatgatagactaaagaaaataaatttaatttgatcaacacttttaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcaggtaaggtccctagccacatgcctttctcgccatccatgtgcctgctgctcttcaccaagctttcactaattcctaaaggggctttggcaggagtctcctaactagattctcagcctttagtttttgtgcccaacaatccatgctgttaatgaattatatatctaaagctctgacctgagcactttactccccaacgtaagaacagccaatggctcccagctctcttttgttcatggcatgcaatccaaagtccttaacatgttaactaagattgttcacaaaatgaaccctccctcttatctccaattactccttgccatcaactccacttgctgagcacctttgccacacacctttcacctccatgtgtttgcttatcctgtgcccctcctggaatgcttgcatcccactatgtctctcacaaactcctacccatccttcaagacccagtccaaatatcactctccctccgaagtttttacagttaaccctctcatccaaaataggattaatgttttctcatctgtatttctgcagtactttgtttacacatttatagaacctatcattgctaaaatctgtccgtttatatgtctaccaccacttttagtgtctcatccatatattctctacgttgtattgccagtacatagctcagttctagacatagaggcaatagttaatgagagtggggtcaagagccatagtctacttccaaaacattgtaagaacgagctgtaggtggtgggaagagcatgaagcctggagaagcagctgcaggagaatttaactttgccatccccaggaagagatgcaattgtccatggttacacatcatgtgatacccaatcttaaggaagttcctgtccctgacatcgactagaaaaacatttctgtccttctacattctggcctaaagtggtttcattaactaacctagtggttggtttaaagagtggctgatatttttaaataaaatattggtaaaagcattcaaatagcaatagatagtaatgaggcttgttgaaaaccataggaatacttattcatatatacaacaaaatattttgttatattttaataacatagaaatatcttccttccaatctctgatcaaatatcactttatcagagaccccttccttgattaccctatctaaaagaacagcacccatcactttctttttctttaccctgcatctgccacctcctgaccatatgcttctgtgttgtctgtctcactcacccaaaatgtaagctctgtgagagaacagctgtatctggtattgttcattatgcatagctaagttccaaacacagagggtctggcaaatagcaaaggctcaatcatttttttatatgaatggcacaatgagttggtttcctataaggtatttctgttaacctgaaagtttacaatccactattacgaacaacaaagatgaaacgaaagtgtatatgtctttgggcttttactttgaatttagagagattatattttttaaaagtgtctttgatcacctttaattttgtagaacagacccagagtcaaattttcctgttgctgtgctgaaaaagtcatgttgcaataaaccttcacagaatcatcatattcactccatctgaaggaaagaaacaaaatcctgagtgaacccaactcaactatgaactacttttccagacaaaaaacaaaacaacacatttttatgtccttcaagctcagtatttttatatacctccctctaactttgttataaataattcatgtgatttttttttattattatactttaagttttagggtacatgtgcacattgtgcaggttagttacatatgtatacatgtgccatgctggtgcgctgcacccactaactcgtcatctagcattaggtatatctcccgatgctatcccgcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggcgtatatgtgccacattttcttaatccagtctaccatagatggacatttgggttggttccaagtctttgctattgtgaataatgccgcaataaacatacgtgtgcatgtgtctttatagcagcatgatttattctcctttgggtatatacccagtaataggatggctgggtcaaatggtatttctagttctagatccctgaggaattgccacactgacttccaccatggttgaactagtttacagtccccccaacagtgtaaaagtgttcctatttctccacgtcctccccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcataagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcacctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttatagtatagtttgaagtcaggtagtgtgatgcctccagctttgttcttttggcttaggattgacgtggcgatgcgggctccttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttgtctctctgtttgtctgttgttggtgtataagaatgcttgtgatttttatacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattctctctttttctattgattggaatagtttcagaaggaatggtaccagttcctccttgtacctctggtagaattcggctgtgaatccatctggtcctggactctttttgattggtaagctattgattattgccacaatttcagctcctgttattggtctattcagagattcaacttctacctggtttagtcttgggagagtgtatgtgtccaagaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatcaattttgttgaccctttcaaaaaaccagttcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaatttgggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttaagtgagattcttaatcctgagttctagtttgattgcactgtggtctgagagatagtttgttataatttccgttcttttacatttgctgaggagagctttacttcccagtatgtggtcaattttggaataggtgtggtgtggtgctgaaaaaaatgtatattctgttgatttggggtggagagttctgtagatgtctattaggtccgcctggtgcagagctgagttcaattcctgggtatccttgttgactttctgtctcgttgatctgtctaatgttgacagtggggtgttaaagtctcccattattaatgtgtgggagtctaagtctctttgtaggtcactcaggatttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggctgggtagatcttcctccacccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgctatgtgtgaatttgatcctgtcatgatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattctttcctttaagaatgttgaatattggcccccactctcttctggcttgtagggtttctgctgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtattttctgaatctgaacgttggcctgccttgctagattggggaagttctcctggataatatcctacagagtgttttccaacttggttccattctccccatcacttttaggtacaccaatcagacgtagatttggtcttttcacatagtcccatatttcttggaggctttgctcatttctttttattcttttttctctaaacttcccttctcgcttcatttcattcatttcatcttccattgctgataccctttcttccggttgatcacatcagctcctgaggcttctgcattcttcacgtagttctcgagccttggttttcagctccatcagctcctttaagcacttctctgtattggttattcttgttatacattcttctaaatttttttcaaagttttcaacttctttgcctttggtttgaatgtcctcccatagctcagagtaatttgatcgtctgaagccttcttctctcagcttgtcaaagtcattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagttctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctgtctgctttgtttacctaatcaagcctgggcaatggcgggcgcccctcccccagcctcactgccgctttgcagtttgatctcagactgctgtgctagcaatcagcgagactccgtgggcgtaggaccctccgagccaggtgcaggatataatctcgtggtgcgccgttttttaagcccgtcggaaaagcgcagtattcgggtgggagtgacccgattttccaggtgccgtccgtcacccctttctttgactcagaaagggaactccctgaccccttgcgcttcccaagtgaggcaatgcctcgccctgcttcggctcacgcacagtggacgcacccactgacctgcacccactgtctggcactccctagtgagatgaacccggtacctcagatggaaatgcagaaatcacccgtcttctgcgtcgctcacgctgggagctgtagaccagagctgttcctattcggccatcttggctcctcctcgaaaccaattcatgtgatttttttgtgtatggttttatgtccaaagtacacaattataaataagtccatctaagtaaatttttaaaatcatagtattagaattatacttaaaatgatttctaaccaaattatttcaaataattataaaatgatttttagagcatctctagtatgttaaaatcttgttttatttcattcctctttggaaatgctctggaagaaaaactaatgataaaggctgttctattattgttaaatatgcattcataatttcattttctctttctcctataaattcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctggagttgtgaattatatacaacttttaaagaatttaccccaattactcaaatttcccaggaaattacaaagccaaagaatattcaacttcctccactggtcaaaagaggataggagtgaattactgaacctagagctattttgctctgtaacaacagataaggctaatattttaaaagccacagtatacatcttcttttaactctgtagaatatgtaaaattttgatagtctgtagtatgctaaatgcagaagtataaataaagtcattcaaagggagtcttttctttttctgacacttagggggccacattaaggatgggtaatctttccaggaataaagtcaaaaggtatttattaagacatacttgagtatgcctgggtccaggagttttaaggaatagaaataagtattaatgaattaattaagtaatttattaaagggaatggtagctgaccacaggaaacttgcttactgttttgataggaaatatcatcacaagcttttcttaagacatctgatatcttccagagatattttttaggttgtcttgcaaacaacaaaatcactgtctttaataactgttgctgtcaaaatccattggttgttaagatccccccaatttagttacatctgaactcctaaacactgttaaacgatgggaaaaacaagaaaaaacatggccatttgagtcattgagtcatctatctttctaggaagatactttctaaccaaacttttcttccaggattgcaaattgatgggaaaaacaagaaaaactgaagtattagtcacctatctttctgggaagatactttccaactaattttttcttccaggattgcacactgattttccatttagtcctaaattttaaaattcccttttcaagacatcaacgattttagtagttatttaaaggcatgtcatttttcaatgaagaagttttgggcagaacttcattcttcttcttagatgtttactctagatcatatacatcatgtcatagaccaagaagagatatggaaattattttataagtgaatactataattaggattcaagctgagtttcagatcaacttgctcttaacaaaaggaaaaagaaatagtaatttaatactatgtatgtatggtttgaaaacaaaccacaatgtttataaaatatctatctgactgtctaaagaggtaatctttaggagcaaaaatcagtgtattataaatactttaccatttaatatcaaccaaaataccatctcaagctaattttgacactgaattacagatatatctgctacatattatttacttctaagcatgttgtctgatgtaattgcatttgcactgaaaaattaaaagaaaaagtacatatttagggttatttatatatcttcatctagacatctgttctacatttgtgtataaagtttttagcatcataatttttattcaagaaaatgttctgacaaaatt

SEQ ID NO: 728 - DNA, 59158 bp, Human
agaaatgaggaactgaagaaccccgtgatgttgttcttgaagtgtgacaatgtaatgaggcttattttatcacattggatcagaattcagttatcctaatgatcactgactcttgaaagaggttataggggattctgtacttgtatgcataaatcataaaccacttgaactagctttagaaaccatttaattggcgtccttttttcaaactatttaaagactcaaaccaaataaaaaaaataaggtattctaatgtcagtgccatggctttaagtaattttgaatttttttttagagtaactcttacaccactgaaagaaaagatagttcattactttaacaccccatttttgactcaaagagttcttagctggtttaaaccctttttctgttcttcaaagttaaatgtaagtgactcttgagtcgttaaatgaattaaagtcattctcgagtaatttttaaaaaacgctgttttttgaaagtttatgctttagtttctgaagaaaactttaaacaatgttttgctctgtgggaagtgactggagtaagtgcacagtcctcctagataagcaaggaataatacttattaagtgcctcatctatgtttgttaaaagatcaaccacagtaacataaatgtatctcaccatagaacttaagatttgagtactttaatgagctggcattacctttagagaccctcctagtccttactcagagaagagaaaaaaactttttcagttttagtcttagaaagttgtagagttaggccccattctgctactgcagtctacattttggttaagcctgtagccacctgtagcagctaaggagcaggtctatcgactatatacagagcagagactagaccacatgggcaaatcaaaaagaaaatagaaaatctaatgttagcttcgagaaaattgaatctctctctccaaaatgacttctaggccaggtgctgtggctcatacctgtaatcccagcactttgggaggccgagccaggaggattgctacagcctgggatttcaagaccagcctgggcaacatagcaagactacttctctaatagaaaaaaaaaaaaaaagccaggcatggtggtgcacacctgcagtcccagctactctggaggctgaggtggaaggatggcttgagcccaggatgttgaggctgcagtgaaccctgtttgtgcctctgcactccagcttggtgacagagtgagacattgtctcaaaatacaataaaacaaaatgacttctaaagacaacatggagaggagcatttaaaatgcagataggttggatcaaatcacttttcagttctctttcaatatgactgcaggctcaaaaaagtccttccaggccagtgattctgtttgaattatctgcttctctaattttcattttttaaatgttctgtatgcaaaaataaggtttttctgtactgcttatgccagctcattctatgaacctagtattggagccttttcttactgtgacatagttttttttattagtatagaatattgctgttttcaaatccaagaaaaatagaataaaaattgtgcacattagttattttatttttctaacattgtatggtttccagtgcttcaacccaatttttctgggactgattcgcttctcagaggattactttcgcttctatcttcacttctttttgcctgagctgttgctatttccctgcactgcaggatcaaagataagaagtgggaaaatccaaaagaaatactttctctaaatacagtaacacctgtaaacttttagtggggaaggatctgaagatataggctaaagtaaaactttaagaggaaagagtagctttctgaggttgttgctctcttctggtgtcagcacattaatcactctgacattcatcacttcaggcttctgtgtgtggcatcgttcattgggaatgcagtaaggatggcctttactgaccagcctacttcagttctacctggataagtcttttctttttcttttttctcagtaagtgctataaaagaactccctggggtgaagaagtatgaagtggtttatcctataagacttcatccactgcataaaagagaggccaaagagccagagcaacaggtacagcttttgatttatcaaaggatcttgatttgagatacatatatacacacatatatatatctatctatgatgagagatagatatgggatttatacatgtatgtttatatatgtgtgtgtgtgtatgtgtgtgcctgtgtgtttcaagtggaatttgtgatgttttcagcaattacaccttggagttaaataacaatgattatatttgtatttgtttttgaccttttaaaaaatcttcactataacccaaagttatattattaacctcattctacaaatcaagtttctgagaagtgaaagaaactgtccaaggttaaaaagagtaaatttgttttttgttttttgtttttttttccagacagagtctcgctctgtcgcccaggctggagtgcagtggtgtgatcttggctcactgcaagctccgcctcccaggttcacgccattctccgcctcagcctcccgagtagctgggactgcaggcgcccgccaccacgctcggctaatttttttgtatttttagttgagacggggtttcactgtgttagccaggatgttttctatctcctgaccttgtgatccgcccgcctcggcctcccaaagtgctgggattacaggcgtgagctaccgcctagccataaatttaacattttatgatgatttattctacgtacttccaaaagaaaattggatgctatctctctatctatccatccttccaaacacaactatgacaattgaaacagaaacagaaaacaaaatacagcaggtgaatgcatgtatatatgcacattaacatgaaatttacctgtcttttctgaataggctcttcttaatgtttgtacgtttcttactgcaaatgaaacaacatattctcagtcaacatttactcaataaacatttattaattctaagagaaaagctaaaacatgatgattcattcaattataacaatgttataattacctgcactcttaagtcttcttctgggagccagcaagatacagataaatgagacacaaataatagtttacagaaatactctgaaatccagcacactcggtgcacatattccctcactggacacggtttcccatagcatttcttctaaagcaaatttatgaaaacagaacctgtatttgaccccatttcccaaaataattatcaaccaagtggtttcactaacttcagatggaacccaaaagcataggattccccttcaatatgactttcttcaaatgctctctaagactttctttaaaatgtcagacaccttttttcctgttgtgcattatgcttattatctgggtgacaaagtaatctgtacaccaaacccccatgacatgcgatttacctgtataacaaactggcacaggtatcccctgaatctaaaataaaagttggaaaaaaaaataaggatttttaatatattttcatatttagtcctttcaacaaacatataacttaagtgtatttttacagtattttatttctaagtggagagataggggctcagaaaatttaagtaccctgcctaggagcacatagcttatacgttttctagctaggattcaaacctctgtttgactccaaatgacaactttatgtgttagtattatttgtggctgcctatccaagcagctaaattgatttaatatatgggagagtccatatgttctcctgagagcctctgtgggatcaacacaggctttctggccattaaggtagctcaagttctgttacactaaagtctaagagtcagtctgtaaccctgagacactgaccagtttgttgtatcgtttactgttaaaaataagagactcatcagctgaattttttttctaataactttttgtctttttgaaaattctattttaagttctgggatacatgtgcagaatgtgcaggtttgttacatagataaacgtgtgccatggtggtttgctgcacctatcaacccatcacctaggttttaagcccagcatgcattagctatttttcctgatgttctcccttgccccgccgcctaccactcctcagagtgtgttgttcccctgcctgtgtccacgtgttctcattgttcagctctgaattataagtgagaacatgtggtgtttggttttctgttcctgtgtaagttcactgtggataacggcttccagctccatccatgtgcctgcaaaggacatgatcctgttcctttttatggttgcatagtattccatggtgtatatgtaccacatttcctttatccagtctctcactcatgggcatttgggttgattccacgtcactgctactgtgaatagtgccgcaatgaacatgtgcatgcatgtatctttgtaatagaatgatttatattccattgggtatatacccagtaatgggattgctgggttaaatggtatttctggttctaggtctttgaggaattgccacaccgtcttccacaacggttgaactaaattacgttcccaccaacagtgtaaacgcattcctatttctccacagccttgccagcatctattgtttcttgactttttaataatcaccattctgactggtgtgagatggtatctcattgtggttttgatttgcatttctctaatcatcagtgatgttgagcttttttcatgtttgttggctgcatgaatgtcttcttttgagaagtgtctgttcatgtcctttgtccacttttttttaaaaattataccttaagttctagggtacatgtgcacaacgtgcaggtttgttacatatatatacatgtgccatgttggtgtgctacacccattaactcatcatttacattaggtatatctcctaatgctatccctcccccctcccccctccccacaacaagccacagtgtgtgatgttccccatcctgtgtccatgtgttctcattgttcagggttgtttgtttttcttataaatttaagttccttgtagattctgcatatttgacctttgtcagatcaatagattgtaaaaattttctctcattctgtaggttgtctgttcactctgatgatagtttattttgctgtatagaagctctttagttttattagatcccgtttgtcaatttttgcttttgttgcaattgcttttgatgatttgtcatgaaatttttgcctgtgcttatgtcctgaatggtattgcctagattttcttctagggtttttatagtttttgggtttacatttgagtttttaatctatcttgagttaatttttgtataaggtggaacaaaggggtccagtttcaattttctgcatgtggctagccagttctcccagtaccatttattaaatatgaaatctttttcccattgcttgtttttgtaaggtttgtcaaagatcagaggattatagatgtgtggtcttatttctgacctctctatccatttccattggtctatgtgtctgttttgtaccagtaccatgctgttttgtttactacagccttgtaatacaccttgaagtccggtagtataatgcctccagctttgttctttttgcttaagattgtcttggctatacaggctcttttgtggtttcatatgaattttaaagtaatttttttctaattctgtgaaagatgtcaatggtagtttaatgggaatagcactgattctataaattactgtgggcagtatggctattttcacagtattgattcttcatatccatgaacatggaatgtttttccatttgtttgtgtcctttctgatttccttaagcagtggtttgtgttctccttgaagaggtccttcacttcccttgttagccatcagctgaaattttacaagttcacctgtatcttctttgttatcaaccttttgctactaaaccaatgattaattgtgtccttgtggaaatttacactaattatctactctttatgtgtttttttctcacagtaaacaatgcttccaagaaaacccaacatttacacacacacacacatgcacgtgcacaccaaacacccttttttcactgaacattttgaggaaaatttaaacacaagtgaagtgtttttaatcacagctgtgaagtgatttcctcacgactgtaaaaaataaatttgagttttgaatatatattttgattaacgaaagccatagactagttactggctcatactagatgaacaatattaatttttgcaatgattgactaggtggatgaggttgatataatgtgcttgatatttactgcagttatattatttatctagtccattactaggttaaatggctacatgaaccttacattttcctgatccatagtgcaagtatataggagctgaattcagaggattagtttgtgttcacctgtaaattttgtccattctctctgtataaatttagacaaacataaaccttacgtttcttgtcttaaagtggagatgatcataatacttgtataaatatttggggataatgtatatgaaaagcaaggaaggatccaaattttaactccctattcaagattatgctatgggctgggtgcattggctcacacctgtaatcccagcactttgggagattgaggcgggtgggtcacctgaggtcaggggttcaagaccaacctggccaaggttgtgaaacctgtctctatcaaaaatacaaaaaattagctgggtgtggtggtgggtacctctaatcccaactactaaggaggctgaggcaggagaatcattggaaacctctaatcccaactactaaggaggctgaggcaggagaatcattggaacctgggaggcagaggttgcagtgagctgagatcacgtcatttgcactccaacctgggcaacaagagtgaaactccttctcaaaaaaaaaaaaaaatagattatgctatggtgctgccctgtgtagcccatcatattccagttcttatgactaattttcagtttttgtggcttcatgtcccagttaataaacctttattttaaaattcttcttttcgacataaattatcaacttcaggttgcttttcttaataatattcttgtttctacttctatgttttttttaatggatttcttgctacttaaaatattctctctacatttagagtccctcccatttaggggactctatatttagagtctcttatagtctttgttaagctgacttgccatattcatatatacactaatatatccctatcctgaaatcgtgcgtcagtcacagtcagtattataaagtttagctactgattttaaaaagaaatgttgattttgtgtcaggagcgatggtgtgttcacaagtgtgtgtatgtgtgtgtgtgcatgtgtttctatgagagcaagtgtaaccttcacttctggtttgaaactgtccaggtaaatttttaagaggtttcttttttttttttttttttttttttttaaaatatgtctttgctatgtctctactcctccttcaccctcacctgccaatccttgtcctggaacataaatacttgtttcattaatacatgttggtctaaataaatacttgcaaagcacattaattttatctttaaaggaaataagagtattaaataaacaccatagataattgaagaaaaaattacctaaacaattagaaccttttaatgttcctttaaatggaaaatcttttatttttttagtttcatctattacatttccaagttctctcctgctccctttggttgaagagtgtagaagagaatatattatgaggcctgatgaatataatggaatgagcactgaatgcttccacagcatctcagaaataaatataactctcccatgtttactttttaatatctcaggtgtcaggtgacacctttgaattaccccacaataaccatgtggctaaaccattagcagtaagttttgccagggtttaattccagctgttcacagggagatatcaaaaaccgcatgacagggttgccagatgaaatacagagtaccagttaagtttgaatttcagacaaacagtaaaacttttttgtataaatatgtcccacaccactttgggaggccgaggcgggtggatgacgaggtcaggagttaagagactagtccgaccaacatggtgaaaccctgtctctactaaaaatacacacacacaaattagctgggtgtggtggtgcgcacctgtaacaccagcttctcaggaggctgaggcaggagaatcacttgaaccctgggaggcagaggtggcagtgagctgagatcatgccactgcactccagcctgggtgacagagtgagactccatctcaaatacaaataaataaataaatatatatatatatatatatatttaaaaatatatatatatatgttccacacaacacttctgatataattataaagaagcattccaacagaatgaatctaattttcccagctagtgcatttgcatctcttttccttagtcgctgatctctagtttctattctttcccacatcttctaaactcctccatgtgcaggattgtcacatttagcaaacagaaatataggatgcccagttaaatttcaaataaacaacaaatatttcattagtatgtcaccatggtcatagggggcatatgtattttaaaaagtattgtgtgtttttatgtataaacaaaaaaatattctctgtttatctgagattcacatttaattggcatcctgtattttatctggcaatcctatcctgtggcttttgatatcaccctgtgagcatccagaactaagccctagcaatctgtccatgattccagattctgtcctatccacagatctaaggttcctaatgctgctgcatgcctcatatctcactcctgccctgttagggttcttgggttctgccatatcacagttgttttacaaacatagactgaagaagctagtgacatctttgtttgccacacaacaaatacatgatttccattggcatagactcttctatagtctctcaggcacaccttatgactaataagaacactgtcttctagatataagccaagttttaggagttatctttgtagtttctgtgttgagactatgggtcttccctgtgcaaagacttgattagcaaatactatttgaaacgatcccaaattcatagtgcagttgaccacccttctgatcaaggggatctctgtatatcccatgaaagcttcataggtctcaccctagattaagtgcttcacttctcaagacagtgaacagatggaagacttttgtagttatcattatacaactgtgccctgtgttgttttattatacaaccagagaactgaggcactggctttacctgtcagctacgccagggttgtgacgtcatctttctgacttgatcacacatgccacattgcttaatatttcagctagactgaaataatcctgtgtaaaaatttttgggggctgggagtaaagaacaaggtggaactttgaatattttattcataatcatattcacgattgtatttatatgaatgacataaggactaaataagtatgtgttaaataaatgaccaaatgagtaagtaaactaatggacaaatgaataaatgtttatgactggagcatattacccataaacctccatagatgcatatttaacctatactctgtgaaagtccctgatgctgggaacttaaattctaaagacagtaactattcttcagagaattcagcatccagattgtacatgttcttagaggcccaaaccatcttggtattggcccatgtcgtaaaagaaaatatcttacagcacaattcctccctcagattgagaattctttcaggcccattagctgatttagcagggtttctagagctcacggatttactgtaagttttgaacaactgttgtattactagaattaagaacctctctgtgtattctacggctgcccttgatatttcctgtgtgcccattgacatcccctagaccttacagatttgctccatcccagaaacatccaggactgtggctttcccaatccacccactaaatcagacccatgtcattattttagaggaaatttggatctatatgtttctgtggtcagctagtcttactcagtaaaaccaaaatcatttccttatagtgagtgctctccaaatcaaggtgcatcttacttctcttgatgcatacttcagaacctacagagtacacaactagaacacacttcttatcctcaaaccttgctctccaccagggaactctctttcaaaagtattattattacattacccagtgtactctctttcatagaggccctggctttcttccttcatctttccttccatccataatctttatgccagtgttaaccaaaactccactccaaaagcatttattcttttctaaaacaaccttcagctaaagttttagtaactaaatctactaaaaagccattgctgaacaggaagcagatatctggaaggccatttctggtagaagaccatatttggtatcattctcatggcttcattctagctaggctttcttaatcctgaacagtaagaggttatgactattctgcataacttttattttcaatgccctttctctttccagttcctgtcatccatgaaaataagctgagtccatcaacctctacttatctaggcccacatttgggggaaatttatagcctgggattactgacagcagagcagacctcaacaactgaggatttaagcaaagtatggactgtaagaattgactttggagagggctaaatcccagcacggtgctcatgatctgatgattctaacatgccttgtctgtctgtgagctcagataccataccggccagaaggggagggagagaaggaaggcttgagcttaggtgcaccacagcagaagaaacagaactcagtccataatatgtgtttctcaacaacctttggtctaccatatttagatatctttaatgacaataacgaggcacttcctaataactttttagatattgagtgcaaccacagccaataaccctgttttatagaccaaagtcagaacttagtaccccaaaacatcttctttaaaataattctgtgtagtcctcaatagctctccttatataccaatatccaagtttaaaataattttccttttacatggtttacccgaggtaatatttcttccttcttaaatacctgggactgtggtttcttcttgatggttcttcctcacattacagtatacattcctgttatgtttctcatagtttatgttccagttagtcttgagaagacttcaagaccaaaaatcatgagatgtgatagaagtttttaggcgtctgtgtacactattccttctaatcagttaacttcccttactcacttcacctgggtaatttatgtgtcgttttaaacattacttcctcaaaaaagcctttcctggctttaagatgtgagacatcctactatatacatccattatcatgcacataactcacctcattgtctgtcttttcacaagatcataagctctctgacagtacgtaccaatttttcttgcttagagtagaattttcaaaaccaagcagtatcttgcaaagaaacagcactcactcaaacgatactttaaaatgcagggatggatggatggaaggatggttggaagggtggatggataaaaggctctcagataatttgtttatttagttgccagagttgtttgatctgtcaagaggggaagaggcaagtatttggtattatactgctaaaaaatagatattgcttgctaatgactacacagatagaaatataatagtcaaatgaatatgtttttaattacaagtaaatgtttgtgtatttttgcaggaacaatttgaaactgaattaaagtataaaatgacaattaatggaaaaattgcagtgctttatttgaaaaaaaacaagtaagtatctttacctgtgatattatcctcagcaagagcaaggcagcctatggagagtgtgctgagtctgttgctgcttatggctcacacaaacctggactaatcagcgtttgctctcaaatgacttgagaatttccatggacttagcaatcagcacaagtaaccacaacatttttgtgtttctttctccaggaacctccttgcaccaggctacacggaaacatattataattccactggaaaggagatcaccacaagcccacaaattatggtataacggagtctcttcaattctttaattagggttttacccacagacctaaaggtagtgtccttgccaggcaaataatagaagtgaaactgcatttgtaacattagtgcttttttcagcagtagccattacttaaaatataaaaaaaagaaaagtggaaaatcaattaacaagaacaaaacaatttcttggcaactccggtaagtttttccagcctttaaggacccctgtaggagggtgggtagaaggagcatgttattttcttgagagtgaagagttacatacctctggtgttctcaatcaatttctatcatttctctggatttgtggtctcttcagccaagactatttcctcaatggcaattgcagaattgcttttcttaaacaatttctctttactgctattcatagcccatcttttcttagactgagcagatgacagtgtgtagccatgtgaggggtcatgcaccattacctctttttctgagctccattttccatgggaagcccttcaagcattgttctctgtagcaataatatcagagtttacatgggtcaacacctcatctgtcccgaactagaaaggtccttcatggaacacccacacgaaaaaatgttaagaagggcattttgctccaaatggaggcaagaaatgtgctgatccagttaatctgatggaacgcttttgataaatcaagaaagaaaaaacaaaaacccaatctaaataacctatcctttggaaaaaagcttgtagatctttgctagaaagaagttaatgagaaaatggccaaaaggaaaaatgagtgtccagtgttttaggagctcaggttttaaactgacatatccaagtttattccatctaagtattattgacattcatcctacttagtcaacattgacagttaataccttgtaaacattttgggatcattaactgacattaacaattttaacttacatgaaagattttaattattttttaaacatcttagtttactgttgtacagcagaatattgtttgaaagcatttaaaatcctgtttcaagatttcagatgcggctttagcagcggtgctaaaattcacatgtacttctctttacaaaaccccttttcctttaggatgattgttattatcaaggacatattcttaatgaaaaggtttctgacgctagcatcagcacatgtaggggtctaaggtaagacttcaggaatgttttgcatgtacctgtgattgtggtatttatgtatgtatctaaccaaccagatgaatcccaaatatcattaatttttatatagttgaatataaatcataagggccataacattttgaaatttgaagaaacaccgcttctcttgatagtggcttgtaaattacatatccgaattgctttcaaatatatttttgttagtttagttttaaaatacaggattttgaatcccagttctggagtcagaatctttaggtaatgggagctgctctctcttctcgctcttcactttattttactcattgatttagatggagtcttgctctgtcaccaggctggagtatagtggtgcgatttcagctcactgcaatctcagtctcctgggttcaagtgattctcctacctcagcctctcgagtagctgggattacagatgcccgccaccacacctggctaggttttgtatttttaatagaaacagaatttcaccatattggccaggttggtctcgaactcctgacctcaagtagtctgcccgcctcagcctcccaaagtgctggaattacaggcatgagccaccacccccagactctctccccactttaagctctcactcgctctctctctagattgccttatccatgactatgacataccattctgtctgttaatgatatactatgcatctgtctatatatagtaatctatagtaaggtggctcttctgatgtccagacttgattatctaattttctttttcatattttcagttggatatcttaaagaaacctcaatctcagtatgccttaaaccaaactaatgattgtcttttgaatctggtatggtttccatgttctttattttaatcaatggtataattagataatcacttgcccaattcagaaacctaaattccttgaggtctgcttgcccctcagccctgcattttcaatcccttaccaagtcttattgattctatcttctaaacactttctgaaattgttcattctgtctctactacgatatcctagtccatctaccatgattccttatgcagaccattgcaataaaccccataatttatcttcttatatccactcttgccattatctaattttatgtacatttaattcagtctgtctattatatctcttgtactttttcttcacatcaattattataattatatataagtacttactatataattatatatattctgtgattatttgatacacatccattttcctcatttgaacataagctccataagaaaagagaccatgtctttatttttgctgtctacccttagtccaatgcctaatgaataatgggtactcaatgaatattggttgaatgaaccctggttcaaggctttagcagagaaaattgagaagaaattgataatatttatttgtcatgtgctttacatgttctctcattcaatctttactatcactatattaggtaggtattaagacaaataaatgtggagaacctgaggcttgtgagtttaaagaattttccaaatgtatcacagtgaatgagttataaagccagtatattaacacttatctataaaactctaaaatccttttcattataagtgtacctttagaacaagtatagcattaaaattggaagaatgctgtaccaagtgtcaggaaatattcattctagtgccagaactgatatggttgcttgtacaacactgcagcagtcacttctccttaatatgtcttatttccttgtagaaaataagtttagataatcttcaaggtatcttcagctgtaagttttactgtattttattgccatgagcttaaattgtttttgacattgactaggaattttaaaggtcctcttttggatcttataaatctgtatgaacctaatgcaacaatatttgttaagaagccagaactctcatgttttttcaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtagtatgtgtaactttatttatttgaaatgctctcatgtattctgccctggtttccagaattagcagtgcaatttactgaaactatagtcattgtcaaaattagtaagttatagagacactaatccttaaatattgctagacattaatgattcatttaacaagtacttaggaatcaactattttttttttttttttgagatggagtttcactcttgttgcctgggctgtagtgcaatggtgtgatcttggcccatcacatcttccacctcccaggttcgagtgattctcctgtctcagcctcctgagtagctgggattataggcatgtgccaccatgcccagctaattttgtatttttagtagagacagggtttcaccatgttggtcaggctggtctccaactcccgacctcgggtgatccacctgtctcagcctcccaaagtgctgagattacaggcatgagccaccgcacttagccggaatcaactattattttcagcaatgtacaaaggttaaaaataagtgtaaaatataactgccctctagaagcaggaatctgtcacactattccctgtagcctacaataaaccacaaagatataaagtattattattaatttactcttgattttagccaaaaagctatgaagtgattattattattttgaaatatcttgctgtcatcataaattcattcaacaaatctctcttaaagtgctgtcacaggtgctgggaagatagaaatgagcaaaatagacatagaatctggctacaggaacttagaatattattttatgtgtggaattctgcttctagtcataggagataaatgaatatagttttgtgttttagactgtatatatcaaaatatctttgttgaccttacttttatttcttattgatactgcttttatttccaagatttatttcaaatccaatcatttcttttaaatgttctcagagtctgtgagcaaagggtataattggtctaaataaaatttctagtcagtttaattttctgtaggtttaaattctaccagcaagttcagtagtaaaggtaaatgtatagtcaaacccagaatactccaatattttaagtgctctgtagatcacatatatctctagtatgacacttaaaaatcaaatgagtaaaaaataatgatgcccataataatttgttaagaaatatataatataaaatatgtatattgtgacattaaaagtataaattgtcagggggaagataaaagtctagagtttttatacatgactgaagttaagttgttattggtgtaagatactccattacaactataagatgttttatgtaaacctcacggtaaatacaaaaaaaaaaaaaactatagcagatacaaatgataatgagaaaagaataaaaatgcagcactacagaaaaatgaccaaatcacaaagataaacaagggaggaagaaatgaaaaagaaatctataaaacaaaatggcagtaggagatccttacctataaataattactaggaatgtaaatggattaaattttccaatcaaaagataaagagtggctgaatggctgaaaaaacaagatctgactatatgctgcctccaagagacatttttaagctttaaagacatgcataggctgaaagaaaaagatggaagaacatattccatgcaaatggtaacaaaatagacaaactcttaggcagactaagaggaaaactcaaatatataaaatcagaaatgaaagtggagatattacaaaagatgtctcagaaatgaaaaaaagatcttaaaggactaatatgaaaaattatttgtcaataaatttgatagcctagagaaaatagatgaattcctagaaaaatacaacctataaaggttgaatcagaaagaagtagaaagcctgaacagaccaataacaaagagattgaaatagtaattaaaaatctttcaacaaagaaagcctaggactagatggctctagagctgaaaagtatcaaacattcaaagaagaattattaccaatactttttaaaattttcaaaaaaatagagacagaaggtgtactgcttagtacttgttacaagcccagcattacctttatacctaacccaagacaaagacgccaaagaaaggaaaactacaggccaataattctgacaaacactgaggtaaaaattttcaataaaatattagcaaatcaaattcaacaacacatccaaaagattatacatcataatcaaatgggacttatccttggtatactgacttaacctacacaaattgatcaatgtagtatatcaattatatcaacagactgaaagacaaaaaatacatgatcatatcaattggtgaaaaggcattaaacaaagtttaacatgctttcttgattaaaagtttaggtagttaaataatggtgtggagttaatggttcttgatttgagagtttaggcatagaagaaaagttcctcaacatcataaaggccatttatttatttatttatttatttatttatttatattttttagcagtcaaatataccttattttattctcataaaatgctacaaattatcttgatttaggatatttgtaaacattctatagcagctaggaacatgtttttccaaaaccaaataaagttttttacatgccagttacatttcagagattttgtcattcttatattcttctttcttcataaaagtaagtgcttgctcaaatatgtgggccttctactgaaattcatttaatatataacttttatccttggcttagttggaattcgagttttgataagaaaggtgtggttgaatggacataatcataggctttcagcaaccacacaaatgttgatagtgtgcaatgcagttgttgatgattaaacaataatgaaaatttaagaacactgttgcattattttatttgaagctggaatgatgtgaaactctaaaatatgtctcagcccaagcattaaggtttacctgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatcaaaagcatttagaaaagacacattcaacttggaaatgaagaagtaaaattacctctatttgcagatgaaatgattctacctgtaaaaaaccctaatgactccactgaaaaaccattaacactaacaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaatgaaggaaattgaagaaaatgcaaataaatgaatatcccatgctcatgaattagaagaatgttgttaaaatgttcatactacctaaagcaatgagtagattcaatgcagtccttataaaaaccccaatgacagtatttacagaaatcagaaaaaaatcataaaatttgtatggaaccacagaatatcccaaatagtcaaaggaattctgagaaaaaaaaagacatcatactacctgatttaaagttatattacaaagatatagtaatcgaaagagtataatggcataaaaccagacacctagaccagtggatgagaatagcaatctcggaaataaatccaaacatatacgttcaattaatttttgacaagggcaccaaaaagacacactggggaaaggatagtctcttcaataaatagtgctgggaaaactggatatccacatgcaaaattatgaaatcgaacccttttcttataccataactaaaattcaaatcaaaatgaaaaagaaacctaaatgtaatacctaaaaccataaaactcctaaaagaaaatagaggggaaaagctgtttgacattaaccttgacaatgacttcttaaatatcatacctaaaagctaaggttataaaagtaaaatgtaagagactatatcaaacgaaaaagcttctgcacagcaaagcaaacaaacaaaatgaaaaggaatctaaaaaagggggtgagggtgagtgtcaaatatatagaggtagagaataaaacagtggttaccagggtctaggtagggacaggaaatggggagattcgggtctaaggataccaagtagccaaatatgcggggttaagcagttgaaagatctagggtacaatatgaggactgttaaggacaaaaagtagacaaatttaacagagtttaattgagcaaagaaaggtttgagaatccagcagccctcagaaccagaagatgttgagagcaattccatgctggtcgttggttggagaggatttatagacagaaaaatgacatacagaaaaatggattaaggtacagaaacagctgcaccggttacagcttgatgtttgccttacttgaacacggtttgaacagttggccacctttgattggccagaagttggtgaaactcctagctatatgttgctgtgaatatcaactcctgggtttgcttgtacagggcctcttatccctctgtttccattccttggtaactacgtggaaagagctttgcttttgagacattttatcgttttggctttcctctacctcaggagtgctactcctcatttcatttctgtcacccttactctgattgactggtaaatattagagaacctcacatagctcaatcctggatctttatctatacattcttcctaggtaatcttaccctgccctgtgccttatttaaataggaactgtgcactaatggccatcagacgtttatctctagcctctgcccctctcctaaaggccagactgttataattatctttttaatatatctactcaaacacctgatatcacaaacctaaaatatgcccccaaaagaactaccaatttctaaaccacaaacaaaacctacttctctctcattctccccattttacttaacactaccaccactcatcatttgttcaaatttggatctagaaattatccttgattctctttttcttcatcccgccttatatggtatccatcagcaagtgcctccgacatatttcagatcttttactttgctcccttttctgactaccccaaggtgccatctcataataaccatggcaacagcctctgcctgacctgcccatcctcgttcagcagaatccacactccacacaatcaatccagtgctatttttattgtaaatcacatcacatccgttttctgctcaaagccctccgatgtcttcccattgcatttagtataaaagccacacaactgaccatgggtcacaaacccctatacgattgtggtcccatagacctctctggtctcctcctactctttactccccgtctcttggtgacctcccccattatgttataaaaacacaagcactttttttctatgctctaaatatgccaatactatttcaccttggagtctatttactcattttttttccctgctggaattgtcttccaatttctctttccttgcctggcttctcattttcgttaatacatctgcttgagggccagctctttagagaatttcacctattctgaaataactacctagtaactcaatgtcacatgcccactttaatccttcacatagtactggccaccatctgatatgtttatgtttgtctcttggtctctctgctgatggagctcacatggtgatttcactactgcatttgcagttcccagagcactctcagtgtattgtaagtgctaataaatatttcgttcccatggagggtaggaagtaagtacatgtctcatcagataatacctaaaaatctatcttcaggagtttcttctttgtaatcgaactttagttacctattaaaagacatgcacttccagaaatgcaatctaataaactttgatgagctattatttagtaggaataatctgttggtcccttttcaatgagtcaatccactatgtaactttttttttttttgagatagagaaaggaacagaacattggtaagtttgaaacatgggaaggagattcaactctgcctgaagagaacaaagtagactagaaacaatggtgtctctgcattgcaccattgataacggagcatgtatttcaccaggatatgaattaaaggctaccaaagaaaacaaaaaaacaaactgactaaaaacactaggaggatgctgaagtcaaactttctctattttgtgtcaggatggtgaagaagtctactgttcaaaacaatagaaagactggttttatttctagctcccctattgtaacataatttagaccccttgataaaaggaaggaatcagaccagaatattgctggtgtcccttcacctccaaatttatgagccttgtcagtagataatcctgtcggttgaattggtgttaaaatgctaatattgtctgcctttactccagatatcaaccaactgcttataaaattacagatgtcaaataatagaagaacttttgcagaaaacaatattgtatcagtaattctactctttatatttcagaaattgaaagacaggaaggttcaggaacatgagaaatacatagaatattatttggtcctggataatggtgaggtaattatatgagataaatgtgctgtcttccaaaactcccacccacatatatttatttattatgtgagacattaaatatctggatgagatttaaagaatcatgaatatgagctatggttacatgttcttctaaaactatgaaatttgacatttataattaagctgatatgacttcttttcagagcgatcagggcaattgatatgatatgcataaattgttggcacttataacactattttcttattgacttaagagtacccaacttagtttccaattacattcttctgtcattttgtcttttgttaagttgttaaatcatttgtaaattaaactttattctcattagggagtcaatacaaaagcttaattggtcacaatgaaagcttagtgaatggaatcctctgaaaaggcaaatctttggtaatagtcactgtttatcttctactgtaagaatgcattttcatatactgtgttttcaaaatttaaaatgcacatgtgtatgaaaatataagtcaaccattagctcaggccctaaagctttggtcttacttactgtgcttaattcatgtactgttcatgtatgtgtctcttaaattaataagatattccttctgttaattctgcacaccttagaaaaccatagaatttaagtgaaaatacatttggagtaattctttagagctttatactgagctagtacttcagaagagaaaacatcatattcactcccaaagtgctttaatgtagctagatgaataggaattaatttgattctaacttttaattaaatctaataactaatctttaattaaaatcaataataagtaatataagagaagatgcctttttaaccttccaagtatattcatttttatcaatgcccatattctttcttaatttttcttttagtttaaaaggtacaatgagaatcaagatgagatcagaaagagggtatttgagatggctaattatgtcaacatggtaagacatattttattacctgcagttttaaacagtttgctgggagatgtcactgggtttttcaatgaacgcacatgaagcatggaagcaaagtcaagacatttgagaccaatgtggctgactggctcccaaaggatgaccacaacttttgctacataggtgaacatgaatattaataccacaaaccaacacttttcttatttacctgccacagtattctcaggtataagaagacataaaagctacatgggtgcattgtattttccaaaaatccgctaagaaaatgctgaagaccaaatcccaacagaaagctggtccagaggggaaaaaaataattttaaacataccaagcactgtcacagtagcatatttcataaaatctcatgtaatacccagaacaacgctaaatgttactaaagcctaatgcatagctaaggaatcatattctcagaaacaaagaacttacccaagatcacaaagtgagaaaagaatagccatggggtttgaatacagatttgtcagatttccaaacccatttgagtcatgcaactattgactatgttctttagacatgattgtgttatctaatttccaaaatatttaaaaaatggttttacagtctttaaatactacttcttagttttctgtttgttggatatatagttggcatacttattttgaaatgaatgagtctctttgtggtatcctataaatgctctaaagataattttttgttgttgtacaacataatgctgtaatatacttcttttgatatgcatatacatagtgaagtgattaccacagtcaatatatatgaaataaaaaagtaatacatttcctttttatgctgatgggaattatttgtggagggctaaacattgataatgcaggaaagacagaagaattattggaataatcttgattgggggagaaataagagatttagtgcatgagtggagaaactggccttagactcagagattgttcatttatatagcagatggggaggcgcaaggtgtttggacaagactaggtgaggcgataagccaatggtgggagcttgtggacgttctcttcagattgctcttatagtctcagcgaatgtggaagcaaggacagttgtgaaagtcggattcaaaggaaatgttagaattactaagaagaggagcataaaaaatgtgtgcagaaaactgcgtgtgaatggaatttggaaatacagcagttttgctggaacgcgttaaggactgcttgagcttagtcacagctttaaagtgagagcaatcagaacaatgtgttttcccctgtgttcaagggcagaaggaagagagatgtagaggcaagttgcttttaaccaggattggagttttgtcaggtgagtaaaattaagcaagaaaggaacaaggaagttgaggaaataatccagtgaaggatgataacatggctggattttaacttcactttcagtaactgcattccttaatgcttttcctgttttccaaactaccttttttttaaaagaaatatttaagtttcttagcagaaagttgctggtgagaatgtctgtcactgtgcacttttagaaactatagtagtaatttaagcttttatctttagagtaagcatattgtttcataagtttaagtcattatttctaaagtttatcctatatgcattgtggattatttggttcaatccatgtttaagattagaggaccattgtctcattctgaaaatacataatatgggtggctcataaatgacagcaatttattgctcacagttctgggggcttggaagtccaaatcaagttccatcaagatttggtttctggtgaagattgtcttcctggcttggagacagctgccttctcactgtgcctttatatggtagaaagaacaaagcaattctctggggatctctttaagggcactaatctcattcatgagggctccactctcgtgacctaatcacctcccaaaggccccacctcctaacaccaccaccttgggagttaggatttcaacacatgaattttgggggacacaaacattcaaactatagcgactacttagcttattgtaaatgcatcaatgtacaacatttcatcatatcaagttacttctttcatgcctaaaccagcaccaagccaactttgctaattctgaaatattctcactctgagagcactgaaaaacatataagcaattgaagccatagtaatgggccactgacacaaaattatagtatttcttaagagcataaacaggaatatgttgtcttaacagggccttttctcctccctaccaccccccacccaaaaaagaagtttacggacctaaactatcttagtgtatttatcttttgttttgaatgggagttttagtgtctacaaaatagtcaatacattctgtttcacaaatatgcttggaaataaggtttttatactgctgtgatgaatgtttaaaaatacaaaatatattgaaaatgtttaaaatgatatcaccattataattaattgctttgccatttattttctttggacagctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacgtatgtacagattttctcccattgcacactatgtggtatttagtggatgcttttctgagccttggcaaagtgaggggtgcacatagaggggtagacatttatagagcacttacttggattatatgtcaaatatgctcttattttggatccaagtattttttttaaaaaaagagagggtcaataatttggcaataatttataaaatgtttgtttttattgggtatacaagaagaaaagacaagtttatataatggaaagagagtttttgattcagtgtttaaaaaaacaactgattggctttaggctcaagttagaagaaacatctaagatattattagaaaaattaagtattatattctaactccacatcttcactaatttatttcccactgaaatgacctgttaagaacaacaggggaaataaatctgatggctgtaaattatatgagactggagcatgtgcctcaaaacattcaagaaaatgctgctgggtagatggataatatttagttgaaatcagatagaaggaagcagtaaggattgacttgaagttactggagaggctattacctaagaaaaccatgaatttcatggaaatcagtgaactatgtcctgccagaattagttaatgtttctgtgctggtcatctgttaactgcataacaaatgagcttgaatttctgggcttgaaataaggcttcttcacttacataattggtgtgtgggctcatctggctggaacagtgagtctggttggtcatgtttctgtctatatcccctttcatgtgcctaacttgagtttccttcaatatggctatcttagagtaggtggacttcttactaggtgtctagcttttctcagaataagcatttcaagaggcatgagataatgcatcaaggttttttatgacctaactacaaaagtcacagggtgtcactactggtatattatcttaatcaaggggaagttgtagggccagtccagattcaaggggaaggcactactcaggctgagaatactgcaaggctggttcattgagggggtcacctttgggaagcagccgacacaatttcttaatttggaaaggtgagttttagactcgagagcccattctttgtggaggagtttagtggttttctaaggtctcatagctggtaagtaataagggagccagacaaattgctgaatactccatcactgtaagtaataacgtagaagcttaaaaataatagacgagatgataaatgtataggtaaaaataaatgacgatacaatgtcaagaacagattccttgaagagatcagaataaagatacgatgaaaggaaatagttgttcttccagttatgcaattaatgtcttaccatttaccaaacaagttaacaaaagagacctatacttaggtataagtaggttaaaaaaattagagtccgaatatactgtttacttaaaagataaaccaaaatatataactccaaaatgaacgaaatgttattttttgcaaatgagcaagtggggagaactgaaaccacaaaaatgtagaatgaagtataaataactttgtgatataattttaaaagagaacaggtatcataaaccttttaagtatgcataatgtaaaatatattttcaaaataaatatctgaaatcagattaaatagataaaatctgcagggaatgaaaaattggaacgttttctaattttctcattttatacagcagaattaaaactctctatttttagtattgttttatggtaaaatacaggttcaatttcccacgtaagtgcatctactaaggaaattaaaaacttgatgcaatttggcaaatttctagagacaattaagggccaggatcttgtacagatagcaaaaaaaaaaaaaaaaaaaaaaaaaaaacccaaaaaacaaaaactaaaaggaaagagtatgaaattattgaaggtttatagaaaaatcaaaaggaaccaaaaaagcaaaattaaaattaccaaagacaaaacatattatctatggaagtataagtgcaaatgattcaaacccctctccagtataaaacttatttgaataatataaatgatcactaatacaaatgctttcaaaatgggcccaatccctaaacctactgtagctaaaacaatgctaatgtaaaacaaaagtatgtgatataaaaatatgagtaagatataaataaaaacaaagcctgtgtggtactgctaatatcaaaacaagatacatgtagacagatgtttattaagaccaaaaatagcctttctttttcttcacaagggatacatctcacaatgaaaagtgttataatcagaaatgatagaaaatattcaacataattctatctaggtgtttggattttaagtaacacaaaagccattctatagaaaaatgccttatgcaaattcaaaaactaaagaaaaatatgacagtgatggttcacagtgagtttttctgctaaccatttagggttttggatgtattgtctataaaaatagagcttagcattataatttgttacatcaatttattcctttcttgcagagcaacagaacttgctggaacgactgtgggtcttgcatttatgtctacaatgtgttctccttattctgttggcgttgttcaggtctgtatgatgataaactgttggttctatgatttacatttatcaaatgctttttaaaaaatctatagagaagatcatgatagtttttctctgtagtctgttgacatggtaaataacactgattgaatttcaaatgttgaactaattttgcattccagtgtaaactcaacatattgataatgcattatctttttaatatattgtttagcatgaagtttttagctacaaactctcaataaactaggtattgaaggaacatatctcaaaataatagctatttatgataaactgacagccaatatcatacttaatgggcaaaagctagaagcattccttttgaaagacagcacaagacaaggatgccctttctcaccactcctatttaacatagtattggaagttctggccagggcaatcaggcaagagaaagaaataaagcgtattcaaatagaaagagaggaagtcaaattgtgtctgtttgcagatgacatgattgtataattagaaaaccccatcgtatcagccaaaaatatccttaagctggtaagcaactccagcagtctcaggatacacagtcaatgtgcaaaaatcacaagcattcgtatacaccaataacagacagagagccaaatcatgagtgaactcccattcacaattactacaaacagaataaatacctaggaatacaatttacaagggatatgaaggacctcttcaaggagaactacaaaccactgctcaaggaagtaagaaaggacactaacaaatggaaaaatattccatgctcatggataggaagaatcaatatcatggaaatggccatactgcccaacataatttatagattcagtgctatacccatcatacaattgactttcttcacagaattggaaaaaactattttaaatttcatatggaaccaaaaaagagcctgcatagcaaagacaatcctaagaaaaaagaacaaagctggaggcatcacactgcctgacttcaaactatactacaaggctacagtaagcaaaacagcagggtactgggaccaaaacagatatatagaccaatggaacagaacagaggcctcagaaataatactacacatctacaaccatctgatctttgacaaacctgacaaaaacaagcaatggggaaaggattctctatttaataaatggtgttgggaaaaatgtacagattttttaagagtatgcctctaactctttcttcccatctattgtgctattattatcatatgtttaactttatatcaccataaatacacaatacattgttattaattttgttttagatatccatctttcattgcaatttaaaattaaattagttttcatttgtacaacaaacccccatgacacagtttacgtaagtaacaatcctgcacttgtacctgtgaacttaaaatagaagttaaaaaagttttatatttaccatcacttcattgcatttccagcactctttacttctctataaaaatcctaatttctatctagtatatattttttcctttcaagggaattttttaaaacattccttataatacagtaaattctttcagttttgtttgtctaagaaaggcgatcttactttcattttgaatatattttcacagactttttggatgtcctgtaaccccaacttattggtggattcaagggaagttatagttgtctacctgccttgtccttgttagtgtaagaataatgttctttccagctttctacatcctagatagaaatggaattaacatattttttagttactatcttttgagtctgggtttgtgataggcttcatggatgtacagaagaagtaaaatacatattttcaaacttgaaatagcttgccataaaattggaagagaaactggcctacctaaagcaatagttctaacatatagtaggtagcttaatgctactttacggaagtaaaaaccattctaggaattcataacagatgatcgttgatgaatattaacatagtcaggaaaagttgcattaagatggacctcagcctgtaatcccagcactttcgaaggccaaggcaggtggatcacctgaggtcaggagttcaagaccagcctggccaacatggttaaaccctacctctactgaaaatacaaaaaaattagttggacgtagtggctggtgcctgtaattctagctactgaggcaagagaatcacttgaacccaggaggcggaggttgcagtgagcagagatggcaccattacactccagtttgggcaacaagagtgagacacagtctcaaaaaaaaaaaatggacctcaaagggtaggtaggatttagagtggggcaagacagaatggaggtcattcgagggcaaaaatcattcaagttaggaaaaccattatttaaagaaagaaaccataaactgaaaggaacttcatataggcctctaaacacattttaatttttctggggctttttggcttgcatttttccccatttggagcactccatatttctatataggaggttttaccatgttcatctcaaaagaatgaaagaatatagtgtgtctaggtatcaacttcccaacttacacagctgttccttgtttgccactcttgtactgttcttcatcaaactttacatttagttctttgagatgaagtagataagagaatcagacttctgtaggtggatgttactggcagattcttatctcctcaataggacattttaacctgcaacgattctcctgcattgttttattgctcctggataatttatagctgcaagctctaatttatctgcaagcttggagttgagtccaagcacctcagaccagaaacagtctggtgatcaagttggctataggctggatttcatgcaatgggcaagtttttaattgactgatgtctgtctactcttggcaattatggaattgagaaagatacaagtagagctaaagtgctaggctgatgaacaattttagatccctgatggccaaatgcatcatagacttctaaaaggcaagccaaatgtaagggagatagatcacttaaaaaaaagttctgatttcttattgttgatgaaaatttgccatctttcttggaaagaaaactagaacaatttccttcattataggaacctactcaaagaggaaagggcagaccatatatgctgtgatgggcattcagttccatttagtactctctctctcttgctctgtgtgtgtgtgtgtgtgtgtttgtgtgtgtgtgtgtgagagagagagagagagagagagagagagagatggcaagtagagtgatgtataatttcattcgaaaatcagagaatctttttcttctttcatacctttaggaccacagcgataatcttcttagagttgcagggacaatggcacatgaaatgggccacaactttggaatgtttcatgacgactattcttgcaagtgtccttctacaatatgtgtgatggacaaagcactgaggtgaggctctctgggccctggggacatgctatgtagccctggttttgatccactgtgggctgtactactttaggtcatcttcaacaacgtgttcgagtttttgagtcactaaatgtgcatttgtgccaagccacctcatctatgggtaatattttttaataactaagacataatttaaacatattgtctctttgctgatggggcaattcatcattttatcctcatcttatctatacaagacctggcttcagaaaaatcgttagcatttatcaggttttccatgaattcagcatagatggtggtcagaaaagagttctagaataaaactctaattaaagaagaaactactcataggacaaagaagacagtctatgaaaagacatcacacattccctccctgaattaggcaaaatttttaggcaatcttatctttaaaaatctcacaatcttttttaaatattcatgtcctcttttctatacatacagctcactctataaactctatttcctcttttctattttcatttcctccctcagcccactgaagctagggttattctccaaagcccctgtacaaaacagcatatggctgcatgccagttacagagcttatgttaactctcccctctattacagcagttttaaacctcatctttatctgtaggatgaagagatcctatcaataggaattcctctaaaggaaagtgaattctgagacatgtaaataaatattttggtacctttaggtctttacatctcccagatgatctaagattatctggagaagtcagagacatatttgttttattaaaagtggcctggatgctacacattgaaatatgactatattttctcatgaagttggaggtgggttaattcgggcatgcaaatgagctcacgatctggcagttggtcagtggattggattttgtcttttggggcaggccgtgggtgtaattgtgcctaatgtcagatactgcttcgcacatgttaagcatgactatattccagtttttctttccttatcttcacagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggtatggccaatcactttctaaaacgatctagttggtttttcagttgctaagaagatcaactacaaaataatgtgtggcccgctataacattataggttttttgggtaattttgggtacgcccatttgtaggtattttccaggaaaatctttctgacaaggaaccctgcacttctgaacagaccttgctaatttctcccccaggtttccaacctcattcctttttttaaggactatttactaacttgggccttgtgtcctcgtccctccctttctaagtgaaatacttgaagctccttacgtgactatgacttacccagtattactttagacagagcactatgagtgcccagagtacaaatagcttgctggttcaaggtcactgggctggcaaatggaggagccaagaactggattcaaatgtatctgtttccagctctgaaacgcaagaccacccagcacagggatctggttcatcccttactgctttgggactcgggagttattaccatcagaagttctgtcctgaccctcttcacagggcagctgggattttgaatgggacctctgcttccatgttattgatgcttaatataaataatgcatcaagccttcagagtactggctttcagtaactttgaaatatgattatatatttgattatgtatttatttgctctatgagaaaaagtagtctgtcctggttgatgattatatttgaactaagggctagagttttaaccctaaaatattgtaaccctgaaactctcagtcttctatgggaatctagacagctgcaggggaacacttttgaggtaagagtttctccaataccttttgcaggcaggattctgacacaaagcagagagactaagacaaagtatttgcttcaagcacagttgaattaaatattaaagttagataaagagctgtatctttagcttttcagtggatatcctagaaattggatttactgctagatatgtacataactgatgagttgaaggaattatattctataattagacaaatcttatttcaagaactgtgttttttcttcatattttaccaaaaagaatagatctttccttaatattattggagactgaggaaactagttaatagaaaaatgacgtaagtggaattcagataaacaacaaaccatcagttgctccaaaatttcaggttttctaattttttttatattttttgaaaaagtcctatttagactccacgaaagtaacatatgcctgatgaatatagtatgttacaaattgtgctgaactgggaccaaaaagtaatgttgcatttacatttgtttctcatatttcttaggaatgtaccaatatttgctgtgatgctaagacatgtaaaatcaaagcaacttttcaatgtgcattaggagaatgttgtgaaaaatgccaagtaagattattttattctattttaataattatgattacatttttatacattaacatctcagtgattatgttaactgaaataagcaatgcaatatttttctttatataaaatgatatatttactatttatgaagcacttactcagtgttctacacacatggcctattgaatcttccagtgatccttcacagtagatattatttcattttgtttttgagaaaaaaatgcagagtagaaaatgaacaaaataatatggccactatttgctacagcctggatacacctgagaacattatgccaactgaaataagccagcatagaaagacaaacactgcatactgatctcacttgtatgtggaatccaaaaacgttgaatacacgcaaacagagtagaatggtgtttaccaagggcaaggaggctcggaaaatggggagatgatggtcaaaagggacaagttacagttatgtagcatgagtaaggttaaagatctaatgtacaacatgactataggtacaggtacaatgtgaccgtattgtatgttaataatttgctaagagagtagattttaagtgttctcaccacacacacacccacaccaacacctatgtaagagaccgatacatcaatttgtttgactgtagtaatcatttctttctaaaattgttttatttttaatttttgtgggcacataggtgtacatatgtagtaagcatttcactgtatatatgcatattaaatcatgtgcaccttaaatacaggcaacaaaaaaatgtaaaaataaacatggccactgttgagtaggataaccccaagtgtgatcatctccaaagccaaagctggttactcctacctgctgctgtttctcatgctccatggctttctcaggtcgaatctcacaaaactgattgtatctccctttaacaatgtgtgtggtggaagaggttttattctgagtagtgtgggggtatccccatcttcaatctttgaagccacttcagggtgaaattcttctaaatatgccatttcatgttctctgtggtgcttttctgaattgtccttcaagtttagtatttaactttctgttgttgcatatcgttctatattgtgagggtttgtttccatactcagattgactcctaaggccagaagacagattcactttcacctagcacagaatttcatacattttaaatgatctgtaactgcagcatgaatgtgcacatggcataccaggttttatagggaatgtttggtgttattttgtttttaatgtcagagagagaggaaagaaagaagtccaaaaggaagtaaatttgagaacttaagcagtactcaaagagtgtttagtaaatgctatttgttagagattatggtaggtaaaaaagtatccagtttcttactatttagagcaatgatatacatatatgaaacatatgaaaatataatgtgtgattcaatggccttgtagatagcataatgatatattaagctttttacgtacagtctcacttgattttcacaatggccttgtaaagtagatgttggatggggacagggattttcagagagattaaatccattttctaaagttcagcactcagacacatgcaaagccgagattcaaattcctgtcatctaaatatgaattcgaggctcttcccaagcacatgaagaaagcaggagcagcaatttgcattaaaggtgtcagaggagacttggtgggaaaatgggctttcaactggacttgaaaaaagattttagacagaagagatttagacataaaagaatttccaaatgagggcacagaaacagcaaagacataagagaagatacaagcatggtttgtctggtatgtggtaaggaattctctgactggagctttgggttgaatttgtaggatctcacatgcttgcatggaaatttggatttgatcccgtcactggtattaagatatttaaagttatttgacgcattgaaaacatacctgctcctgttaggaaggaaaacaaacaaacaaacatactttctcagttttgcaggaatggcagaatttgtttcactaaagtttctctgagcaaataagagtaagatttgcagtaattgattacaactgagttagtatatcaagtgaatatttgcttatttctccctcatgataagtcattctatggaagaagtgagttgaaaggaaatagctgaacctacaataaaagggattaaggattaggaaactcgaggcctgggaaagtccgagtctgctgatctggtgcttgtaagcttatctccttgaataccgaagatccaattcaccagtaaatctctgaagttgcagatttaaatctccttggagttcctgacagagatgcatccaacaaaaggagaaataactcccttctttttatctaagttgttgcctgttttttttttttcgtcctgtacttttctacattatgtttctttggtgtttttgatacaaattcagaaatattgcttaaaaacttagggcattaaccaatattaatagaagtgatataacagatcatggctttaatttatgacaatgtaagcttcagtgaaatgacacctccaactactatgcccaaaaagtccaaatggaaaatatttgtgttaatttgaggtattagggtaaagcaggtagggagaataaaaagccttctatttttgtttttctacagtttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggtaggaggacaaatcctttcccctgtgcatgtgcgaaggaaaatcatttcagatgacagtgtttaaccatggtcaaaggaccattctgtcctatccttcttagaagcttcgaactcaaaatcatggaaaggttttaagatttgaggttggttttagggttgctagatttagcaagtaaaaataaggatggccccgttaaattttaacttaaaattaacaagttttttgttaattttttgttttttgtctcagcatcagtatatcccatgcaatatttgaggtgtgctcatactaaaattatttgtgtatctgaaattcaaattaaactgggtgtctttttcttttcatctggcaaccctactaagatcataaacccttggaaatctgtgtgtgtgcgggtgtgtgtgtgtgtgtgtgtgtgcaggggtggcagaagtactgtgggatgggacagaaataagaaaagatggaaaaaagaaaagaactctggaaatgcagaaagccaataaagaaaagtgaaagttcttaaatggtcgctttgtccataatgccaaaattttagagaccatattctctaatttcaccaagaaaacttgaaaaataaaagtttaaagagatatccgaaaatttaaacagcaatttgtatagtattaaataactttggccaggtgcggtggctcacacctgtaatcccagcactttgggaggctgaggcgggcggatcacgaggtcaggagatcaagaccatcctggctaacacggtgaaaccccgtctctactaaaaatacaaaaaattagccgggcgtgctagtgggcgcctgtcccagctactcgggaggctgaggcaggagaagggcctgaacccaggaggcggagcttgccgtcagcagagatcgtgccactgcactccagcctgggtgacaaagccagactccgtctccaaaaaaaaaaaaaaaaaaagaaaaaaaaagaaaaataactttattagaaagtcaattttagatcataagtgatctagcttatatacctaaaatctaaaaaagttgaacgcatagaagcagaaagtacaatgctggtttccagggtgtgacagggaggaggtggggagatgttggtcagaggatacaaaatttaagttgaaaaaaaaaggcaagtttttaaaaaccagttatttggactttctggatatgatgtgtatgatgtacatgtatttaattgccatactcccttcctaatagtttcagactcctacttaaatgactgaaacaatatttattaaaatagagaaaatctacatagtcctattatttgaaaggggtcattgcgtgccagaaacttttcataattcctgaaaacagagctaaaacaagattgagaaaatcaacaaaaattcctaacttgcaatgcactgtgaaaacaagaaacctgggaaacaaatagacaagaccctagaaaaacctccctgtaaacttctctgtctttggctacagcgggttgagacacaatttgaggagcaaagctcaattcccttagtatgtcagcaagctcactagtatcctggaaccaggcctcagcaatcttgcctccacttcgtggatgcgccaggttaaaggtggaaacaaaattgattgttggttaagaagctcatgtttccttggctaacttcagtatacggcaaaaaccaggagaaagaaaatctttagcacagaggtgaagttctgagcatcacctttattatcttgtagtaaatattaactgcaaacaatattaactgttaccctcctccctcctttgtccgactttatgattagtctcctcggcaaatctgtaaacttcctggaacagggacattgtctacattgttcacagttgtattcccagtgcctcccagcacagtgtctggctttagtaaaaagctcaaaattgtctattgaattaacattgaacatatttatctgatcaggaaatggagtagacctcttaagtcatacatttaaatacagccattataaaaggccagagaaaacaatttgcctaaacaaaattccaaattttataattcacagaggatcacgtatttattttaaattaatctgggaagtttgaaaagtcttgcaactttgtaagtaatttaaaaatcattctttttggcatcaaatcattcccacaaatcaattctaattccaagtattgaaaatgtggctaaggcataagcaggcaatttgtcataaagaagaaatacaaatgtcctgtaaaattaaaatcattttaactcattagcaatatacaaaacctgaatgaaaacaagttaatcttctacatttgctaattggcaaaagtttgctacagatgttaatgttcagtgtcacagaaaacataaccaaacaactcccttcgtacactgctggtaaatacacaagttagcatcatctttacggacagaaaaatgcatacacaaaatctaaaaataattgttttttactccttctcctagcaattgtactcaaataattatgaggatttttcaaccagcattttttaatgatagtggataactgaaaaacatctcaaaatccaaaatatatggattagttaaataaagtgcattaattcaatacaatttttgcagctgtgatgctttagaaaatttaatgcctggggaaaggacagctatattgttaattggcaagaagttataaaacagcatgatgccagatatatgaatgataccttctgcaatatcagcagcaataactctgaagtctcagattaggaatatcatgcttctccctgattattcatgactaatgattcttttcttccatgtagattaggaatatcatgcttttccctgattattcatgactaatgattcttttcttccatgtagatattgtattataataaaacatgaatacattttactaagatacaaataataaaaagtaacaaaactcattttatcttacacattgaaacatgaaattcgtttaaaagtatttcttaaaaacaatgccgtatcttcataggtgtttattttaacttagcttgctgtttgtcaaaggctagactcaaaatttccaaacgtttaagacagaattacttgttcttgaagagagggtacctcagcacagagaaggaacataggtctttctctgtgacttgataggattctgtttccttattaataaattgagaatggcaataagaatggctagtatttgtcaaccatgtactgctgaccaggcactgttctcagtggctcacctatattaagtaatttaatcttcaaaacagctctttgaggtaggtactgtcatatataatgtgtatatatatacttttatatatgtgtaaatattaaatatatatgttcacataaatataaattatatatccttattttacagatgagaaaactgaggggttaagacacttgcccatgttcacacagttactcagtcttgcttgaagcctgagctcttaacaatgtgttttgtctgatggagatctgaggaagattacctgagacatgaaatatgtgatgcctatttttgtacctagcacatagtaggagtttgttacagagtaacagattatttaaaagattatttgtaattccagccagctcatttgataccaaattactacagcctatgtttctaggagtggtcaatggaattatgctaaaatagtatttttcttgcttgttttatattttataaatcgctttccagcactgaatctttaaaatcttttattttcaagtatctcttgaatctcaaaaatctattttcttttccctgctgactgatcctggtcccaggaactgaggttgcagataagtcatgttacaacaggaatgaaggtgggtcaaagtacgggtactgtcgcagagtggatgacacactcattccctgcaaagcaaagtaagtggccttgtctgaaccttcctgcttcacagactagagcaatggtacacttccagctacacattctgatttattccagttaaagggaaagtgcatttggtcatcaatcatttgacaaacatttattgagtaactactatgtgccatgatgtgggctaggtaccgagtctaaaacaacaaataagaaatggcttctttcttcaagtatctcatggtgggtgcttcagatgacacaaagcacagtcattgttgggtagaatgaatggttgtgatggaacatgccacaaagaatgggtctggttagaaatttgtccagggatttcccagtataaatcagatgctttctcaatctcatgtttttccttgtaagattcagagtagaaatatttatctacccagaggaataacagatgcagtgcttgaacagttttttaaactttcagtagaattacataaagaaaaaatacaatatgaaaatattgacaattcatctgaagagtttgttagttttagtactgatatccgggaaaacactatagaacagcacaccagaagaacttgggatttttctatggtttaattctgcaattttgagatgagttttaaaatccaattatagattaaactctttgtacctgctctaaattttacacataccaaataatatataacaagaggttgcacaagatcaacatttcccaaagtttgtctattggacacgaatttctctgaatgacaggtattaccaaactatactttggatatagggttatctcttgggagaatctgtgcctaaagaacaatcattttcggtggtcttgtggtctcttctttataggaaaccagggcagattcaaaagaggaaattatgtaaaaggcagtatgtgagggccagaggaagggcaattgtaggtggtgaatgggaagagagtgggtctcgccatctttcctttgcagtctgtgcacacaacagtgtcccatataactctttgcatgagcattagtttctgtgctctagtggctcaagcagctccttcaccccacaaactaccctcctagtcacttctcagtagtcattggctatagtgaagagttagcctgaaattccctgtgccctaaaccatcctttatcgctttacctaagtgattcaagaaaaacacactctcatattttgagagaatatatgcctttctccactcctcaaacatattttctacagccaagagagatcaaaaaatctgatgccatcactttctggatacttttttcacagccctcttccgaattctacataaagcaattgacttccattttattgtcttttagtcctgttggcagtaaatgaatggcttgagtgagtgttgagcagtttaatctgcaccttcagggagacagttcttttagtaactccacctgatgccttgcagtgtcaagggaggctcagctttgttctgacagcattatagtggagacttgggctttcttttggtggaattattctgcagccagttgtacaaataaatgagtaacctatctgaaacaagctagaaattgatgtctcagatgcctccatgatgttaggaatccatgttttatcctctagctccatcatccacatgactttcatttccatgtgtttctctaggcctatgatagcttctctagctatcatactccaatcagcaaaaaatgagaaaatgttgagaaatagaagataattcctcatttaaggccaccttctagaatttgtgcttaagattctgttttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtaagttgaaattgtggctttcactcaaaatagtgttttttactttggtgtgctttgttgttttgcccctcggttattcactatgtgccttgtttcccgattttggggttcgccatgccttaatagaacccacagagtttgaatttggaacacagaaatgaaaatggcgcagaacctagtaaatagcaggaataagcactgacattaacattctcaaacactgtggtgaaatttggaaataattgactctcatagtcattatttcaagaagagtatcatatcgtcatgcagataacacacagtagcatccgtttaactttcatagacgaagtctgaaaactcactgaaagtgccagtgtatgtgatactgggcttcatttaacagatctgtatatcattaataatataatgaacttaaatacgagtactgtttagccagggccaatcaattcacgaactttgaccatgaggtttgtctctcttaagagattagaattaccctctttatatattcactaagatatccacatgaccaaagagttcccctgatttttcactgtggtaaagccaatcctcagaatattatcctatttacttaaactgatttggctatttaaatattaatttatccaatgatgagtccaaaattatctaagtggttcagtgtgggtattgcttatacgtggtctctgaacccctggagctgaaaataaaaatttagcaatgtttataaatctgctgatttgacattaaaatattaggtcttgcctataagaagtacccacagtatttaaacttattcttttcccccatttttcctgaaacatatgctagcatcaagggcaaggaattttatataaaatataatatttaactgcgttttcccaggttttactaatttccttgtattttctagtgctgaagcctttaaagacattgagacattatcacatgacctggcatggatgttgcagtgcttgggccttaagggagggaagtactgggactagggcagaattgagatgtttctgggtcccctggcattaagatcatctcattattgcttatcccttaacttcttgcatagtcattgcttctgggatatacagttgtttggatttttaaaaatacataaattcttagatagactttatcaacctttttgggttggtttaactaagaggataatgtaagcaacagagcccgtctctgtttcccttcttctacatcagcctcctggcagagccaccttaaacaacatctgctagcctcttcacacagacctcaactttctcatctacgttcagagaagatgaagcttcatgttttctacatcactttcaggtttgcattaatgcagaatgtgtggatattgagaaagcctacaaatcaaccaattgctcatctaagtgcaaaggacatgctgtaagttctgaaaatatgtttccctaagctctctgaatcttatgacattctaggtcagtcataagaaagctaaaggaatattttcagctttaaatgatgataattactaagtttatccaagccttcagtagcatggttcaaggagaaatttcttctgggaatcattcatgaaatgcctctcattcactcatactttttgtagatagatggaagcctggagactggggttattcctttttctgcatgaactttattatggatgagtagggccttgagtttctggtcagcctagcggggacagtaacaggatcattgctcccctaggtgtgtgaccatgagctccagtgtcaatgtgaggaaggatggatccctcccgactgcgatgactcctcagtggtcttccgtaggtaacattacacatctaacctgagaaaattgctctcctcttccaagcctttattttgtattatatgagatttcactgcttcttttctctgttcttgaaatttctgttctgttgatgttgaatccacaatatttatcccccaaatctccttaataccttttaattatattttccgtgtcttcattttcactgcacatgcaaaaaaatttcctcaacctttatatttgtaatcttattttaatttcacaaattttcttactttaggactcttccattttcatagcagcctcaagttaatggaaaaatgtaatatcctcaaaactctctaagaatatgacctattattttgtatgttcagttctattctttgaattatctgtttcttttgagttggtttgttctgttgtcaccacgtcacttgtattctgttgtactagttttcttcaggatatgtgatccttagttcaatgtggaattggtagagctggattagttcacacgggatgtctctgcatttgtgtgtgctgttgtacctactgatatttctcttgatgggggaatctggctgggagctctatgggcaggtaggcaggtctgcctataggtcttcagggtgggaaggagccagagtggggacccacctccagttgttacgaggaacattttaccctgaggaggagctcatcaccacattttctcctgagagagctgctttttctcatcatcatctcattgacgctcccctctctgtctgatatagtgtaggtatctagaggaagcctctgtcctcctgttcatgttcctgcatcctctgtttgcagaaacggagaaattcttaggattttgatctcaggtgatgagccaatcttgttctatatacacaggagatgaagtagacctcagtgagatatctgccccaaattcagattgttagacttttcaagagagaacatttatttctgatgtttagtctatatttattgtttccatccacataaatcccttaacttcctatctttctgaagatttttaaaattattttttctagtgccctatgattttattatatacacatgtatttgtcatgtattttgaaaggggcatgaacataatcaactgttttaattagaaaactctttaatggtttcaatgctcactaaaaatccttttaaactatgactttcttgactgctttattttgacatatctattgatttgctaagtcacctctatgactaatttcttcctggtgtaacaatgcatccacataaaactttctaagttgtacttatgagaatgtatttctgttgccaaatatttttaatatttcaattaatattctatatcatagcatgcatagcaggtttgattgaatttgattttttaaatcataattttgcattcataactctgttaaagtagatgtttatatttaatgtcaaaaaaaaaaaaaacaaggccagactgatttctgttgatgttaaataacatcccttttaaaagtcattaggtttgttttgcttaaatgcttttagaattaattacttaattactaattaatcaaaatgaatcactattttattcctgggtgatgttctgtttccattaagatgttacctagtgagtttctttaaactgaggatttgcttttttcttccattgaagaaatgtttctgttgttctaggttttaaaatttattttctttcagttttctggtttctgatttagaaatgtaaattatttatgcaaaatatctccactgtgtgatctccatattatattccatattgggtcatttttcttgttaattctggggaagtttttcaagattattctctgtatcataatatacattttttagcaatgttaattctcttattacttataatgacatttaaaattattcagtggcatttttatgtgtctttgaaatatttttttatcccagttggttgttttctcctgtttcacatctgtctagcttttttacagtctatattttaattgcattgagagtaccctaaatttgattctttatactccttttctgagagtatacattttatgtatacttctacttctatgtgttattttatacctaatcttttgattcaaccgatgctttttctttagttatcatccaataaggttgaattaattctgataagcactgttaaaagtatttctcaaaatttttaacttggaggactagcgatacaactttacggtatattacatgaaatttgtattttagcaggataaggaggtagctggagaagttcaaaatacatacagtggaagcttttctcaacttattctgtttgttgaaaccactacatcagaattcaactttatcccccaagccttgttttttttagggcattgtgttagtgggttcagtgccctttcagtgctatttcttatctaaccatcaaggaaagcctcagacagactgaggaacatttcctagttcagaagtgtccttgcaccaagaggacagaccctagaggatgacaatttttactatagctatggtcctaaatctaaacttgaatgggaaaaaattacatttttattttcattaaattctaaagttagtttagaattttctacaattatgggaatgtatggcttataaaccataatagtattagcaatattccatgactttgtcaccaatagaaattacaaagactttaatatctcattgcagttgttgaatgtatctccaaataccccatgagtatcatttgtttgaaattttggtaattactgacctactgttagaactgattatttcagaggttaataaacacatattttactatatcataaattgttttataatattttcacaactgtatcccaacatcaatagcttcctttaaatcttatgccttttatgaatgaatttagaaacactcagaaaaggggtttataggctttatcagattgccaaaatgatttgcagcatgacaaagtttaagagcactgccctacgacatggccatacacagccattggctttcaagattattgttaacaccatctttttgtgtgtaacataatagagcagacatgtaaatataaaggcaaacctgatgattacaaaatgaacgctcatgtaatataataagggccaagaaatagacccagacatctgctttcctgcctcttttcagtctgatctcccctctttctctaagggttgaccattaatctttcttttgtcataatcattttgttagttttctttgtagttttgcttcctaaatacacatccttaaacagcagcttttggttatataattccatgtgtataaagtttttaaacacaggaaacacagcttccctcactatcaacactgtcaccagagacatacatttgttacatccatgaacatacccggacacatcattatcaccaagagtctttaaagtttgtatgtatgaaatttttctatgctcattttcttctttttctctaccttatgctttcaagatcatccattctagtgattggattaaggtccactagttctctttcaagtttctaagaattctgtcaaatacttccttatttattaaaatgttttcccctttactctattagtactgtcaaataagtcaattggtttgtgaacatttatctaactttgcaacctttgaataaacctaagttagaaataatatcttttttatatagtgaaggatgtttactcttattttatactcttgggtgatattggactgtgattttttcatattgaaaaaattgctgaattttggtatcaaggttatgctagtcgcataaagtgtattggagagtattcatttatattctctggaagaatttgtattttttggctattttatattcatgggtgatattggactgtgattttttcatatacgtgttctgtagtattctccagatattttgtttatcaagtttattaattgtctgatatataaattaagcctaacattgtttatttgttctaccaattactgtgctgggagtgttaaaataccccccactgtaattgtgaatttgattactacttctggctctatcaatacttttatactttgagagcgtattattatatacatacaagtttagagtgttgcttcttccaaattaatgaacagtgtatcatgatgaaatggtgctgtgtctatctagtacacttcttacctttgagaatatacacttcctggagaccatatagctgtaacgtatttgttttggtctgtatttgccctgaaataacatttttccatattttcatttttatcctttctgaatcacgttttaagtctttttttcttttattaaagaaagcatgcacatatagtttttagtagtactcacatctttggtttttgtttgtttctttaactgaggaacttagtccgtttaaattaaatgtaattactgatgtacttgggtataaatccacaattatatagtttctatttgtctttcctgtttatgttcccttttctctcctttcttactttcttatagacttattgattttattattttattaacttggatgttatgcatttcttttatattttaatgattaccctaaaacttcccaattcatttgcttttttaaaaaaataaacttaacttactttcttttgtagagcagttttgggttcacagcgaaattgaagagaaagaacagacagttgacatatacccagcaactcccactcctgaacagcttccctcaccatcaacatcccccattctcgtggagtattcgttgatggtaacaaatactccataaacctacattaacacatcattatcaccccaagcccacagtttacattagggtttgctgttggttcatttgcctttcatttctttctgcatttctgaacttttatctaggattattttctgtctctccaggtccttgcccactcactaatctctacaaagtaattttatctaacatttaagtacttttatacttttaggatgcttttgtttgcttgtttgcaaaaaatttaaagattaaaagattatttttaatgggcaggttgatctcaatttcctagtccaccattaccagaaacaagaagaggctgcacttactcttcagtgatttctatcttcacctgcaaaccttccgttgttatacttccatctgtcctgtgccccaattttagctccagaccatgtcttttcaagtttggtgtgtttgtgaagtactgccaaattcccatttatttctctgataatatgtcattcttctgaaaatagttacagttctgatattagtgcaagtaagtgtatgtttttcattctgaatgtatctacactataacagaatgcttcactgttttattttcctttgactttttggattggaatcttatggagggtggcgagtagcgaatatttgaactaaagtcattgtcttacctagaattctgcttctgatgtgtctacctctatctgcatgtgtgtgtgtgctcacacttgtgaacttttcttgcatttatacaaatattaatcatgctattggtttgctgatttctgtaataagagaacggtaacttttggcattgcttttcaatcttttccttcctggtctcttgtggtttcagattattgtaagagaaatgaacagttaagagcaaaagagtgaagttatattcattatttaaatttgtcagtacaagaaaaaacaccatggaggcccaggaatatttgttcaaaccatttcctcattctcaaggtcacataacttcctgtctaattccagtgtagaccaacatcagtggaacactcgattatttgtcttcttagtcacacctcagcttcttattcactaatgacaggaatgtattttcaaagttttagtttctttttctctgttttattccaagactgcttttcaaaaatgtttcatttcttctttgccatcttccttactgtatattctcttctaatctcccagctcatttcccagttgttacaaacattatctaagtattctcaatattatgatttttaacttatttcatgttaaatgtttcctatagatttcatgtgtatttattctacctaatattaatataattatcctgatcaaaatactttttcattttactggctatgggaatttatgttcattggagaaaagggtagctggaatatgtgctaagtaaagaaacaaggactagtgtgttgtgcagatgtgtgtttctgcagtcctcagcgggcccctgttctctgctgcagacttctccattgtggttggggtgctgttcccaatggcggtcatttttgtggtggttgctatggtaatccggcaccagagctccagagaaaagcagaagaaagatcagaggtgatcctttatcttatcttgctgtagggactctttgacccctattttactttactttaaattcaatgtataacctatcctttcaaattgaattggtttacttctaatattcagaaatacatgcagatggtctttttggacgagaaactgggtttccctttaactgagaaatccttcacatctagaaatgttttttgtttttccttctgttagtcaccgtagttataataataagagtgatattaactctcattatgacagattttttgaatttgttgtaagaatataatatctaacattatttgatcaatatacgatgagcactgtgctaagcaccgccccacccacttttttttgagacaagagtctccctctgtggcccaggctggagtgcgatgctgcgatctcggctcactgcaacctccacacctcccagtttcaagtacttctcctacctcagccccgagtatctgggattacatgcacataccaccacaccgggttatttctgtatttttagtagagatggggtctcaccatgttggccaacctggtctcaaactcctgacctcaaatgatccacccactttggcttccctaagtgccgggattacaggtgtgagtctccacacccggccgtgtgctaagcccttttatatctattatcttatttacacttcacaagaacttcataaagtggtcatgagtttcattttacagatgagaaatgttttatgctaacccttacacaattttgcaaggttaggaacttcacattttgatggatatagaaacaagctcagagagattattagcaaacatgctttcagtcttgcagagtaagtggtggaggctgggtttgtctcacgaacgtgattctggcacaatggtgttttttttggttttttttttttttagcacttttaaagaaagacttatttactcatgatgagttttttaatattgagtaagacattaataaaacaacataatttagataaaatttggattcaacactatcatttttagaagtcaggggtttttggagaaaaaagaaaactagtagtgattatgaattacaaggcaatgaaagaggctgacggggaagtaaaaactgatccagggagcagataaaaacccaggcaataggcaagaaagacataatgggaaaaagaagttgggaatcttctacggagtttccctgtcatgctgaaggagctgctaagtcaattgatatcatgtgtttctctcttacaggccactatctaccactggcaccaggccacacaaacagaagaggaaaccccagatggtaaaggctgttcaaccccaagaggtgaactatatagtctgggctgtgattaccatggccccactttgcgtttctctcacactcttatcctgactacctatctatcatttctacccagcagcgttttgcagtaaaacattcagaaatgtctcctttgccttttgttaaaggcaaaagagtccctaaaatgccgaggctactttgccggggttcatgaaatgcaaacagaataaagagaacaaagaatgcacataccggatgtctgtctgtctctctctttgtctctgcttcattctctctccctctctcacacacacacactccctctagcttatttctttgcaaattgacaaaatagatacaaaaatatgtatgtctgtatgataatacatgtaatatttataacccaaatgtcctactcatgtcctgtaaatttaaagattttagctgaagttggttaataacattggtaatcatttataacattggtaatcatttcatttataacattggtaatcattttttgatgaaaacttttcattacagctctgggaaatacttctatggaatacgccagcaggaccactgtgattttctatctggtctcttggtgtcagcttagttccaagcttccatgccttgaaaagtgcttacttaaaaattacttaaaaactgtgcttatgaaactaatggttcattttgaaatattcgttcttcttttcagatgagtcagatgaagccccatgtgtatgatctgccagtagaaggcaatgagcccccagcctcttttgtgagttagcaacttctcttaaataccaccctagttcaatctccaggaaatatcggtgaaagtcatagcccacaacacttcattatttcttcaggacaatattgaaatctatgtgaatattaatataaaatacaaattcttctgcaaaatattttgaaaatataaaaaaatgaacatgtatgtcactccatgccaacttgtgacaagaagaggactaatctgcttaatagagtaccactgttttcatcagctcaggctgctgtaactaaattaacatagattgagtggcttaaacaacagatatttacttctcacattctggagattgggaagtccaagttcaaggagctggcagatccagtgtctggtgaagcggccttctggcttgtagacagctgcctttttattgtatcctcacatagcagagggagagcatctctcttgtgcttcttcttataatggcattaatcctatcatgagagctgcaccctcacgacctcattatttccaaaaggccccacctccaaataccatcattctggggattagggtttcaacatatgaaattgtggggtgacacaaacatacagtttatagcaatcatctttatcagatacctattgacattggacttaggtctcaactgtgtatgtacaactaaatggaagcaatcaaactcatattttacaatattctcatgggtggggtcatggcttctccatttctgaaaatgatttaagtcttttctttatgcacgcctattttcaggaccctatctttgaatgtaaatgttttatccttttactagctaattacaaagccagattttccaccaccgccaattcctgcacctatatcatcttctttgcttgtaactatcagatagtcattggtgaatttttaatctctcacctgctcattgcaaatactgtctccacatccatcggttatcaggatgtgtacttttgaggttaacttgaaatatcacagcacatttgtcccagggatatctaaaacttcctgtctataaattagtatggatattgatgttttattataaaaaatagtattgctgttatgcaattattgagaaacgataaatagctctgctctgtgaggtctcaaagattcatttctagatgtttatttaaggagataaaattttattaggtgatattttactttatatatattagtcatagttttctgtaggaggtagggtatgaaaaatgcgccatatataagcaaacctggaataagagtcaggtgctcatgaagtaagaattacagtacattcactcattaaatggctcctgagcatttttcttgtgcctggtattctgctgtgggtaaatgagaaagacctacatttgagattttttttctttcaagaaatttcacatttttagtgagaaaaaacaagtcatataaaaatggagcacttaattcttcaactgttatttgtagtatcgcccaagacgagtgacactgacaggaaaaatatggtgaggagaaagtcaacgggctcggagtggttaaagtaggacgaatattcattggttgagtagttggaatttgaactggaccttgaaagttgggtagaatttaaatgagtgaagaagagctaggaaataatttcattaaggaaataaatatagctaagatgggacaagcatagcatttctaatgccataccattgtttttataattaatgtagcataaagacacaaacgcacttccccctactgttttcaaggataatccaatgtctacacctaaggtaagagatctatagccaaattattatattcttgtattataatctcctactgtcaagagaaggcccaccatgtctttttagaaaaaaacttactaagaacagtatctgtatgatttggagatgggtgccaacatgaaagtcttatttctcggtatggccaataattaaaaagagaaattagaagattctcagctagaaagctatgtagacacaaatattatttattttctcagaaatattccctaaggatgaacatgagaagaaacctcccatagaataataagtatagtatcctgtaactctccttctggtcccctaccttctccatattatgctaattaccggatagatacttagatcttagtgtagtatttttctcactcccttcgtatcatctcacatttctacttcttcgtttttgctgtatcaagtgacctatgaaatagaaactgacttcagataattttaatttcttcatagttcagcttcataatagtaaatatctaaatttttgaagaaagttgatcatttagaagttatgtctgtcttttttaggactcaaatccaaaagcatgaagcaacagctaagcaagaactaatggctaaattatcaacttggaaaactggaaaatctggatggcagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaatatatttggtctgaatgatattgatattggacacatagtacttttacatgttttgaatgtattgctaatatttaaaaattgagagatcttgcataaacaatagattcccagctttgtcagatgtaatcaaaaagtaatccgatgctttgtcaacaacagacttacattgcccatagcaaccgtcagcttagttgatgggtaatgtagcaaacactattggtttcctaccaaataatcccctttttcctggcttttagaacaataattttgttcacctgcccacttctaggaaagaatatcctatctatctaatctatctagctcagggataaatccctatccttttaagtaagtcaagtcaattaaaataacctcatttttccttgctagtggtcgacttggagatgattttataatcctccccctccctttttttttttgctagtaagacgacagaggaattatgttacaacacttctggaaaatttttcctcgtctctttttctggatatgggcatctgaatactctagctggtactgctgcgctccacacggtgattatgaaggctgaaaaagatagatagatagatagagcagaaagatgaaaagaataaaacctggcctttcaatgatgtcatggaattggtagatcagtgactgctggagttacctcacactttcttggtactccttattatatgagccatacattttccttgttgtttaagccattttgaattggattttctctcactttcaacagagatcatcctaactagtaaagtagctgtttccataatcagggaacatgctttagttcatcatcacagctacagtttttcttgtatttgtctgcttcacccatttctatcaatcacttacctggtccccacaggcctgtcgcttcatgaggaactttatggttcatttacccttgcagtatgaggttctagataagcccactctggcctcaaaagtgaagctcagtcctcaggaaatccagagtccactgatcaaatcactgtcaaggatacaggctttttctccatgtggcatttgcagaagaacaactttaaaagtagagctttatctgccctgtgaggtttcagaagaccctcccctgacccagaaataaatccctatttcctggaaagccattaagtactcctgaccaacttgtgaacttttctgtgttgttgttgttgttttttaaatatctgtccccagtaatagattcacctaatccttttttatactgatggaatggaaatcttaaatctatgaatcctcaactagccatgtaccataacccaagcaaaaactaaaccatacactctcaaaagcagtggcatgtgaacatgcctgcaagttcctaaatgatgtcactaggtccctgatgcagatgcatcatacgtcctatttgaagagaagaaatgcagtacaatgacaggaaaaccattattttatcatagaactgcgaacccaagtcctacaatgtttccctttcagctcaactgcagaatagtttagaacagactttttgatttcacaatactgtttccacacttacttatatctgtaactttctaactttaagggaattccgcttatttgacatttaactacctcagatatgccaccaaacctgttttcatcattagttatttttaccttgtctactttaaaacagtgaaattattaggttaaattatgtttttatccagttactctaagataccttagtgtttgtctacttattacaactcaccaaattactggttttatatggcctttgggaaggcttttagctttttataaaataatgaagtatgcatgaaaagaaagcaaattttagttggttgcagtcagagaatatggaaagggttattattataattaggattttattattcacattggaaatcactgctatgtgttaaggaattgaaggtggcctctggctagcagccattaagaaaatgagcccctgagttcaacgac

SEQ ID NO: 729 - DNA, 6589 bp, Human
gctaatttttgtatttttcgtagagacagaggtctcagtatgttgccccggctagtctcaaactcctgggctcaagcagtctgtcctcctcagcctccaaaagtggtgagattacaggcatgagtcgctgtgcctggcctccaagcactttcaaatgtatcaacttaatcctcacaaaaccctgtgaggtcggtactgttttcatacctattttatagttgaagaaacagacacagagaagcaaagtcacttgctcacagtcacgtggctaggagagcaaggatctgaagcaaggcgatctcttaattaccaagtgatgttcctggagtaaggctctgtttgtttcctttcctgtaaaatgctgcatgcaaaagtataacacagtaagtaaagaagtcagttagcctgcacatactaagacctaaccaaaggagcttattgtttttctccaacttccatgataggtaattagatagtggagacctctgctggccaatatggtagccactaaccgcagctggctcttccaattaaaattacataaagccagaaatgtaactcctctgtctcacttgttatatctccaaggctggatagccacatgtgactggtggtggctggattagctagtgcatataaaacatcactgcagaaagttcagctgagcagcactgagttagatggcctctgaagaggatgtcccacggagagaatccagaactcaggatctttttttttttttttctttgcgacagagtcttgctctgtcacccaggctggagtgcagtggcgtgatctcggctcactgcaacttctgcctcccaggttcaagcaattctcctgcctcagcctccctagtagctgggactacaggcctgtgccaacatccccagctaatttttgtgtctttttagtagagatggggtttcactatgttggccaggctggtctcgaactcctgacctcgtgatccgcccccccttggcctcccaaagtgctgggattacaggcgtgagccaccgcgcccggccagctcaggatcttttgggatggtctgttcacctcgcagaagtggctggcatgagcaataggagcccagagtggaaccagggccttctggttgtcaagtggacttgctgtgtgacctcctgtgagtctctgccctctctgagcctctcactcctcacctgagatgagggagttggctgaggtgatgccgatgcccctcacagctttgacctcctatgattcaggggcctgtgtgtcacctggtggcacacagatggcagggagggtgtgagatggccacacatgggtatgaggcagagccacagccccccccaacacgcacatgggctagtcactgggacacacacagagctcactcacggccacagagtgggcgtgggtttccctttttccttgtttctgtttctcttagcctcggcgcctccctccctccctctctctctctctctctctctctctctctctctctctggctcttttagccttggtttgttacaatctcccttttcaagccagcctctgtccctcctactcaacctgctttatctctaggccttcctccttcctcttccacagtctggcttctcacattgtcactctaggtatgcacttcccattgatttcctcttgctcagtggcctctcatcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacggtacaattagacagagggaaagggagggagcccgggggtgggggtaggggagggtggagaagcttccggactccttggggttaaaagggaaggtcccgccaggggtccctgggcagaggataccagcggcagaccacaggcagggcagaggcacgtctgggtcccctccctccttcctatcggcgactcccaggtgaagctacctgcaccccacccgggttggggtggattgcgagaggatgggtggggacccccgggccacaggcaggagccggcttagagcctcggtttctccacctgcgggacgcggaagtccccccgctgtgaggttgagaaagaggctcccactggctccgagcctcggatccccaccccgcgcgtgaaggagggggaaacctcgggcgcggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggtaaggtcgggggcagggggcggggagaggcgccggtgggaggcacgggcgggaggagaatgtgttcccgtcaccaagccccgcgcacctctcctcccccgagaccccagcacccacccagcgctccggagcacggcccgcccccaagtcagctgggcccttcttctggctcggcccctgggtgacccgccccactcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtgacgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcgtgagccaccgctcccggccacaccaccgtgttttatcctgagtcttgccttaccgctttttgccctctcccctcactttttttcttcctctttccctttctctctcttttttctttttctttctttcttttctttctttcgttcttcttttccttccttcctttccttccttcctttcgtttgtttcttctttcttgttttactttctctcttattttttcttctttctttcttgtttttttctttctctctctttttctttccttcttttttttttttttttttttttgagacagggcagtgctctgtctccgtggctggagtacagtggcccaatcagagctcactgcagcctcgacctcctgggctcaagcgatactcagcctccagagtagctggtaccacaggcatgcaccaccacatccggctttttttttttttttttttttttttgagacagggtctcactctgtcgcccagactggagtgcagtggcccaatctcggctcattgcaacctccacctcctgggctcaagcgatcctcccacctcagcctcccaggtagctgtgactacaggcgcatgcctccgcgactacttttttgttgttgttgttgttgtttgtttgtttttgtagagactgggtcttgctgtgttgcccgggctggtcttgaattcccgagctcaagcggtccaaccgcctcggcttcccaaagtgctgggattacaggcgtaaaccactgcgccccacccctctcctggttttcaatcccgttttgttattcacaccccttcctctccccgatccccgagttctatccccgcacccttacctccccgccgcgttcaatccccgcccctctatcgaccagcgacgttctagccagctctccaggcgcgctgcgttcagtccctgccctccagacccaccctattctgtctcattactccacgctaccctatcccagcttccttccactttcacgcgcttcttctcctcccattcccttcggtgcacgcgaaacccccaatatttccctaccaccctcgcgttctggctgcgtcccccgtccccgaacgcagtccagtgccacagcccagctccaaccccaaacccagaccctgccctccgtgctttgattccgtcccctttctttctccagccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccagggggcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaaaattttaaaaaaattaaaaaaaaaaaaaggctgggtgtggtggtgggtgcctgtaatcccagctactcaggaaggaggctgaggcaggagaactgcttgaacctgggaggtggaggttgcagtgagccgagattgcgccattgcattctagcctgggtgacaagagcgaaactctgtttcaacaaagaaaagaaaaagagaaaagaaaatgtggaaggcttacctaggtgtccaggcccccagccctcctcaattcctacagatcctcagagctcaaacaactgattcctcctccccatgtccactgaggtccccttctcccacaaggccctcttccctcagactcttcctatctccaggccctgcttcactgcccacctgctttcccagtccctgtgaagggtttgccttcacatgcctcttccttcccccaggccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagaggcaagagctggggctctgaggccggaacctcaggaggagggggctgagggcctgaacccctgggtctgaggaaggatgggctggggactggattcctggatctgagggaggacgggctggggtcctagatgcctgggtctgtgagtctgaggggaggaggggctgggggcctggactcctgggtctaagtggggaggggctggggccaggattcttgagtctgaaggaggaggggctggggcttaggatagaaacggtcttgtatctggactcctggctccccaaggattgggggctggacccagggattactggcatattctcccttcagtgaagtacaacaagggcctgacctgctccagcatcactatcctgagccctaaagagtgtgaggtcttctaccctggcgtggtcaccaacaacatgatatgtgctggactggaccggggccaggacccttgccaggtagggtctgaacagggagagtctctgactcctgggagggaggacagggaggttatgggaaaagagcagaccctgtgcccgatccccaactccattcccaaacccatccttgaccccaactcttacccagacctaaccccctcctcatccctatcctcaatcccatttccatcccaaccccaccccattcccatctccaagcccattttcatcccctcaccttccatgaactacaatcccaaccccagtctcactgtgccttcattctcatcccccagcccaacctcccataacctgaagtccacct

SEQ ID NO: 730 - DNA, 131860 bp, Human
tttctcctgaacatacactcattatgccccctacacagtagtttctctttctcagcccaacccaaatatagatgatcacaaaagtcacacaacagtcacacacaaagaccacagtgtcaccacacacacaatgtttttatctcgatgtctcttgcaaactgggttacacacaaagttgtaccaaatcacagccatgtccctcttttgtgtgggcacgtacaacacacgcaaactacaccacaaaaacccaggattttttcacaacttgtttacaacagggacaccacatttctttctaccacattaacatgcatgtacaacaggacccaaaagtggagatcacacatcacacacacacacaggcaggctgtcttctgttccttcctccttcccttgacctcacaaaacctacacgtggagacagtgtctctcctggacctgcaaattcacacgcctagagagccacggctccttctctctgctttgctaccattccctccctcacccctctatcacggggacacacacacacacagcaacaaaccccaaatacagcggacacacacacacagcaacgaaccccaaatatagcagacacacaaacacacagcaatgaaccctaaatatagcggagacacacacacagcaacaaacctcaaatatagcagacacacacacacagcaatgaaccccaaatatagtgcacacacacagcaacaaaccccaaatatagtagacactcacagcaacgaaccccaaatatagcgacacacagacacacggcaacaaacctcaaatatagcggacacaggttgtcctgaagtccctggacggcaacgaatcccaaataaatcagtcagggctttccttcacatataaacacacgggcacgcggaatccacccctcccccactttctgtctcctcatctctcttcctctcttacacacacacacacacacacacacacacacacacacggcaacaaaccccaaatataccggacacacacacacagcaacaaacctcaaatacagcggacacacacacagcaacgaaccccaaatatagcaaacacacacacgcacatatacacacagagcaacaaatcccaaatatagtcaggactttccttcacacataagcacacgggcacgcggaatccacccctcccaccgtttctgtctcctcttctcctccctcttacacacacgcgcgcgcgcgcgcgcgcacacacacacacacacacacacacacacacacacacaagcagctgcagcgccccgggtcacactccagtgcaggagccaggcaggagacaaaggtcgccgaggctcccggcggccccaccggacacaatcgagcctcttcccggttctgctagctcccaacgccggtctcggcaaggtctggaccctgcgccccgaagcaacaactcccgcctgctcctgccctccaggttccccgcgcagcccgggcagccgactcccagcgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatggtgagtgctgcgcgcggaggtctggtccggtccagcccagcctcgacggtcgcgggcagcggtgccgcgggtggcacccggggccgccctggctcgcggggggctgggcgccggctgcagcagcagcccccgcccggctctcggaaggcgtggagtcggggagcgcccgggcagagcgcggctctcccggcggcgctgcgcttggtcccgtcgggggcggccgcgccgagcttggttctggtcccagccggatgtggggggctcggggtccccggttcgctttggggacggttgctgcggtctgttttgggttgttctgaagtccctggactcagcttggcttggagacccagggcagccgggctgggtcgggctcgcgggtggcggcgatttcgaggtgcctggatgcagctggacctgagcgtcccgggacactgaggtcggtctggggctcgccttggggcactgtgggtggccacgcccggcgcattcggagggctaggttgcggccctctgggactgctgatccagctgtggcctaaggggtgtatgtggtggcgacgcagctaggtcggtgctgtcagagaccaggggacactcaggggccctgcacccagcgatccggtctccccagcatctcccggtgatgggtcctcagaggaggggcttgctgaggccgagtgctgactgcgataggcaggagtaccagggagaaagggaactggggaggggcgtttcatggggctctctaaagccccagaagagaaatccatttgatccaggctgggcttcctgggggggggctgttgggaggggcattgtccctggaccccaagagcaaaggccctttgtccacttgtccagggccgggtgccggcctctccatcacgggaagggagccatctacttctctttggtttctttccctatagacgagccactcggattccctctcctagttctgttctgtgccctgtgaagtgggtcaaagtcaccatgtagggctgaggagggcatgtgcctgggatggtggctgccagtacctgtgatccagcccctccacttctctgtgatgatgctgccaagcccgagggcgcctggatgggagcaggatgggaccccctgtaaagccgaagagtcccacagtggttcccagcccctgctgtgcccagagctggagtccccttacaacccgcccccccatctctcccttccaaggcctcttctcacccagctagggtcttctttgcttaggcaccgccagttgcctcactagagtcagaagtggtggaattatggcttagttctatacctgaaggtgcttagagaccacgtgagactcaacctacctcctccattaggaatctcccctgtaatgccccacccagaccgtttccgacacagggagtgcactatctgtggaccagcactggatttaaagtctcagtgtatgggcaccaaaaggccgtgagactttgaggttgtatgatcccctctgcctctaagcccaccctgagttactcataaagaaaattttttcttccttaaaaaccaccaaaaaaagaaagaggtcccctcactttgccttggtgacactttatagatccttacaactgaagaagcccaccagcctattgtgaagagtccaggctttgacgtcacaccaatttgtgtttgaaccccatcccctccacttccccacagggactttggtctaggtgaagcatcacccttgagtttcagtttcctcatctgcaagatgagatgataacacttacctccaaagggtgagataacccaagtgagagtgctttgcttcagtactgcttagttttcttttccaagcttgagcccacgctgggaagttctacctaacatctaacctatttgccccaggggttgtctctggaatccaaaacaaaagtctgtcatccatctgtccagggctatgggctggcttttccagcacagggacagaggccacctatttgctggtctggaagacgaatgaaagtttatcatgttgtagggaggagaccgtgatactttcgtctgtcatttagccaggacgtgttgaacacttactctaagccaaaccccatgtgagggaggaaagaattgactgaataaacagtgttatgggagcttccaccaggccataaacgtctgcactggtcctcagactttttggcacgtccttggagaggtagaaatatgccaggcaggggctctctccaagctggagagacgagagaaagcttcatggagcaggtgacatctgaactggaaggggtgtcccgggagggggacctgtgtgacagaggagcagaggtgtgagtgcacaggacaggctcctggaaaggccagaatggggctggtctggcacttggctatgaaagggtcaggaaacaaaagagaaagagggcaaaaaggttgctggggccagaaagtactaggctgaggaagtccacggtggattgttgaccggcggtgcatgcatggggtggcagctgatgtcaggcctccctggctcctgtcattttaatttcctctaaacattggttcctgtgctgtcattcctgaggcaggggtgattcgggactgatcaagtgtttattccctggatctcctgctccgcggcttttaaacaaatccagcactcacttctttgcagtgtggccaagttgtccttggcccctgggttcctaatgcggcgcgtttgcagggcgtgtgtgtgtgtgtgtgtgtgtgtgtgtgtgtgtgtgtgtatctgtgtgtgtctgtgtgtctgtgtgatgtgtttcctgttgtcctcactgaatctccctgatggtcaccagctccccacccacgtctctaaccccttggcagggagtcagtgctgttcttaagggcctcggatggaccgtctccccctgttttctcccagtgcaagccgtgggccgagggttctgaggaggctttttatgtctcctgcctccggttgtactcaaaccaccctgcagcaggcacagagaggtgaaggaggttgcccagggtcacagagcaagatagtaccagaacaggcacaaacctcctggacttttggaggggtaacctggcagacagttgggggaaggagacccaacccatcatcccccatctgcagctgtggcaccttgagaatgttccttcactttccaagctggggctgagttgaggctaccgctgagggttgggaatgctctttactatacagcagttgagttgagaacagggcccagggttttggtttgaatcctgatgtactaccagcttgctgtgtgaccttgggtcagccattccccggctctgtgccccctttcctacaaagtggggcagatttgctccacttctccagatattgtgagggtacaatgtatgtagaaacactgtgggaactattaagaatgtgagggagtccgggggcagtggctcacgcttgtagtcccagcattttgcgggggcgaggcgagaggatcacttgaggccgggagttcaagatcagccagggcaacatagtgagaccctatcttaaaaaaaaaaaaggtagggagaagcgttactgtttgaagataggagactaaccacatgcccccacgtcactctggtgcctctcagccactccagatggggctcccagagcacagtgcgtacttcaccctgggcagcctgtgcccctgctggtgactgggctactgaggcctccttacattgctacactcttttggtaaacaaggatgttgttaccttttgttaaagaataaatacattgttttccctgcagagttggggaggccaggggaagaacaggatttgaggcatgagagggctacaaggtgggcttggcagaatgttctgggcgttagcccagaaaaccagcttggccaagtccacactttcatgtctacggtgagagaggaaccatgagcaaatgtttacaattttttgtgcttctgctcaatttttttctctccaattgactgggtaagcctcctgccatagtcaaagggcttcattcatttgttcattcactcactcaccaaacaagtctgtctggcacaacacgaggcatgggggccgtggtcagtgtgagtgagactgataggtctctctctcccacagtctgatggacaggcaggcagacagatacagagcaggaaattacaagcgcaattactgttgtcagggagacacgcggggggctgtgggattggaccgggaacctgacctgaggatcagaaaaggctccctgagcacatggcattaaaatcataacctaaagagcgagtgggactgggaagagtgttggggggcggggggtggagggagcagaatgtgcaagagtacagaccgctgtgccttcagggatggttcatctggaggcacggaggactgtgcttaggaggtggccccggagggtgcactcagggatggtcatatgaaggacctggggctcaatccttagggcagtggggagccactcaggagtttattttttaaatttaattaatttacttatttattgagacatagtcttgctctgtcacccaggctgagtgcagtggtgcaatctcagctcactgcagcctcagcctccctggttcaagtgattctcctcagtctcccgagtagctgggattacaggcgtgccaccatgcgactaacttctgtatttttttagtagacaccgggtttcgccatgttgcccaggctggtcttggactgctgacctcaagtgatccacccgcctcagcctcccacagtgctgggattacaggtgtgagccaccgcacccagcctactgaggagtttagagtcaggggagtgacacggtcggatttgcattctgagatggtcacaggctgctttgtggtgattgagtagaaggagtgaggccgaaggctgggaaaccagtgaggaggcacctgaagtggccctgggagaaaggtggtgctgcaggcaccatccagtcctcctctagcccaaaccacgcccctggcatgctgcccagagcagtcagtgaagacagaaggaggctgtggccccagacagaggtcccagacagccccttctcctgaatgtattgacccttcccctcatcctttcaggcagataaccagccgagggccctggtctccagagcctttaatagaggagaaagaacaagttcccagatcgctctgaaataaggtagaaaatgctatgtgccaacctggggatgcagctccagagtcatcctgcccataggtgtgtatcagggaagccttcccagaagaggtgttaacacttggtggaatgcttcctagacgccaagttttggacacataaaaaattaggaggggggttcacttgtccttgaagagttaatagtctgaggggcacagtttaatgaacaaccagtgctggcggaaccccactgtcagggtggcactggagtccaggacctggggcctgccctttccttgggcccctgagggcagagtggctgggatgccccaggcctgtcttggtgggctgacaagcctaggaatggctccctcctcccaacagggcccctttggacttcctggggggaggtgtaaacaggggagcaagtttctagagagcattcaggaaatcggctaggtggggatctaacatcagggaggtgggcctggcttctgggccttctaaagacgctagagcgcttgtatgaaaaggggattaggaaccaccaacttcgaggcccctgtttgacaagtgggaagactgagagacaaaatgagcatctactatgtgcctggcacttaaatgtaatctctgctcttcacaccaaccccagggaggagggtgagccttatttcagagttgtaaaagctgaggctcaaaggtcacttagggaattagggacgggagctagacagtggctccccgattcctctagattattatggcttcagtcccaagctgccactcagtttggcagaaacttggccttcctgggaaagcccactgggacagggataggactgttgagccggtagccagaggcgttgagagctcactggggctggacactggccaggctcaaatgctggttatttattgttcacctttgcaccgcacttgacagttagaccttttcttccccattcaccgactgttcttggattcccactgccaatcagtagcagaactagaacttgaactcaggccttgtgactcccagcccagtcccccgccctgagatccccagctccccagctcagataacagcccctccctgtctggcaccacctggtcccctggcctgggtctccactaacccccacccctaacacctgatgtcccagcctttctgaccacatagccctctaagcaggaggagcagcccctggcccagaagcctcctctccccatcctcctcccacaagctcccttccctccttggctgggaaggcaggagggtgggcctggggcagcagccaggcagagttaggttacagcgtaaacacagtcatgtcaatatttacctctgcctggaagcagagcctcccacctccctgcctgactccctccagctgcccatccagctgcacatggcccgctcccaggctctgatctggtcattgaaagcaaggccagggtggcttccagcccaggctctgccactaatccttgtcctcctgaaccacggtcttccttcgtgggcctcagtcttcccatctgtgaaatgacatggctggagcagactgactccagggccgtcttcagtaatgacatgcaggatgacaagtataatactctcattcagaggatagactcgaagttgtgcaaatctgggtttgaattccagccccaccacttcctcactgtgagacttggggcaaggcacctaacccctttgagctccactttcttcctctgtaaaatgagagcctagcagtacccattttgtttgctggtgaggaatcatgagctatgtttgtagcacttggcacaggataaggtttgattaaatggtcatggtggtggttgtgattccagataaacattttgcgattctctgaatccagacacttggttgcgtcacttggaaactggagccaagggtggggactctaacctcatgtcctcctggtcctctgagaggccacaggctgggctggggtgtccaggggttgagaaagctccttggtcaataccacacacacccccagctgcctggccattggagtcccttcttattgggcggaggtccagggctgaaatgtcctcagagctatgtggccatgagagggatgagggagggcagagggggcagaaggggaaggaaggactcatttcctcagcagctctttcacagaagcttcgagtccattacacacatgagctgttccttccagcactggagaggagggggcgaggggcgaggactggctgcctccaggtgccacatctgagcaggcagtgtggggaggagagggcagggaggcgggatctgcccgtgcagcaggagtgggccttggagactgatgggcccaggttcaaacctggcatcctcactttttgcattgtcaccttggacagcgtgtcacctctctaagctttattctcctgtctctaatatggagctcctggggcagtattttgcccagtagttagaaacgctcaatcagatcctgtttcagagtagcccagctgagggctggcacatacagaggactcagtcggtgtcacctgctgttattgtcatgactgttacgatgatgacacaggatgccagactggacctcatgagggcagagattgtacgtttctaaaaattgtggtatagtataatttacttaagtaatgtatgcatatcttgtacagctcacgttttacaaatgcacacacctgcatactacctggaccaaagtgtgaaccattcccacagttcccgtgtgcctcctccatcagtcccctgcagcaggtggccactggccctctagtttggcctggttttgagctttctctgtgtggattcattcatgtgtgctcttttgtgcctggttttcttcagctttggacagcaaggaatgtttgaggtttgtccgtgtcgcctgtaccagcatctgctcctttttaggctgagtcgtgccgcattgggtggatgtacgtgtaaatgtccgtggctgacatttgggttgattccagcttgaggctgctgtgacattctcgtatgtaactctttgcagacctcagcactcatttctttggggcacatacttaggagtgcaactcctgggtcagaggggcaatgtgtgtttaactttctttttttgttgttgtttttttgagatggactttcactcttgttgcccaggctggagtgcaatggtgcagtctcggctcactgcaagctctgtctcctgggttcaagcgattctcctgcccctgtctcagcctcccaagtagctgggattacaggcgtttgccacaacaccaggcaaattttttcttttttttagacggagtctcgctttgtcccccacactggagtctcgctctgtcgcccaagctggagtgcagtggcgcgatctcggctcactgcaagctccaccttttgggttcacgccattctcctgcctcagcctcctgagtagctgggactacaggtgcccgccaccacgcttggctaattttttgtatttttagttgagacagggtttcactgtgttagccaggatggtctcaatctcctgacctcgtgatccgcccacctcggcctccgaaagtgctgggattactacaggtgtgagccaccgcgcccggccacagccgactaattttttgtagttttagtagagacggggtttcaccatgttggccagcctggtctcgaactcctgacctcaggtgatctgcccacctcgtcctcccaaagtgctgggattacaggtgtgagccaccacgcccggcctcagtgaatgttttttgttgttttggttttgagacagggtctctcactctgtcacccaggctggagtacagtggcatgaacacagctcactgcagccttgaacttatgggctcaagtgatcttcccacctcagcctcctgagtagctggtaccacaggtgcaccactacacccagctaattttctgatatttttttgtagagacaaggtctcactagttgccaaggctggtattgaactcctgggctcaagtgattcatccaccttagccttccatggtgctgggattacaggtatgagacactgcctgtctcaagtgttttttgaaagaaggaagaaatttgagtcctttctttgtcttaatgccccagattcactctgtagccctgcccctgcccccagggcctggcagttctgggctggcactctgcccagaccctgggctttgggcttcgcctgctgttctgcagggtagggaagggcctccctccctggagacccactgattggctgtgtgacctcaggcaagtcccttcccctccatagtcctcactttccccttccgtcaagcactgggtgggtcgaagcttcccagctccctgtgtctgtggtctccctcatttgggagcctttgctcctggtgtttggtgcctcttcacccccagggtctcacccaccccaggcaggagctcagctggcctgtagcttgcagaaggaccatttgggaaagctggtgggcccttcattcttggtacccgccctaagagcctcactgcgactctgtccaccctgggtgagagccctccagagtaggcccccagccgtgagagccccccacccactgaggcttggcatcaggtcgccctcggtctgaaccctgctattccctggctctgggactttgggcggctcaatccacctctcagggctgcagcgtcctcatcttcagggttgtgagcacccaaggaggccctgcctcattgtggggacagaagagaatggagcagtcacatgcctgcccctaaggagctgcactctaggggaggaagctggagaccaaacaggcaaagccacccaccagaaggatcgctccgagagaagaaaggagacaaaacagggcgatgtggtggagagtggctgtgaggggagggggccgctctagaggagcggccaggaaaggaggtgatgtctgagctgggacatgaaggttgaggagggggcagccgggcaaagacgggggcgggggagatgagagttcccggctgccggaacagcaagtttggcacatgtagggggtgaacgctggtgtggccgggcagaggcagtggagggtggagggaaggctagggagaggtgggcctggaggggcaagccatggacagccttgtctgtggggcaggggtcagcatttcgttctaatagtggtgggaagccactggaggaccccacgttgaggggcgactgggcttggtttctgtttggaaagaccttggctgctgtgtagagcatggactgtagggggcaggagggaggcaggagcgcgggcctcaggatattcgtctgtcctgaggctgaggaggcgtaggtttctgcaggatctgggattttggctgctacttcagggatgggagagaggtagccaggcatcccagatgcttcgagaccttgctggcagcagagcacagtgggcaaaagttacctgtggagccagacagacctgtctgaacctccacttcaactcagccttccggggtgggcttgggattctcccagagtgaccagttcccaccgtcccagcccctggggacccagagaaacagagccagagggcattgagctggagcctgcctccctcgcttccgcacaccctgccgagaagtgagggcataggaagtgatggccgcaaggggatgcccagcccctctgctccagggctgctgttcacacggccacgctggagggaatcctgtggctttgtggttccttgtttcctgggctggtctggtggaagatggccatgagaaagcggcacttcatcttccttcgcccctgagtgttcagtgggtggttactcggcatcctgttgggcttccggtgtggtggctgggagccagagagaggagggcatgagagctcacagagtctcaggaggtgggacttggaggtcatctaggccaacttcctcatagggcagaccaaggctcacaaagggaaagagacttacctgaggctatacagcaggttagaggcaggacttagaccctgattctagactcctcatccagcactctttctagataagatggaggtatggaggttttggagccagacagatgtgggttgtagtcccagctctgtcacttagtcccagctgggtgacctttggtgagtgaccatctctgagcctcggttttctcctctatgaaatgggatgatggtagcacctttctcatagtggtgttgtgaaaagtggttgataatttatgacaggttgtaaagctcacaggacggtgcacggagttggcccttgggaggtgggagctgttattacctttgtggctccgtcatttttttttttttgagacggagtctcgctctgttgcccagattggagtgcagtggcacgatctcagctcactacaacctccacctcctgggtttaagcaattctcctgcctcagcctcccaagtagttgggattacaggcaggtgccaccatgcctggctaacttttgtattttttagtagagacggggtttcaccatgttggccaggctggtctcgaactcctgacctcaagtaatttgcctgcctcggcctcccaaagaagttgggattatgggcgtgagccactgcgcccagcccgtggctctgtcatcctaacctcctgaagcaccggaaagaatggctgcgtgctggccctcacatatgctgttttctgatgaacgcggttagggagggaagatgagaatgggccatggttggcccatctctctgctacttattttatttccccactatatttgagagactccttagccaggccacactactacccacccacccccccgccccccccacggctctggtgggctggagctgtgctgtctgccttcagcccaaataggggtgggggaggcggaggcactaagtgcaggtcccgggtgaaaaactgggcagctccccccaccttctgcatcagatccctaccacgcaccaccaatacctgtttgttcagtgtgacctagtggttaagaccaagggccatgggatcaacttgagcttgaaccctggatctgccattgaattgtcaccaaggacttttagcaggcgtgtcttcctctctgagccttggatttcccatctgtgaagtgaggataagtccctcccaggaagactgcaaatattcagtgagaggagcagcactcagagcatgcatggtgcatatctggtgctagactccaagaattggatggcactaatattgtaacagtgttgacacatgtcccaattgtttctctttccatagctgttcttagaaacttacttacccatccggcccaccccacccccatcctgtgttcccgcagcccccttccctctaactcctcgcctgactgacttctctcagggtcaccttggactgaaatctttctccccctcccctcccctcccctcccctcccctcccctcccctcccctccctcacctcctctcccctctcctcccctctcctcctgtctcctccgctctcctcctgtttcctcccctccccttccctcccctctctctcctatctctctccccccctcctcccccctccccctggactaacacagatcaagagttcaagctctggcccagcctgcctgggtttgaatcccagctctgccatttactggagcagcctcaggcaaagtacttaattcttagcctctatttctgcataagtaaaatgggaataaggatagtgccaagcttagagagttgtttaaataagcgacgagattcttgtaaagtgccaggatcagtgcctgcagtacactaagtgcctaataaatgtcacctgatttattactaggcagggttctgatggagcagagcccctgccttttcacctctgcgttcccagtgtctggcagggatgggactggaagggatgcaggctctctaggggtttgtactatggcattggagagttgccttcccagtgaagcaggcctctccagaaaggggaagggactcgggccacatcttaagcatgtctgtctggcagatatttcccacaaccctgctgcacaccactgggtgctgaggatggggtgggggagggtgcagtaaggctgcccttagtgagctcaagtccacggaggaaagtgggacaaaacggccctgatactatcagagaatgaccagcccagggctggcaggttgcttctgaggaggctcctgggagtggtgatgtttgatgtttccttgtgggagtgacatagtagtaacttctgtctgcattagggctttattcagtaatcctccattctttcctgcccgcggtgttttactagtcttagcagtaataataatagcgtttcttgagtgtttgctgtgtgccaggtacagcactaaatattttatgttataaatttacttaatcttcacatcaaccctgtgaggtacttattattgttattcctgttttgtaggtgggaaaactgagggacagagaggtaatgtatctctcctctcagtcagtaattggcagagctagagtggaacctgggcagttttggctacagagtctatgcttttttttttcttttttttagcgaagtctcactctgcctgtcaccctggctggaatgcaatggcaccatcgtgcatcatggctcactgcaacctcaacctcccagactcaagcgatcctcccacctcagcctctcgagtaactgagactacaagcgtgcaccaccatacccggctaagtttttattttttaattttttaatttttttgagacagagtctcactctgtcgccagtctggagtgcagtggcacgatctcggctcattgcaattgtcacctcctgggttcaagcgattcctctgcctcagcctcctgagtagctgggactacaggcgctgcaccaccacgcccggctaatttttggatttttagtagagatggggtttcaccatgttggccagggtcgtctcgatctcctgacctcaagtgatccacccgcctcggcctcccaaagtgctgggattacaggcatgagccaccgtgcctggcctaatttttttgtagagacagggtttgctatgttgcctaggctggtctcaaacttcgggctcaagcgatcgtcctgcctcggacccccaaagtttgggatgacaggcgtgaaccaccacccctggctgaatccaacttgtgcttcctccataactgacttctacccagctggtcgtagtccttatgatcagccagtctcatggactctgagtgcctcaccttccatgagagtcctttgcagccagcaaagggaagaaattaatcttaggtcttcctgtacagcctgtgttcagcatcagctcaggggtgagcggatagggaccttcaaggaagggggtgtggaagtttaagacccagaaaggaaaggacctgagtcagggggaggaagaaggattagcctaggaagcatttaatggggagagaaaggaaactcagaaggctgaaaaagttggaattcaaactgaagcaacatttgctgagtacgtttcctgtgccaggcatggcagtgtctgtgccttccaggagctcccaggcctgtgggagagatagataaattagcaggtaaattgctgaatagtatttggtgaggtcagctaggggcggtagctcacacctgtaatcccagaactttgggaggctgcgatgggtgggtcacttgaggccaggagttcgagaccagtctgggcaacatgacaaaaccccatctctacaaaaaatacgaaacaattagctgggcatggtggcacgtgcctttggtcccagctactcaggaggctgagaatcacttgaacccgggaggcagaggttgcagtgagtggagatcatgccactgcactccagcctgggtggcagagggagactctgtctcaaaaaaaaaaaaaaaaaaaaaaaaaaagtatttggcgagtatgtgggcaggagcctttaaaggcccagaggaataggacctgggagactctgtctcaaaaaaaaaaaaaaaaaaaaaaaagtatttagtgagtatgtgggcaggagcctttaaaggcccagtaacttggtccagggaggtgatgtttgagttgggtcttgaaggatgggtaggagtttgccagccaggcaaagctagtagtagcagagccaaaatttaaacctgaacagtctggctccagactctgtgttctttcctgcagcatgcttggccctgctgccctacaaggcctagccttgggaggtgagactctgggtcctgggtcactccacgtgagccctagaccattttcccatccaattcctgcttttgctcttcacaaactcccactctctcccccttctgcaaaggtggttgggagttgactagccttgtaggcagtctgtgtctctctaagtgactaggatttgtggtgtgctgagaagggtacacagattctacccgcagttctcctgtggcaggtaggaggcacagacagacagagaagcatttcctggtttgtttttccactgtttgccccgagcacatgaactgtgctttgcataaggcacctcctcagatcattgcaacaaccctggcaggtagaggtaatttactgccgttttaagcatgagaaaggtgactcacagaggttgagccatgtgtccaaggtcacacagctaagccagtaagtagagggactggaatttgcacctcaatctaactgcaaggcctgtactcgtgtttttaagccatcaggaagaataccaggttatgaaggccacgcccctttctggtgagtctcacctctgtgctggtaatcaggacacccaggaattgcaagtcggcggtagcaagcataaggttgcattgatttcagtgcttctcaacggacatgtgcatgagaatcatcaggaatgctggttacaaatgcaagtttcattgccctcatcctagaggttctaactcagtaagtgtcggggggagggtccaggaacctacatttccagcagaatgcctgattctgatgctggtggaccatagaatatgctagaaatctaatttattacatgtcttctctgggtccaacactatcctgggcattttatttggtcacttcagccatcagaacatcgcctggtagggggaatggatgcaaagggaggtgggagtctagagagagattcgcagcagtcatgatgaacagccagcatgtccattccacctttagatcaattggataaggaaactgaggctcagagaggcggtaccttgcccaaagcttgtggtggcagagctgggattagaaagcagaccctcagcagccgaggcctgtgttcctcctaatacccaacgtggttgcttttgcagacttccacacagagattcttttttttttttttttttttttcgagatggaggttcgctcttgttgctcaggctggagtacagtggagtgacctcaactcactgcaacctccatctcccaggttcaagcgattcttctgcctcaacctcctgagtagctgggatcacaggcgcccgccaccatgcctggctaattttttgtattcttagtagagacatggtttcaccatgttggccaggctggtctggaactcctgacctcaggtgatccacccacctcggcctcccaaagtgctgggattacaggcgtgagccactgcacctggcctacacacagattcttggggacatctgccaaatatcagcataggtaaatgtgggatgatcagtggtggcaatatctaccatttactgaggacccactatgtgccaggcacaaggtctagaatggttagcaagcaggcatggtcttggacagttgcacagatctctaactataagcaggttgctatgggagtttatgtcagaggagccatccctggcagagagcaggagcagggaagacatccctgaggaagaaggatttgagaagagatctgaaagatgtgttaagtgttaaccaggcaaataaatggagagaaaaagagtctaggctgtgagaacagcatgtgcaaaggtcctggggtgagtgacctatagcagcaatctccaacctttttggtgccaggcttcgtggaagacaatttttccatggacagggtgtgaagaatggtttcccttatgagaatctaactaagcccgatgatctgaggtacatgaaactgttccacctcagttcatgttagttagattcatcaccttagttagattctcatagattctcataggaatgcacagcctagatccctcgcacgtgcagttcacaatagggttcgcgctcctacgagaatctaatgccaccgctgatctgaccgaaggcagagctcaggcggtaatgtccacccacagctcacctcctgctgtgcggcccggttcctaacaggccatggactggtactggtctgaggcccggggggctggggaccccagctgtgtagctggagtagagaggaagggtgaagctgaagggtggtcagggctgggtcccgcagggccgtgcagaccaggtgaggctttattttcctctataccaaaagactccatttgtgccctcaaagtaagaaaaggcaaaaatgtgtaacaagcagggtggaggtctcccggctctcgaaggggtgtcagcagggagctaagatgatccaacttgacttgagtggggagggcaagagtggcatcagaaaatggtggtggctttgcccaggccagtggtagtggtgagggagaggcagacagagaaactgagtagagtgggcagggcctggtgattgattggagtggggcaggggatcagcccatcgctttgacaaatgagaaaacagagcccagaaaggttgcatgagccaccggagtcacacagtccaagcgttagagccagacgctaagctggagcctcccatcccagggccttccagccaaacatggactccaggccccagattcctggcagctgctctggcagagtccctcttcccagtctcctggtggcttcgtccctccccatgccctgctgcctgcagagtctggcagcttcaagggagtggggtgctttgaagcatctacagggagggcagtgctgtgacctccaaattctttccatgtgacctatgcgaccccagcgagaccagggccctcaggaccctgccctccccaggctttgacggagtccacagaggtggggtttaggggccagagccactgtgcaaacacagccccttgctggggagcgggggtgtttccagggacccgagctgatgccctgtcatgaagagaaaggagacgcaggggccaaaggctggggagaccctctctgtgctcagtggggtctccccagcagcggggagctgcttccccatccaggctccgtaactgcaggctgctggctgctgtcttaggatttctgttttcttccctgatgtcaccccagttggcacctaagacctctgagatgctgctcagttaaatggattcttagctctgcaggcctcgccccacctccctacgctgctccaaaccatccccctcctgaaaccagaaatataacccccctattatgaacctcatctcctcgaacctgagcccctattttccttaagatttggatctctctttggggttcaggccccccttttttctcactaggttctaggacctgcttcctgcttaggcaccttcttctccctggaccccttcttcacccttagaccctggacctgggtctgatccctctctggggactggaggctctgctgtcttagagaccagcacccccgacacacacaccccacggtctcccaggtttctctaacccccaggggcttcacccttctcagcttgacacacagtaggcactcaagagacaagcttgatcctgccaccccttctcccagccctccccatttgtggcccctcctgtacctccccaccctcccccgcatgggtatttttgctcagggagctcgtgctgtgtggcagctgagtctgggaagcagctattgttggctgagaacgtggggcggcagaaggatgggggctgagaggaggcaggaaacatgctcataggtccaggcccagccccctggtccccacaccccactgggtccaggtgaggccattttaggacaagtcaaagaaagcccccttcccacagccgggagctccgttgtggaaatcactgcgctaggggaagctggcagcaagtttggaaacaaggtggctggcgaaagtgccaccggcagcttcggagagcagccggggcaccccttgagcctctgggtggcgtcgggacagtaggcaggactccctgtgtgttgatgctctgctgccgccccttctcgttgcttctcgtacctgtttcatgtctgctccgtggagcaggaggtgggaaccacaatttattgagcattaactttgagctaagctgtgtgctgagcaatgaatgcattgactcaattcatacctcagtcaactccaaggaagtgggtcctattgtgtccccatttaataggtgaggaggctgaggcttggtgaggtgaggtgactcggccaaggccacacaactcctgactctgtttttgcaggcttctgtagagcatctgacttcaaggctgagtgtgttttgcttgtggctgaaaaagaccagggacagcgaggagggaggaggccagcaaaagaggatgagaagcctgcatggggagcagggagtgccctttctggtgtggggacaggcagctggaagcaaatttcaatctggatgaggaactggcactgttctgtcctctggcccctcttgccccttaattgtgacgttacttctcaccgctgaaggggaaccgctcgagacgctggcttgtcctggcacctgccttgagcagaagctcagagaaagatgcatggagggaaagagtggggagcagaaacaagccatcaggtaccaggttggtggtcctggagccagtttatggttcatctagtcacaagggccacgtctctgtgtttagtgtcagctaatgaagaaattgaatccagtacacaaaattggattttgcagttttgcaaccagtctcaacccccctctattgtgtaacgtgtttctttagagaaggaaacccacaacaaaacatgtgtgctttcctcctggcgacctctgatacctccattgaagacatggcttaacgagaactgtttttctccttctttcgtgatttgtgacttttcttgcaggctccaggtggcagtgagtcagccataaagctcgttcaggaaagtccagaggaatttttcttctgcatcaggttcaacttgagcagtgctgggtgacgcccagtgacacactcggttggggaaggagaggctggcacactccactagctgcttatctctgccacctccgcctccatttgtccctggcttcctggggcccagagccatctctgccagagcagggaggccgattaagtgacccgcgggctccttctgcctgactcagctcagctccagccctctctggggagaatgagtcattttttcaaccctgaaatgtttctcttcatgtgggaaaggggcgggggtggggagagcccctcctggtcctctccaaacttgttcctcagctctgagggacacttcagccacagacaaagggattctagggcagctctggagagggcagtcagacctgaagtcagtaaaccacagctgtggcagccgttggagtctccctggacagaagcacactgggctgagtgggtggagtgtccctgtcagtcccgcactgatggatggtttctcccttggggatgggcctctgccccctgcttcctctgcccacccagttaagaagctatatgagcccgggtgtggtggtgcacatctgtagtcccagctacttgggaggctgaggcaagaggatcgcttgagcccaggaggtcaaggctgcatgagctatggtcgaggctgcatgggctatggtcaaggccgcgctccagcttgggcaacagagtgagaccttgtctctttaaaaacaaaacaggccgggtgaagtggctcatgcctgtaatcccagcactttgggaggctgaggcaggtggatcacttgaggtcaggagtttgaggtcagccagaccaacatggcaaaaacccatctctactaaaaatacaaaaaaattagccgggcatggtggtgcatacctgtaatcccagctactcaaggaggctgaggcaggaaaatagcttgaaacccgggtggtggaggttgcagtgagccgagattgcaccattgcactccagcctgggcaatggagtgaaactatgtctcaaaaaaaaaaaaaaaagaaagaaaattgcccccatctcccattttctgtctcccttcactacctcattgctccccttagcccctcccacagtctaacatgctgcatatttgatttgtcttatttattctgtctcctactagcatataagtttcatgaaggcaaggcttattttattttattttattttatttttagttttttgggacggggtgccactccgttacccaagctggagtgcagtggcacaatcacagctctttgcagtctcgaactcccaggctcaggtgatcctcccatctcagccttccaaagtgctggggttacaggcatgaacactgcacttggcccaaaggcaaggattttgtctgttttgtttcctgctatatctgtcgagaacagtgctaacacgtagtaggcacacgattttaaagagggtaagaggaaaatgaatgagtgaatggatgtgagcccctggcagagtatccggcctgcagtcagggctattgtgtattttgatccataaccctccccccgccggttccagctgtgttgttctgggaggctagggcctttctccacctacgccctcaaggtcagcttatccactcttgaggtttcatgcttaatttttatatttgagcttctcataccagtgtgtgagattgccctggggatcagagtagggtacttgcatcataaaataaaaaggtactattttggagcagaatgcagaattggcatgaatttttgagattcaaaaggaaatgagacttaagcttttttcacagcttttagctgtgtcctcagtcctgccagggcacaggttgactctcctctgccatgtgggtgctttgggaaagtgtaagcagccttgtttttggaaatgaccccaacccctgagccctgggacctgccctccctccaaagccccagtgaggggttttcaccaaacatgcacaaattccagcagagggcggatccatgtgcgtcctcttccgggggccatgcccacttcccttcccggcctccccgtttctttctctcagcagagtgctagatcagaacctcttgtccttcctgacaagaggcccttgtctgtctgccccctttcctgtgcctctcctctccatcgctgggttttcttgtccttttccccagctaggtggttagatcaacttccaacccctcagggccaaacagtgccaccacactggtgtccccatcccctatgccagcagtggcactgccattttggtcacaggcctggggccctggagtgtgacacatgtggggggcctggcacagccccaacctgtgcctcagcctgcgccttgcactggccaggtgagaagggctggttgctctcctgcccccaaagaacccactggtgtttccatggcaactgtgcagccaggctgcctgggcgtctgctgggctaagggctaccaagtcctccacaaggtgcccatggttgtgggaatggaagcatttgctagaggtgggtggcactgacctgtccccagccgttagggagggagctgcactccgggctcaggtggggtgtggggtctcctggttttatccacacccccatccccactccatctcactgagaagccgccttgccacttctttctgagcccctgtttcttcatctgtaaaaggggcatataatgctgacttcagaagttgttccagctcccgacatgagccaggtggggcagcagtgagggagcttcaggcagaggaggagggagacaagaccagaccaaagggtggccggggacgcagctctgtttcattcggacctgggaatcacaccaactggccccttccaagcggtcttagatcctgaggaagcattcttccctctctcagcctcagtttctccttctctaaaatgaaaatagggtgggcacggtggctcatgcctgtaatcccagcactttgggaggccaaggtgggtggatcacttgaggtcaggagttcgagatcagcctggccaacatggtaaaaccctgtctctactaaaaatacaaaaattagccgggtgtggtggcacgtgcctctaattccagctacttcggagactgaggcaggagaatcgcttgaacccgggaggcagaggttgcagtgagccgagattgcgccattacactccagcctgggcaacagagcgagactccatctcaatcaatcaatcaatcaatcaatcaatcctgtgtgacaggactgcagaaagaatggagaaagataataagtgcatgacaagcctggtgcctggcccaacacaccgtaggtgctcattccatattgattacttgtgaaggcacccatgggccactgcactggaaattgtctttcctgtggtcaggcctaggtccccaacagaccctcttccaggacatggctgctgggggccccagggctgctcctcccagtggagaattcctcttatgttattcacacagagatttccccaggaagtctgagcccctctttgtgtatcttcccagctgttatctgggcctcctgaaggcctgcctggctttctggtttatgttagggttgtttatatggggtcttatctctcccaggagcaggggccagcctggggagcagcaagattgtgggctttgagtcagagcaacctgggtttgagtccccagctccgccacgcactagctctgggacccttggcaagtgacaccacctcttggaacctcggtttcctcctctgtaaagtggggatggtagtacctccagcacagggtgatcatgaagattatgtgggaaaatatctgcgcggtgcctggcatgggttaaatgatgagttacagacagctcctttccccttttccaaaccaggaggttctgcagcagcaggatcctagaggctcagacccagggcaagggaagaccatcacagctcctcaaggcaccacctcggcagtaggcaggggaggctgcacagccgagctccacgctgctggcagctcccaggactccatggcctagaggaggctggggacctcaggaaccctccgcagaatgaaggaagggtggggaagaaagacacagagatgaggctgcggcccctataggagcttgggtgagtgtggaagataagagcacaggctctggaacagacacgtgcgtccttcagggagctgtgtgaccccctgtgagtgactcaacctctctgagcctcagttccctgtctatgcaaatgaaggatgatggcataccatatctcctggggttgctgcgaggcgttgataatacatggaaagtgcttagcacagtctggccaagaattttctatttatttttaggttgtattctcaggacccactgacttctggccaaactcttcaattactcataaaacagtattaaattttttttaaaaagcttatttctccagcaccttccatgagccctgcaggcaacgtgcttagcgcctacctctcattatcccatttgatcgtagcagtcctctgtggggttggccctgtcaccatccccattttataaatgagaagtccggtgacctgtttgagcccatacagctgttgacggctggagcctggagatagtcgtgggcggggttagtgtctcaccaggtatcagctggacgcagcaaacctcaaacagaatccatggggagaatctgtgaatgagcttgtccaacctgcggcccgtgggccgcatgtgacctgggatggctttgaatgcggctcaccacagattcataaactttcttaaaacattctgagatttatgcatgaacctttgttttttagctgatcggctatcgttggtgtattttatgtgtgacccaagacaatatttcttacattgtggcccagggaagtcaaaagatgggacgctcctgccgagtgtaaacagaagatctggagtggggtggggacacctgtggactcaagacagcctgggtggcgagtggtgtgtgggggctggcactagaagccatgggaccgcgtgtgtttgttcagcctgtctcagctgaactaatgtaaacacccagactgcttgttggccctctgggggaccaagacaaactagggaacagtgagccgtgcctcccggtgcctggtagggagtggcgagaatgaggagccaggtctcaggagaggctgaggagagttggacagggatggagcctggctttcctgcccagttcacagaggggagggcacagctgctggcttggagggctcccaggaaggccaggagcagaaagtctgagaagcagattgggggcagcagagggagtctggcccttggtgccgggggtgccctggtggacagaggtgggggcagcatggagccggcatttatggaggccctagtatgtaccaggccatttagacacgaggtcttatcatgtctctagaaaagccctgcgtagtccactttatgattatgattatgattatgattatgattattattattttgagacggagtctcgctctgtctcccaggctggaaagcagtgatgcgatctcggctcactgcaacctccacttcccgggttcaagcgattgtcccacctcagcctcccaagtagctgggattatagacgcacaccaccacgcctggctacttttttgtattttagtggagacggggtttcaccatgttgcccaagctggtctcgaactcctaagctcaggcaatccacccaccttggcttcccaaagtgcttggattacgagcttgagccaccgtgcctggcctcactttattattttgacttagctgatgagaaaacggagcccgggagattgtacagacccagctccactgaaaacccacagaatttggcttcctgggagggtgagtttacggaagcattttcggatagtattccttcgcatctgcctctgctgacgtcacatttcccatgctgactttcttctgaccctcgctcagcgtctcccccgacagaagtgcggcctctggggagctgtagctcttgctgcaaatcccctcccccgtccgctttttggcacactgcctgggggcctggccaggctgaagtgactgtcaggtcgggttagctccttggaaggctggtgtgaccaactcaggggtgtcgcctgcctctcacccagggaggaggattttgccacctctgcttggataggcttgtgaagtgggcctcaggaaggctcactggttctaaatcttcaaaaaatgggattttagaagttgctaaggcctgaaatatcaccccacccattttacagatagagaaactgaagcccagagcggagaaatgtctgccccaaagacagtgagaggctgaggcacaagggaggggaggtctccagggaggacacccctaggccaggctgacctttgttaagggagtgggacagggtcaggaaagggcagggatgaaggaaataagttccccaactgcgtcatgacctgaaacccaatttcacagctgctcccactctgctgccctccccaagctgtgccctggaaatgtccttgggccctcaggaacgctgatcagttcctgcacatgcgccagcagggtacttgtttcattgggtttgggtctctgcgagtccacacgagggcctcctgctccccacttgccacgccaggtcttgcccactgctctcccccaccgtttccctcactcttgttcatctccgagtccaacagctatcacttgagttgtgcagagctgggaagaatcgtttaaccgtcacagcagccagcgaggggacctcgtccatgccgtctgataccttcaaggtgcaccttggaggggcaggccctgctttgcatgtgttttgtccccacttcgagaaagagatcgcggtggctctgatttaagttcaagaacattggggtcacaccccgagcctggatttgaaccaggagacagacactggcaccccacaccttcggccacacctgctaaagccagggacctacagaagtcacatgacctgtctgagcctgcacagctcttgactgccctgacccactcgtgcgtctccagaggatctgtttggatgcaaggtggttaggaccccaccttgagttggggagcaggggctcaggagaggccgaagagaactgggcaggaatggaaccgggctttcctgcctagctcacagaggggagggtgtggctgccagcctggaggggtcccaagaaggccaggaacacaaagtctgagaagcgggtggggagcagtagaggggctccagccagcctgggcccatgactccatcccggtcaggggaccaagattgctcaatccccagagctgcagatgcgtcaccagctcagcgtcgccgcgggctggactggccttgtgacaagcaaacccttttccccatctgaggcctgcgagctggccttcccctctgtctgttcattttgggagaccctcccaacagcagcaggaacaatggcagccaccggatgccaggccctttgcagacacgaccttgtttaattctcagaagagtcccgggagctaacagtgggcgataggattcccacttcacagagaagactgggatcgcatggcagcaaagcacagggctggctcgaagcccaagtctgtctgacctattctggtgggtagcaaaatatctcagacatattaaaagcatcaggctcagtaaaaccaaacactggtatgtaagtgttcagcttaaggaataaaacatcccaaatgcagttgaatcccccatacccccacacccccagtccgtttcttaccactctctctcccaggggaagagactgggagagactcttcagtgactgtcttgatactgttactcctgacctcaggtgatccgcccacctcggcctcccaaagtgctgggattacaggtgtgagccaccaagcgcagcctgattctgcctccctaaatgatacataggtatgatgttgctcactgtttttgaactttcaataattgattggaggctccatgttgacttctgcagcttttctgtcttcctgttgtttgagttgcagccacttggttttcattaccgtgtagtattccatcccatgatgtggctctcctgtggtttatccaggctcctatagatgggcatttaggctgtttctcattcacaaccacagcacatgctgtgtgggacttccatattcatgtctcttggcgaccacaggagagtttctaagaagtatgtgtgttatgtatgttaagaactggaatcaggccgaggatggtggctcacacctgtaatcccagcactttaggaggccgagacgggtggatcacctgaggtcaggagttcgagatcagcctggccaacatggtgaaaccccatctctactaaaaaaaaaatacaaaaattagctcagtgtggtggcgcacgcctgtaaccccagctactcaggagtctgaggcaggagcattgcttgaacccaggaggcagaggttgtagtgagccgagatcgtgccactgcactccagcctgggcaacagagcaagactctttctcaaaaaacaaacaaacaaacaaaaaactagaatcagataaacccacggcatcatgggattcctcactgagagaacaggccaacaatattggggttgctgttctgagggtgaaaaaccccttaaggacagtaatgttcttctgatttgctgctgtaaacagcaccaagaacagtgtctggcgcattgtgtgcgtgtagtaaatctgttccctagacaagaggacatgtgccagctactgtggcaggtactcaacttacacagccgcactcagtcactgtgaggaggggttctcccaaatcacaggtaagctgactgtggcaccagagaggttaagtcccattcttaaggtcctacagccggtacccaggttgactgactccagaaccagcactctttcctgacgctgcctgtgtagacagagggagtggattcatagagccctagaatcctagaatatggggaaaatagggccagctttttttttttttttttttttttgagacagagtcttgctctgtcacccaggctggagtgcagtggcacacagctcactgcaacctctgcctcctgggttcaagtgattctcacacctcagcctcgcaagtagctgggattacaggcatgcgctaccacacctgtctaatttttgtatttttagtagagatggagtttcaccatgttggccaggctggtctcaaactcctgacctcaagtgatctgcctgccttggcctcccaaagtgctgggactacaaacctgagcccccatgcccggccaggagcagcttttaatgcctagttgcctatatacaagcccctaggactttccaggttgtcctagacgccgtgagggtgaggtggcaccagctggtagatcacctttggcctgggataccccagacattggggctgagtgacagctcatctctgaggttgatccattggggaactgcaaaggttgggaccccagtaggcatcggattcagctgcagttggatggaggtggcagcctgaaccaaccaaagaattatttgcttgggacatgagcagacctgggctcaaattacagatctgccacttattagctgtgtgattttaggcaagcctcttaacctttctgagccttatcacccccatctgttaaataggtattgactctggcttgcagagagatagatttgaaattaatgagtgtgacagtcttaacacagtgcctggatagtagttattaattacagtacaagggagggttttctactagggatacatacaaatcactacagatacatacagatggggcagcatgggacacagaggaagacttcatagaggagatgacatttcatctgggttttggagggtgaataggagttctccaagccaagaagcagaccataggtcaaacagtttctatgcgtcctggactagatttggtattgagagggataagcacagtgttgtttacaaaaacaacaacaaacaaactcaagttgcttgcagtagataaagatacatgatcccatggaaatggcacaggccaggtactgactgaatagacaaagaatcagtggcgttggggtcttaggaacacgtgaaagctgtgagccaggacagtcaggaagttccctggaggggaggttggatttagatgacaaaggaagatggagaggggctgtctgacccttgatttcctgactgggctgggttaggaaaggggtcacccagcttggcaaggggctggggacatacctagtaggttctgtcagaagccccactgtgtccctgtcaccagggctggggccgatccctgccttggaagaaaagaaaagttgttcctaattgttaattgtgcaatggcagattggctcccgaatgggactgaactgagccaagccctggagggagaggaggagctcaggctgtatcactaccgagccaggaatttgggggcccgggagggggtttgggaatgtggctgcgtgagtgtcccaggaagggcctagccagcgcccccttcccagaactcccacgccattctgcaggctcccataatgcctgagtatcgggtagaaattgggttcaaatttgatcccatctttttaccagctgtgcaaccttggacttgttacttaacctctctgtgtctcttattccacatctttcacgtggggttgctgttatggttaattagaaaacacacgtaaagtgcttagcacggaacctagaatgaagtcattgctcaagatgtggcttttgctggtgccatgtcgttggtgttaccgtttagcagctgcagcctcagcactgtcatcattgcccctacatctgtaacccaggccacactactgctcaggttgaacccagggtcattccagctgctcgtacccgttctccgtgagccgggacattcctgtgccacaggcattaccttggcagtgcctctctttaggaggcagcacttgaattccccatgtgccttttcatggattatcgccttaattcccaccatagcccagtgaagtaggttcacatgtccccattttatagatgagaacacatgctcagagaggtaaggcaactcacccagggtcacacagcagtaaattacagagagtccagctgaggtctgtctgttccagaacctttgttctttccactccaaggttgagggagcagcttgttctcattggatctgagcctggtgctcagccccctgctcccccactcccacctgcatcatgtattcctctccctagttctcatccccgcccagctctgctctgggcctgggaccactctggaccaagactgcagctagggcagctcctgtcctcctgagccaatgcagtcatcattcccccactgtcagctggaatcagccctcctctccccagccaggcgtttcctcccgggctccctccatccccccaggcaagcatgacacatgtgtcttgagggggatggagtgtactggggaccagatgggaagctgagcctggggtgggcttgtccagcagatatgcctggtcaccgaggcaacgccagctcagcagcatctggtttggctgcaggtccaccctgattggctggggctagacaaggggagttggccttggcattgtgggcaggtgaggggacaagcacagaggcatcagagtccaggagggaatagtggggcgcagagggcagagtggaaacaataagtagtttagagtcagacagacctggtgtccagtcctgccctgtcactttctggctgtgtgatccaagcaagtcactacccctctctgagttgcagttttagcatctgcaaaatgagagacaatgatagtatttaccttacatctgcatgagaggatcaaatagcagtgctggtgatcacaatactttgtgtctttgaactattttaattctcatagctacctatgagagtggggctattattagctttgtttttttaatgataaaccaaggcacagggaggtcatatcacttgcccaagtcaaacaaatagtagtaggcagagctgggatttgaatacaggcggtatagacccatgtccaccacactccagcctgctgcatcctcctacctctcagtgacaggacagcacatgggacacgtgctgtgtcagctggggatgctgcttgctctttttatttatttatttaagagacagggtcttgctttgtcactaaggccagagagaagtggcgcaatcatagctcacagtaaccttgacctccctgagctcaagcgatcctcctgcctcagcctcctgagtggctaggatgataggtgtgtgccaccacaccaggctaattttttaaatttttaaaattatttttttgagacaggattttactctgtctttcaggctggagtgcagggatgcaatcacagctcactgcagcctcagcctcctggggctcaagcaatcctcccacctcagcctcctgagtagctgggactacaggtgccccccaccatgcccagctaatttttatattttttgtagagacaaggttttgcattgttttccaggctggtcttgaactcctgagctcaagcgatcctcccgccttagcctcctgagtagctaggacgataggtatgtgccaccacaccagactaattaaaaaaaaaattttttttttttttttttgagacagaatctcactctgtcgctcaggctggagtgcagtggcatgatctcagttcactgcaacctccgcctcctgggttcaagcaattcttgtgcctcagcctccccagtagctggaattagaggcatgcactgccatgcccggctaatttttatatttctaatagagatggggtttcaccatttggccaggctggtcttgaactcctgacctcaagtgatctgcccgcctcagcctcccaaagtgctgggattacaggtgtgagccactgtatccggccaattttttaaatttaaaaaaatttttttttaagacaggatttcactctttcaggctggagtgcagtggcacaatcactgctcactgcaacctcaacctcctagggctcaagcaatcctcccacctcagcctcctgagtagctgggactacagatgtgcaccaccacgcctgctaatttttatatttttttgtagagttggggttttacaatgttgcccaggctgatcttgaactcctgagctcaagcgatcctcccacctcgacctccgaaagtgctgggattgcaggcatgaggcactacaccaggctaatttttttttttttttttttttttttttttgtggagacagggtctcactatgttccccaggctggtctcaaactgctggtctcaagcgatcctcctgcctcagcctcccaaagtgctgggatcacaggcgtgaacccccatgcccggcccgcatgctcttttctcacttgccctggaagcctgcgctgttggtggtgcatgggacacgcctactgagtttataaatgggtggacagaggagggcacagatgctatgaacattcctgcatgttgggcaacaaaagggaggcactgggggtgtgaccctgcaggccctgtggtgtgggcagccagccagacccagccatggccctgagctggccagggagccccactctgaaaacaacagcccccattcatcaagtccctattgtgtgccacacactttgtctacattctctcatttcatcctcactaccagcctgattgcccacgatggcagaatgtgtctttgacagaagctggttttgaatgtaggtccagctttcctcacaggggcactgagctggggccatctcttgcctcctgaggggtgggtgatggtttccttgtcaacatgtttttgtaggatatgttgctgattgtgggttgagggaggaggctgcagggtagggttggaagagcctagatgaagattttcatcctggttggccccttacacaaccccttctattccttgatccttcgttttcttcgttcgtcaaaagtagtttatgatcagggacagagcagagggctgggagagccaaggtgaccagagtcttggccctttaagacttcatcgtccagtggcagggacagtcacccatacccaagtacccaaatcatccctggaagctcgggtggggtctgctgggggtgtgtgcagagtgcagtgaaagcacagggccagaggtggcaggagggatgatgtggacacaggttgttttgcctttcttctgctaacagcaacctccttcctttgggaattgttcctccccaattccttgtggtgcatgggacacgcctactgagtttagccgattaaccaggctgtcaatcacagcatcaggccccacctctactaagtcacaggggagggcacaggaaacaggcctggccaatcagagttcttccctgggactttctaattcagcccagggagagagaaggttttttttctctagggctctcagctaccacaaggtaagcctggccgaattctctgggtgtgaaggatgtctaatctcagagatgagagtgaaggtaacacacaaggggaagatgaggcatggaagatgaggcaggggagagaaatctagcagcagcatctgaactcctggatcgtctcctgcctgatgatcctccctccctccctctgaggcaatgtgagccaagatgtttgttttgttagaaaatccagctggggcctggcacagtggctcacgcctgtaatcccagcactttgggaggccgaggcgggtggatcacgacacgaggtcaggagatcgagaccatcctggctaacacggtgaaaccccgtctctactaaaaatacaagaaatagccgggtgtggtggcgggcgcctgtagtcccacctactcgggaggctgaggcaggagaatggcgtgaacccgggaggcggagcttgcagtgagccgagatcgcgccactacactctagcctgggcgacagagcgagactccgtctcaaaacgtctcaaaaaaaaaaaaaaaaagaaagaaaaaaaaagaaaatccagctgggtttggtttttatcattaacagccctgagggtcctgattgaagaggcttcagagaggaggtggcatttgaagcatgtgttgaaggagttcttgggactaacagcaatggtgaggttatgccaagccaaggaagctggtgggaaggatgtgatcatgacctgcttgggacaatggcaggtgctgatgtccgggcagatcctgaagggcctcgtgccacagagcagagctccgacgcattgactcattccttcatgcacccattcattcacccaaccaagccagcgctcactgcataccaggcactactccaaacactttctgggtaactaactgcatcctcccaacaacttggtgggacgggtactgtgattcaccactttacaggtgagaagacagaggcacagagaggttaagtaactcactcaaggtcacagttggtaaatgacagagccagggtttgaacgccagcagtctggctccagagtttctgtccttaaccacagagggggagtgaccatcctcccctgactccagcccagggttctttctgtgtctcatatcccagtggggacaagactgcagtgcctgtgtctgggatgtggccctagaactctggaaccccagtgtgcctgagtgaggggaaaggagagagggaaggccctgtggatccttttagaggacacgaggtgctgtcctggcccagttccagtcccaactagcgaggagcctgtgccagattcctgctaggtgccctgctgtttctgcaaactgtgataatctccagaaacagtgaatgatgggctctggctcagtccaactaagcctgctgcaggagatggggaactttaagaagctgtggctcatagcccaggtactggggagttttaaaactgctcctagcaagggaaaccctgggcaggcaggaaggggagggggctctgagacacggcatcagagaaggagccctgggggacttgcagcattcgctcaggccccagctcgcccctcagtacccagactcaagcccctcccatgcacaaaggctgttcaccgtctcattcagaggttgggggtactagccctgtttcacaaatgaggaggttgaggctcagcaagggcaagtaacttgcttgaggtcacccagccaattttcctgggtccatgtccagggccctggacagcctcatgaaggctgcctctttgatcttgtctctgatcccaaagggtttctggaacacacgccagagctccctcaggcctcctggcccctccctctcacaagacgcccttcctcccttcctcttgttactcccaattccagagaagggctgttcccccaaatagagagtgctttgccgtttgtggggaggatcctggcaacccctgggggtcctacacaggtggtctccggggtgggggctggagggtaagacttccggttgtccctcattggctaggccctagcagggtgtatgagggcaggacagcccatctccagagcatgcacaaatgcttgttaaactaaagctggggcaaagggagtgccatttcagctgagactcaaaaggttggccattttctgacagcacagcagagagtgaggtttaccaggtggaggaaacagcatgagcagaggtctggaggtagagaagtggaaaatgtctccaggggaagggcagctgctttccatgtgggtgggagcaagctcgttcatggttccaagctaagagtgagccagggaggttttgaggggtgaccccattctagaccttctggggggatccagaaggcgtgtgacccattgggatcgcagcaaaactgagccaggcacctcctctcttctgtcctgcccagatctctgcctgacaaggatgctcaaggcggggccaacctctcaagggggcagggcctccctctcaagggggcagggcctctttcctgtgcctggccacctttcatagaggcttatctgtcccttcccattttctgtctggagcccagtgccctaggagcagtggccctgcgtgggtacagcctggccgccacaacaggtctggtcttgccagccaggcagagcttccactttgtacctcagaggtacaaagaagccccagccccagacccagtggggacaaatgacaggaatgcctcctggggtgcaagaaaatgtcctctggaggcccctctgctgctgacgtcctcacatcaatgactgtagtgatcatgtttaaaacttgctttttatgaaatacttaatatgtgccagccactgtgcttggcactttacacagactctagtggtgtctcactagatgctcataacccccggcaaggaagccactgccaccctcaccatgcagagggaggaaattgaggctccgagaggtgacatgactcgctcaacatcacacagctgctaagcagccaaatgtgtctgaccttgagatctatcttccacccatgatgtggagatgctagctccagccccccagagtcgctgtgaagagcaaaagtgaattaaagggaacgagcccgctttggaaatgttaaagccagcattacagggcccgggctggggtaatgtggacaggagttctaagcagggagcagtctgggagctgagacccatgctggacccagaggaaggggagagtcttgagtgcagggagacgagggagtcctcggtggacctcagtcatcctaagcccaagagttggctcagtcctcgctgccaggcccttagcatttgtggcacagttgcagggctttggaaggagcactgggccgggagtataaaagcctggcttctagtcctgactgtgtccctgactcagcatgtccagggggcctcagttagttcatctgtagattgggggggttggtcagacagggctcatggagaccttcctcgactcctccccagaggcttgagcacacctcgctgctgccctgtctttgtaacactcatcgctctctgcagtgaggccatcactgtactggttagggtcaagttggagtcatattgcctgggttcagatcccaaatgccttagagctggatgatcttgactgtaacctttctgtgcctcagctttctcacctacaaaatagggtcaataatatggccgggtgcagtggctcaggcctgtaatcccactttgggaggccgaggtgggcagatcacctgaggtcaggagttcgagacagcctggccaacatggtgaaacgccgtccctactaaaaatacaaaaattagccaggcgtggtggtgggcacctgtaatcccagctactcaagaggccgaggcgggagaatcgcttgaacccaggaggcggaggttgcagtgagctgagatcacgccattgcactccagcctgggcaacaagagcgaaactccaaactccatctgaaaaaaaaaaaaacaaaaaaacacttaacatatagtatgtggcacacagtaagcactcaataaatgtaagatgctattgttaatattgcgactcttagtaacattgtttattgtctctccctgtattacaattcaagctcctgacagcaaacgctttgttttgtttaatgtattcctggtgggaagctcattttttggcacatagtaggtacataataaatatttgttgaatgaatgaatgagcaaatgaatacacagacaatgacattgacatccccagcgtccaggaggccccatatggctggatgtggagaaggatggatgctgggaagacaaacccaggccagctgcttgctcagggcccagccagccctctttgttcctagcagcccttggggcaggccctgtatcagtctgccctgatggggggtccattccactcagaacagagggttctctctggggatcgaggtggctccctgtcctgccaccatgaccacagcggtatttgtgggtgtctgatgctgttttccagctcagattccagccaccaggcatgggggcgaacgtagatttttccctgtgctcagcagccctccctcccaaacccacagagtggagcccagcctgttgtctctttaccacccgtacccgccctttccagaggccactctcacgaactgaaatgctcccactgccccttacacagctcccttgcctccctcctgttctagaatttccagatgggactgctgacacagcggttctcctgtgagtccttcttggccccggtggtctgagcgaccctgaggacgttggtgtatgtgcccagttttgagagtgagggacagattgttatgccattctctatacagagaaaacgaaaactcagaggagaggtttgctggaacatttacagttgtcggaggcctgagttgggattcactcaagtctgtttatttcttttgccttcattcattcattcaactcgtatttcctgagtacctgctctctgtcaagcactgcacagcagtgttcatggtgcctgccttgcccagggatccagatgttaatcagaccagaagttagcctggctttgtagactgtgtgtacaccagtgttgtccagtggaactttctgggatgatagaaacggcctgtgtctatgctgtcgagcctatgtgtggctatgaagcatttgacatgtggctagtgcaaaggagggttgaatttttcactttatttttaattaatttgattgaaatagccacatgtggctcatggcgcttctatgttggatgtcgtagttctgcatagatctttgaagatgtcgttcaaggccttaacctgtgggtctcaaactcaaacgtaagcagggaccaaggatgggaccgggctgattttgcagaggcatcttcagttgtgtcttctttcccagtcgtcagtatgttcagcactacaaaggaatcagtttctgttttccttgaaacatgagcccctccagacctatctttcagttttccatttttttttcttaataaggtgtaatttccattacagtgaaatgcacaagtgagggctgaggagttttgacaaatgtagacacctgtgtaaccacagaatcaagatagagggtatttccaggacattctcattccccagaacattccctcatgtgcccttccagtaagtctcatcctcggaggtggctgctgttctgatgtctgtcgccatatggcttagttttcttgttttgaagctgcatgtaaatcatttcacttttgaccaagacaaggatatgagaaatatttctctcttttttaaaagtaagaaacaacattgacatgatgaaaattggcagctcaccctggggccacagtgaggaggagataaggggttggggtgggctgtggaaccccagggactcgtggcctgtccagaggaggtggccactcctcagccccagccaccacgtggagaatgtggtcccagcattggcgtatcttttttttttttttttttttttttttttgagagggagtctcgctctgttgcccaggctggagtgccgtggcgcgatctcggctcactgcaagctccgcctcccgggttcacgccattctcctgcctcagcctcccaaatagctgggactacaggcgcccgccaccacacctggctaattttttgtattttttagtagagacagggtttcactgtattggccaggatggtctcgatctgctgacctcgtgatccgcctgcctcagcctcccagagtgctgggattacaggcgtgagccactgcgcccggcccttttttttttttaaggaaaatggaaactattcatttttttgaaataatatccccaaagtgttacatttcaaaaacttttctaagccaggcacggtgactcatgcctgtaatcccaacactttgggaggtcgaggcaggcagatcacttgaggtcaagagttcgagaccagcctggccaacatggcaaaaccccctatctattaaaaatacaaaaaattagccaggtatgatggcgcatgcctcctagtcccagctactcggaaggctgaggcaggagcattgcttgagcctaggagtcggaggttgcagcgagctgagatggtgcccctgtactccagcctgagggacagattgagaccctgtctcaaaaaacaacaacaacaacaaaattcctagtgccgtaggccaaataattcacatctgtgggccagatggccagtttgtgagttctgccttgggccagttggaatgttagtaataatcacagctggtatttcctgagtgcttcctttgtttcaggtcctgtcctaagtgctctctattagtaagtcatgtaatccttgtaacaatttattaatagatccactttacagatgagtaagctgagccatagagagggattaagtgatttgcccaaggttatggagtgagtgcttgggagagccaggatttgaattctgactgtttctccacaatctgtgttccccaccactacaaatgttcctctcgagggcaagggtggagggtgaggccgctggggatggttatgccacttgggcggagctttgacagccaccacggtgccacctccctgaacaggtgaggagagagtaccacggccccaccctgctgggattgccctggctcgggcactttgcatgtctgggcaccttggctatcagttggtggagcccagttttagggagttctgggaaagcagccagtggtggggctgggtagatggaagcctagtggatgaggagccatgagaggcatagaaagcactgggcaagtgggggcagaaatagcaggagcctggctgggtagagcccaggcccggggggtggcaggggagagcgggagatgaggatagagaaatcagccagcccaggcccagggccacggcaggctgctgctgcccaggggccaacagctggggcattcctgccccctggtgattcatctggacaagcctgtcatttggggaaggtacgggaggggaatataaacatcaccaggcaaaacactgctacatttccgtcatcaccttccacctccaaagggggcagggcgggccaggggaggaaactgaggcccagggagcactcggcttgaactcatgccaggacttctggctcccactctggcgttctgtgcattcctcagggcagggggttgggaaaagggtctgtggtcatttctggagcctgagaaggggcatggcaggaaggggccagcagacacatccagatcctctctggcccttatcttacttgtaagtcaccgagtcagggcctgatatgcagtaagtgccaaataagtatttgccattattaacggattttcctaatttgatcctcacacccagttctgagatacgagctgttatcatcaccgtttcaccaatgagaaagtcgaggctcagacaggtagactccccgggtcacagagccagaaagttgttggcaggattaaaaagagtgatgtgtgtagggcgcttagcaccaccctggtgcacagcaaggggcttggtgtggggcctgggccagaagagggggaggtggcaggactgttcaaagagggcctcctggaacaggtggcgtggggctggacgtggggaacttagcctgttaagctgctggttcctttggggctaaggttggtttctgactaagacctaatacccgctgggtctccccactctgagaatgcactgcctgctagaatgccatgcagttttgggccgcacttgggcctcacgtgctttcctgcagctccacatcaggggagcctagtgagcctggcctggaaggggcggtctggcctcaaggtggccatgtcacctctctgagcctcagtctcctcatctgtcaaatgggaacagtgctacctaccacacagggttgtggtgagggcctggcatcacagaacttgcaggagatggctgttgaattggcctttttttttttttttttttttttttttctgagacagggtctcactctgtcacccaggctgaagtacagtggtgcaatctcggctcacggcaacctccacctcctgggttcaagtaattcccctgcctcagcctcttgagtagctggaaccacagatgtgagccaccacgccaccatacctggctaattttttgtattttttttttgtagagatgggtttttgccctgttgcccaggctgctctctcctgagctcaaagcaatcctcccacctcagcctcccaaagtgctgggattataggtgtgagccactgcacccagcatgaattggctttttgtttgtttgtttgtttgtttgttttttgagacggagtctcgctgtcgcccaggctggagtgcagtggcgtgatctcggctcactgcaggctccgccccctggggttcacgccattctcctgcctcagcctcccaagtagctgggactacaggcgcccgccacctcgccaagctaattttttgtatttttagtagagacggggtttcaccgtgttagccaggatggtctctatctcctgacctcgtgatccgcccgcctcggcctcccaaagtgctgggattgcaggtgtgagccaccgcgcccggcccatgaattggctttttaagaacagaagtcagacatagccccaagccagcctagggaagcttggtccatgtgtgagctcagaacccaaacattctcactcctgcttttcacctgtgtactttgagagggtcaggaggagacacaccctcttcagctttgtctacactgggtcaggaggagacacaccctcttcaggtttgtctacactggacatgagtgctagggagcaagtttgccattattgtcctccaaacccaagagcagcaaacacttatggagcacttgctgtgtaccaggcactatacaaagcaccttatattttcattgtactcctaggaaacaggctcagtagctggatgttgagcaatcagctagtgatgctggagtggagacttgaacctatgtagtctggcttcagagtctatgctcttaagaagaaaaaaaagtctaccagaagggagcaaaaatagtaattcagggctgggcacggtggctcacgcctgtaatccaagcactttgggaggccaaggcgggcagatcacttgaggtcaggagtttgagaccagcctggccaacatggcaaaacctcatctctatgaaaaatataaaaaattagccgggtgtggtggaacatgtctgtggtcccagctacttgggaggctgaggtaggagaattgcttgagcccaggaggcggaggttggagtgagctgagtttgcactactacactccagctagggcaacagagcaagactctgtctcaaaaaaaaaaaagtcattcagggcagtctttccgttgcaaagccttttcacatgtgtgatgcaattttgtccttaggacccctgatgagtgcagtgttaccatccctctcttagaggtgaggaaaatgggccccagagagggacacgacctgcccagagccacccacctgactccaagcctggtgttcttctccctgcttctcagccgcctcctggggatactgttgtccagctggaatggtggcagccagcaggccagcagcagggaaccctgcgtgtcccacagcccccatgtgctgcctccagtgggtgagcagcatcctggcccatgccatggtttcctgcttccacccgaccctgatctcagcttagagccaccagttctcagagacagttgagtgatttttcaaactccattccttagaacccctgagggagctgggttcagggtcaggatatgagctcattgagtgcctaagtggcagctccacttacatctcttttgtattttgggttgctgtgtttagttttttaaataaaggactctatggaatgaaaaaaaatctgtttgcaaaccactgttcagatccagcaactacttccccattttacagatgaaaaatggacagcaaagctcattttttccccataaatgacaataatattcaggcattgttctaagtcttgttactcgttttatcttcacaagcctatgagggagacactgttgtcatctccattttacagatgaggacactgaggctcagatggtgaagtagcttgcccaaggattagaatccaaggagcctagctcccaagtccacaccctcagccgtctgcaacctgacagacatactatctctttgtatcctgaagagggatgctacttgctgaggcccagggtaaggcagtgttagaactgggaccgagatgtggatctccagcctcccagccctattcctgttccttctgctgtccaagacatcgcctgggctgaagagggaaccctggctctgtcattttctagctgtctgatcttggacaagtgaatggacttctctgagcctgttttctcaccttagaagagagataacagtacatcatgaggtcatcatgaaggttagacaggatcaaccacatgagttggctggcatggggttcatggatccaaggagtccccagagcttcctgccccacccacttcctcctccctctgcccagccctcacccacccactcacctgtgtaacacaaatactaattacaactgactccatgagctgcttcctggttgagcacaattactgggcagctcagtcatcaccattataccatatcattcaatgagacgggttaactttgtcttaagttgtacgtgattagatcagcacattgtcagagagcgcttggtctcttcagattgggacttccccagcctggtcatcacacagtccaggacatcacacaggagcacaggagcatgaggaggtgcaggggcatctgtgggtagccctggagtcaggaccagctgctttctggtctgctttgcagtttgtgcttggagaagatcagagtggacaactcagccccttaaacccagctgggaggtgacacctgaagtcgtaaggatggagcaggtgaggcagggtgggttagaaggaggtggtgattgccgtcttatctgatgtcatgggaaaacctgggttcaaatccaggctttgctgtttaccagatgtgtgacttagggtgagttactgatgctcgctgcactccagttgtttcacacttgcaaggagctgacatgtgccaccgagccccaggtctagtgcctggcacaccacgggtcttctctggtcgttccttccctcccatgtgctgcttctctgctaggcactgggctgaggcctttccgtggctcacttttttaagacgtgtaaggatcctttggggtcggcaccatgatcatctccattcacgtccgtggaaagatgtgaaagccaaagcataaaattgaagtgaaatgacttggtcagggccacacagccgcacttggctgctcttcactgtgttgggatgagatgccagaagcatgctgccgcggagcaccgaggaagggtcactgcgaagcccgagagagctgcctggaggaaagcgcgttaagctgaggagccagccggagaaagaaggcagactcgaactcctgagggagtcgggagggagggtttagcaagccaggccaaggttcatgggcttcatcctgccagctccagggagtctgtgtgtgaggcagttccacttgagaaagtcctgcccaggccaagcatggtgactcatgactgtaatcccatcactttaggaggctgaggccggaggatcgcttgagcccaggagttagaacagcccgggcaatacaatgagaccttgtctctacaaaaaaaatgtttaaaattagctaggcatggtgctacccacctgtggtcccagctactcaggaagctgaggcaagagcatcacttgatcccatgagtttagaggctgcagtgagccatgatcacaccactgcactccagcctgggtgacagagcgagacctagtctcttaaaaaaaaaaacaacaacaacaagagccatggctcacatctgtaatcccagcactttgggaggcggaggtgggtggatcatctgaagtcaggagttcgagaccagcctggccaacgtggtgaaatcccatctctactaaaaatacaaaaattagccgggcatggtggcgggcgcctgtagtcccagctactcgggaggctgaggcaggagaattgaattgcttgaacccaggaggcagaggttacagtgagccaagattaagtgactgtactccagcctgggtgacagagtgagattctgtctcaaaaaaaaaaaaaaaaaaagaaaaagaaaaaagaaagttctgccaggagctagccaggagctgaaagactaaagggagctacagtaggagatcaagggggtcagggggtcaccggggaaggcatgccgaggggacagagcccagtgggcctggacagaggaccagagatgattgatggaggttgccaggcaagtggacagggtgggcaggtcagtggcctgtatcaggtaggagtgagaggctgctgaccaggtttggggcttgggcatggggtggcctccacagcaggcactgaagaatgggccagcaacactaggtaagattcccggtgccccccagggcctctggcagttgagtcaacactgggccatgtgagtgagtgcttcccagcgctgtgtgtgtggaggcaagtctcctgctgccagcacattcacgggagcccagccctgggactcggggccacgccagagtggttggctcacaggctggcagggctgctgccttctccaaggggcagttagcaaccttgacctcctacctctgccctgtgcccttggccttccagtgtctccctgagtctcaccttgaggcctccccagcccctgcccacctgctgccttcccctgcacaggccctcagttccatctgagcccttggtacaaaggggagtctccctctccaggccccagcagttatatctgtccctatttcccacatcccagatgggtggcccgtagcctctaaaggaagttagcctacagagccaggccccgggtaggaggcacaaaaaaaggaggtgaggccctgagataaccaggaagatctgggtttgggctccagctctggcaagctgcttcctttctctgagcctcagtctctgcatctgtaaaatggggatcccaggacttatcccacatggtgattgtaagacacaagagtaaaagagccttgagaactgggcaatgtcaaggtcaatgactctgttttgttttgttttactttattttattttatttctctctcttttttttgtagttgagacagggtcttgctctgtcacccaagctagagtgcagtggcgtgatctcagctcactgtagcctcaaccttctaggctcaagcaatccttccacctcagcctcctaagtagtggggccacaggtggatgccaccacacctagctaattttttttttaaattttttgtagagacaaagtctcactgtgttacccaggttggtcgcaaactgctgggctcaagcaatctgcccacctcgcctcccaaagtgctgggattacaagcatgagcacccggctgaagggtacatgatttctattaataactcgtatttgacttcttgctgttgatattaacctccatcacctgggcaatctgttattttcactgagtttacagcagggctagagtaacaacaaatgttggctgaacaaaggccaagactggaaaatctggatgagggcagaagcaaatgggaggggtggtgaggaagacaagaagaagcaagcagaaagaggtggcctgcgcaggatgtccctctggtgtggttcacgcaggcttgggctgctggatgccaggcagttcatgttctagcttactcggtatttacaatggcccttttacggatgaagaaactgagacctgagggtgaaaacaacatgtccgaggtcacatgagccaggaaacctgtgagtgggctcaggtctgtcttaattgcctgataaatgttgtttctaactctgttccacaaaggattcatgataggttataaataaaatacattcagtaaaacgacatgcaataccaaatggaaaatcagaatcacggaaaacagagtggaaaatgtggacaaggaaaaagctgaacctaaaggccaagaaagtgcccataggcgagtttctgatttggctatgagtttcctggcagccaaagaaaaaagagatacaagctgattcctgttattaaaaagtaaagaagcagtttacactttcaggaacttcatagtaaattttaaaataagctaatcacatggaaatttctctggtgaaaaatactgggaaatataatggataatgtaataataataaatgtcaagtggcatatctttagaaatgatagccatatttttatatcttatcccttgcccaaagttgtgttacttgggtttgtttttgtttttgtttttttgagacagggttttgctgtgtttcccaggctggtcttgaactcctggcctcaaacaatcctccggcctgggtctccccaggtgctgggattgcaggcatgagtcaccatgcccagccaagcactttatctatattaactcatttaagtgtcaccacagtcctatgagggaggtactattgttatcatcatcctcctcatttgacagatgagtactgaggcacagagaggctgagtcacttgctcagggtcacagagttgggaagttcagactggggatctgaaatgaggtttagatccagagcttttacccactacattatagcatctgtgaaatataagtgtttagctaccagataatatgagtgtgttttagatgacatgtaaagattgaacagatcccagccaattaccagcaccaaaagtagtaactgatggggacttcggccacaaagggcagcgtctctaaggagctgaggcttagagacaatgtgaaagtagctgtggagggtgtggctcagtcccaggcctcagaatttcacatgtggggcttcccttttccacctcatcaccccaagatgacttaacaatcccccgcctttggccaaccaaacgcaagagccatatgagtgactaatgtcgtctgggcaaagggggtcatgcccaggtgctaccaggccaggaggcttttgtcgccagaaacctgtgcgtgtttatatttctcgtttctgctcaccacaggcctttgatttacaagggtggagtttccagagctgggcactgttgcaccttcatctggctgtcatcacttcctctgtgcagctggggcaccggggactgaggacggggcagtccacagggagctgtggttccaccccttcactcttggtttctgccaggccctcctcttgaacactagacccagattcaacccagatttctcctccacggctgcacagtgccaggaagggaactgagaagaccaaagtggaggttctttaccttccccaacacactcggggccaggcgtggcacccacaactgcaaatgagacaattagggagaataagtgctggctgccctgtcagcccagagcctcagtctgcccagggcacccagactctgtgaggttcccacctgaagaagcagttccatcttccacaaggagcacaggaccaagagtccaggacccaggttcgaggcccagctctaccactttctcgccgcggggctcgggttctctggaggcagcgtaatggagtcagtgggtttggcaaggggaagattcgcattatggctccctcagtctccaggcaggtgactcagggctggggggaggtcctttctcctctctgacccttggtcatctcatttgtaaagcggaggtgatgattctcatctcagggacgaggcactgtggggttaggagagaatttgtcaagtggcatggttggtttttggtctgtctaggcccctccccctctctgtaagctggaagcgatacttgtgaggctgaggctctaggtgggtgtggggagccattggggtagtgaatggaaggccctgggcgaagggccccaggcagctgttgaaatgtcactcacccactgtggacttcccaccaagcagagcccgccaagcctttcccgtctgaggtgggttcagtttcactaccgggctgaggcaggcatctcaggaaggggccctcggcttttgtgtgctgaaaaataaccaggctccatctctgctgatttctgcttgggagttccgtgagcttcctgcatcatctgtccacagacaggctgccgcagggtggacatcagagtccctggggtggcttccggcctccctcccttgcctcccgcctttgctcaaacatctgtagaggctccagccccagactaagcccttaaggagacagggtcccgtgagacccagcctctgccatcagggttctcctgtctaaaatgctgtgtgcctcagtaaaaggcagcatggggtagggtggctgtgtggggacacagagccagggaccaaatgctgtctggggtccctggagggtggtcaggagagcttgccagaagggggaaatctctgaaatgagacagaaggaggaggagccatcgcttaaccacacctgggcgagttaacttccccaagcctcagtttcattctctgtaaaaggaaccagtgatacctgcttctgagggaagggtgagaagcttaaaagagatggtataaaagaactgacaaatcccgtacaccagccgggtgaatcccttacaccacccacgtgccccggggagatgttctgtgaactgaacttctttttcaaaagtcttttcctctggcaatcgacacctggtaacgtagtgtaaccaagtgtcctgttctagaaaaagcccagctgcaacccagcagtaagtgaagcagcctcagagtcccctctctctctgggatgggtaatggaaactcctccacccagtgggagtgaggcagaagtctccagaattcagagctttcccatgcaccctgcctccccagggcctgtgacctttagatgtgttccctgtttctgtaggcattatgaagttagatgcaggagagttcttgagaacttgaaggcacttcccctctacttgtcccccctttgattttaacaaccgtttgttgagcacctactctgtgccgggtgatggagagtctctgttggacaggccagacaaggtcccagccccagtaaagctgtggattctggagagggacagagacagtgatgataaagacatggaaacaaaacagtctgcaacaagtactgtaaaggaaaacaaacaggatgctgtaacagagaatttgggggactgcttagggttcctgggacatttgaggagctggtaggctgagatctgaagttggagctgaccatgggaagagtagagaggaggaaaaaatgttccagatagagacaacagcagctacaaaggtcttgggggaagaagaaacttgtagaaactgaggagttgtgtgaggaggttggggggggagggggcgctggcagcacaagatgagggcccagagtgggcaggggccatggggcctggtgaagggtttggatttcattccaggacagtggagggtttttaagcaagggagtggtaatatcagaatttttttttattttatttatttactcagacaagatcttgttgtgtcgtccacgctggagtgcagtggtgcaatcacagctcactgtagccgccacctcctggcttcaagcgattctcccacctaagcctcccaagtagctgggactacaggcgcataccaccacgtcctgctaattaaaaatatataatatataaatatatatatatatattttctttttgtagagatggggtccgtgttgcccaggctggcctagaattagactcaagtgatctcctgcctcagcctcccaaagtgctgggattacaggtgtgaaccactgaacccagccagatttctgtggtttgtttgtttgagatggagtctcactctgtcacccaggctagagtacagtggcacaatctcagctcactgcaacctcgacctcctgggttcaagcgattcttctgcctcagcctcctgagtagctaggattacagatgcatgccaccaggcccagctgattttttgtatttttagtagagatggggtttcatcatgttggccaggctggtcttgaactcctgacctcaagtgatctacccaacttggcctcccaaagtgttgggattacaggcgcgagcgagccatggtgcctggcctcagccagatttcattttaaaggctcatcctggctgctgagggggctgtcagagggcaggagtggaagccaggagaccatctggagccattgccctcactgtccctgtgacgtcaggcccctcacccctctaaacctgtttattcacacatatgtgtgactgtgagaatcaaatttggaatgagcagaaatgcactttgcaaagctgaaaagtacgcataaatgcagggattcccgccttgctagaagcggagagtcctttggaaatctgctgggttagacctctctggggttcttggttgggacagtgctgggcctgagtccctaactgaacacctcatatccgagagagccccctttccctgcctagggttataggagagggctcaggggctggggaggggggcacctggctgaggctccgagtcttgagggggaagatgggaaagaagggtccccttcctggcttctgactccccctggagcaatggttctcttgtgttgcagggagggcgacacctttgagcacgggggtgaccaccggaccaccctgcagccatccaaatgcacacacacagctcctttcatcccgtgtcagggagttctctgaaattttctgaaactcattcacgaactctggcttaaaggcctctgagctagaaaggggaactgaaaggggacacctacctttttaccccaccttttttgtctggtctttctagcattaaccccctagacacacctaagggctgatgccggggggaacctgtcttgattgctctgggccaaatcgagggcaccttcctgatacttttgttatctgccactggggacccggttgttgaagggggacttaagattttctcgaaggaggggtcactgtgagggcctttcctgcctgctaggggcttcagtttgggggcccccactcccgacctccggggaagggaggggtccccatctcccccgggcctctcgggtcttggggtctccccgggaggccggaggttgggaaccgggcgccggcgaaccgatcaggccccgcccgcgaaggtggtgcaacgcctggcccggcccatcccatcccggccacccgggcagcgggaccaggcgtctggggcacagcatgcggggcgtgtggccgcccccggtgtccgccctgctgtcggcgctgggggtgaggcgggcgcggcctggagggcgggggcgggaggcgggcgggacccctccccgcgcgggccgctccgtgggccggtctcggtctcgggtgtccaggccggggcggggcgcggcggcggcggcgccagggtcggggccgcttccccattcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtaggcgccctccgctccctcccgaggtccaggcgccccgggcccgggcatgcgcgctgccgctgccgcgccccccgcccctacctaccccgcctcttcccctcccttcccctccctcgtcccggcatccgggaggggccgcgcctccccgcagctggagctccgcgctgagaagccttccggagcccaccagtctcccctcacctgcccccgccatccctagagcctcccggccacctgcttctggggccacagcccaggtggcagagttgaaagcacccccgagacccgaactggtccagttccctttccacagaaggcacagtttgtgcatgtcccgggacttgcccaggccctttaccggcagagtctacggctgtttctgttttagcgtggaaagccctgcatccctggaacccactcccccagtccggggcaaactgggaaagttggtcaccttatccgggaggcagtaccaccctcttcctcttgccctcccaatacctgagtttcctggggccagaaacctgttctctgccccctctccctgccccttttccagcctactaaggaagtccaattcctcccctccccagggtctccgcccgtgggcatcccatctgcccactcctggggagggccccacccccgtccctgccttgtaacaggacattgagcaaggctgctttctgccctcccgtccctggggggctgcactgggacagttgtggccaagacctcagtgctggaggggtttggagccagccaggtgcgtgggaaggtgctggaaacgctgcggacaccctaggagacccagtgatctggctcttgagaagccagtgtagaaagaggagctggggcaccccaattctcggaggacttctgccaggtagaccaagggaagtatttgggagaatcttggggccacttggtgaactggcacacaactcttcccaaaggcgagcttaggatgaatggacgcttagttgccaggcccactccactcagatacgcctcttagaagcgggaataatcctcccagcgcagggagacaccattgatggagttcctcctccagggtcacataggcccaggggacccaaactcacagtcccaagggctctacccactgggatgtgtggtacccctgcttaaccttcaggaacacccctgagacctgtagggattactgtccccacttacagatgtggaaactgaggctctgagaggggcaaccactggccttcggtcaccgagctaaaaatccgagagcgacacgtcaaaccctgtctgtctcaaacctcttcccagtggactcttcttaagaggctgaagccagcaggaaattagatttctggggcaggtgcttttcccttctcaaatcaaaacagaatctaatcagcaatgtttttcagtctcatcttccacagaagggtctaaatatatcaacacaaaagcatttcagaattcacagcaaagtaataatgccatgttgctgttatcctcacagcagcctgtttggggtataacctttttcagatgaaatagcacatttctctggggagggcccccggccaagcaggaggagccccgtctctgaagccagcgacccgggtttgagttcttactccactcacgaccttgggctagtggcttaatctctttcagtggtgatggcctcactgtgaaatggatgttagagaaagtggatgtcatacatattatatgcagcctgctaggattattgttttatgacccatgaagtaagggctggcgtggccacattattgatgataaaggtgagggacaaagagaggttagagacattcctggggtcacgtcgctgttgtctatggttggagttagtgtcctgtccccaaatggatacattttccactttccttgcaggaaaaggcaaagaggttatgcaaggatttggggcatttttgtgggtacccagcttggcttgtgtggtgttgccacaacttccccaaagtgaacatgaagtagccagtgcttgcttttctgagtcaaggacccattcatctccatttatgaggcagagtattctattaattgaatgttttcaatcattgtttttttttttttccccagtgtaaaagctttatatgctcacttgggggagaaaaaaagatagtcaagtataaaaaggaattaaaaacggagcagtaatcctgccacttggagataacggtttctagtttttcacacttgtatgtatgtatttttaaacatagttgagctcactgtaaatacacaatgttatatcccgcatttttcattcagcatcttctacattgtcagaaacttccgaaacatgctgccattaaaaatcataacacctcatggtaccaacatataaaaatatatttattcaatccactgtagttggacacttaggcgcaactgctgtcactctgtgggtgacccatttttagcttttcagattattacctttgggccggttgctagcgacacaacttctctctcaactttatttatttatatttatttatttattttgagacagagtctctctctgttgtagaggctggagtgcagtggcgcgatctcagctcactgcaacctccgcctcccaggttcaagcaattctcctgcctcagcctccggagtagctgggattacaggcgcacgtcaccacgctcggctaatacttgtattttcagtagagacaaggttttgccatgttggccaggctggtctcgaactcctgccctcaggtgatctgcctgcctcggcctcccaaagtgctgggattgcaggcatgagccaccacatccagcctgtgctctcaattttagactttttaaaacagacccttcatcccaaatcttttctcttgatggacagctaaaaaataagctatttgatttttcaagattttgaagtccattcgttttaggaagtcccaagtgatcaacaccaataactaataaatgaacacttccatttttcagccaaacttgacacatttgttactttattacttgccacatttatttattttttattattggacctgctggccaatgttgaatttaaccagagcaaaattctacctgtacctcacctgaaagggtttttctttttcttttttttttttcttttttttgagacaaggtctcactctgttggccaggctggagtgcagtggcgcaatctgggcttactagcagccttgacctgtgattctctcacctcagcctcccaaatagctggaactacaggcatgtgccaccatgcctggctaattttttgtatttttagtagagatggggttttgccatgttgcccaggctggtctcgaactcctggcctcaagtgatcctcctgcctcagcctcccaaagggctgggattacagccaccgtgcctaacctgttctttttctttatcccatattttaggcacagattacttgcagtctactaaagtgagtcactctgaaccaagcacagaattcaaaggaagctggctctaacttggagccccagctctgtctctcctgcgctgtgagacctgaaagcaactcacttccacagctttctttgtaaaatggggttaatattattagcccacctctcagagctgttgcaaaggctcagtgggacagtatgagggaaagcattttggataatgcttagaaaatggatttggttattaggttattacaaggattattacagaaactcactatgagtgacatgatataataatatacatctaaatatgctagcttttgctctgaagcctcttgctctgccaaagccagctgcctgatcttcccacacctgaacatacaccattttcagcggcaggaagggatatagctgaagttacacctgcagcctgaactgaggagcagatggccatgtctaccaaaacctttgaaattcattcaattacttctaaaaatctttttttgttgttgttaagaaaaaaagaaaggtgagatattaaattcttagttatagttttctcatttttttcccaccttgcacagggctctcttctcttctcttttttttttttttttttgagacagagtcttgcttgttgtccaggctgtagtgcagtggcacaatctcagctcactgcaacctccacctcctgggttcaagcaattctcccacctcagcctccccagtagctgggattacaggcgtgcgccaccatgcgtgactaatttttgtatttttagtagagatggagttttaccatgttggccagcctggcctcaaactcccgacctcaggtgatccacctgcctcggccttccaaagtgctgggattgcaggcatgagccactgtgcccagccttttttttttttttttttttgaggcagggtcttgctctgttgcccaggctggagtgcagtggcgtgatcatggctcactgcagccttgaattcctgggctcaagcgatcctctcacattggcctcccagagtgctgggattacagatatgagccgtcatgcctggccaaagctgtctttccagggtgatttcagggacaagcccgctcaatactttaaaaagacatgtctgtttacctggagttgttatcaactctgtttgcctattatatagccttgaggtttgagagtctgagaagtcacacctgggacctcaatcagcctcctcattttagagatgggagactgaggcccagagactgcccagcaacacacagtgggatatttgacttctcagggttaccatctttctcccatgctgtggggagctgggtgttccttctgggaagcgatgaaagttggaaagtacttgtaaatattagcctttgattcttgctaagatgtgaggagtgccctcccctacaacggatcatattttaagctgttaccagtcatttaaagtcaggcatctgggtggggtagcagacaaggctcaggcagagacaagaggacacaaggacttgagaattttgctctggactgaccccattgcctcagccagaaggccacctcatggaaactttactggaagaaacttccccaaactgactttggggaactttcggaggcagggttcctcgcaggctgggctgtcacagtcgacttgctctcaaaggcttactccagggagcctggtgcccctgccagcgctcccaggtggctgggtttctgggctgcagaggggtgggatccctgccagacccttgcccagaccactcccattgctgcttcgtgcagcccaggttgctgggttctgccttcccttccgacctgactctgaaaacctggcttcacctggctccccaccctttctgctcccggcttgtctcgtgggccccaggcagcaggccccatcctcacctgcagaacttgttcttgctgtaagcctaggtgagccaagcactcacttctgtaaccaaatatgtgtcccggattagggctttgttcccttggctgtggaaaccctgggaactcctggctggatagcgctgctctttttcccttactctagctctctcgctctttctgtttctctggctctctcatttctttgtctcattctccacctctctcttttgagggcaccccctccttctcattctctttctgcctcccacgacaataagtaggaaattaagcccaccagcgagctgagcatctgcagtgattctgcatcttccaggcatcagcgctgcctcttagcggatggccatttcacagtcccctctcctgagatggactgggctgcctgccaccaatcctcctaccctccaagctgcttaggccagtctcccatgcttgacgggacctcatttccaaaagaaacgtaagaaaccagtcacatctccccatgctgtgacctcatctcacggatcccctccacagtcccatgaaggaggctgggcaggtgcgacagggatgcaaagaagagactcagccgaggccagcggccattggaagcagatcggtgccctgactcacggcccagccctttccattgcacccaggaattggccaccctgccctggagaggcctcctgatcctggcctagtacctctaggtgacttctcctgccccagggtgaggcatctggattcgttctgcctttagagacaaggcttatccagaaaccatgaggcccgtagccgatagtacaagtcaagcaaagaacaagacaaaggttaaaaactccattttcaaactccatttgccattcttgcctggaactatgaatttttaattcaattctggcttaattttaatttaattttgcagtgaacaccatctgtttagattcagcactttgcatcaaacagtgagggtcagctccacttcctgtggtaggtctgcggctgccagtcctggagacgtgggttgcctcactgttctctctcctctctccttgccttcatgccccgacttcctgggtttcttctggagctaacgctaatacctactcttaggaatgttgtgaagataggctgggtgcagtggttcacgcctgtaatcccagcactttgggaagctgaggcgggcagatcacctgaggtcgggagtttgagaccagcctggccaacatggtgaaaccctgtctctactaaaaatacaaaaattagcccggcgtggtggcggacacctgtaatcccagctactcgggacgctgaggcaggagaattgcttgaactcgggagacagaggttgcagtgaacagagacctctccactgcactccagcctgggcgacacagtgagactctgtctcaaaaaaaaaaaatttaaaaaaaattcaaaaaaaggaatgttatgggccgggcgctgtggctcacgcctataattccagcattttgggaggccaaggcgggtggatcacgaggtcaggagattgattgagaccatcctggctaacacggtgaaaccccatctctactaaaaatacaaaaaattagccaggtgtggtggcatgtgcctgtagtcccagctacttgggaggctgaggcaggagaatctcttgaacccgggaggccaaggttgcaatgagccgagatggcggcactgcactccagcctgggtgagaaagcaagactccgtctcaaaaaaaaaaaaaaaaaaaaaataatgttgtgaagatagaattgcactatcaaaatagaattaatatgatcccaggcccttagcactcaagtatttatttgctgccattgttcttttttccctttcctatccctctgtttctttcatcttccccttctgttcctttcttctctcccttctctccgcagatggctttgctccttgctcttagctgtctccttgtcgcccacaccatgacatttccctgtacatttaaggtgaggttttcctgcatcccaagcctagtggctgcatcctttggctccctggagccagcaccaggcacaggggtacctcttttcttttcttttctttcttttttttttttttttcaagacagcgtctcactctgtcacccaggctggagtgcagtggcgtgatctctgctcattgcagcctccagctcccagtttcaagtgattctctcacctcagcctccccagtagctgggattacaggcatgagccaccatgcctggctaatttttatatttttagtagagacagggtttcaccatgttggccaggctggtctcaaactcccaacctcaggtgatccgcccacctcaccctcccaaggtgctgggattacagtcatgagccactgcgcctggcctcttttttacttttttgagatagggtcttgctctgttgcccaggctggagtgcaggggcacaatcatggcttactgcagcctcgaccttccgggctcaagcaatcctcccacctcagcctcccaagtagctgggactacaggtgcatgccaccatgcctagctaatttaatttaattttttttaagagatggggtctgactgtgttgcccaggctggtcttgaactcctgggctcaagccatcctcctgcctcagcctcccaaagtgttgagattataggcatgagccaccatgcctggctgatgggtacctcttaaaccaaggtctcatccaggtgcagtccagcactttgggaggctgaggcgggtggatcacgatgttaggagttcgagatcagcctgaccaacatggtgaaaccctgtctctactaaaaatacaaaaattagccaggcgtggtagcacatgcctgtaatctcagctactcaggagactgaggcaggagaatcgcttgaacccgggaggcagaggttgcagtgagccgagatcgtgccattgcactccagcctgggtaacagagggagactccatctcaaacaaaacaaaacaaaacaaaacaaaacactgtctcacggcctccttgtgccctgtgagctgagccatgataatggggacatgagaagcctaaaggaggaaggatgaaacaaattaggggcagcaggacacatacgtcagtgtccctaggcaaggcagtccctgcttcaagtccttgggacccctctgagtaccagagaccaaggtaaagtgtgtgagataactgattactctgaaaaagcactttataaacatttgagtacagtgtacatgttagcatcataccaggctgtctctctctgcaccaggccctcacagcctgaagttttaattcatggtctgaaactttcattgctcactttttcagaagagattcttgagggatttgagcgggcggcatccctcccactgcctgacccagctgcttcagtgtctgagcctcctgggcctccacggaagtgtctctaagccccaagatcctttgctcagttttgttttgttttgttttgttttgttttgttttccgagacggagtcttgctctgtcgcccaggctggagtgcagtggcgcaatctcagctcactgcaacctccgcctcccgggttcaagcgattctcctgcctcagcctcccgagtagctgggattacaggcgcctgtcaccactcctggctaatttttgtgttttttagtagagatggggtttctctatgttggccaggctggtcttgaactcctgacctcaggtgatcctcccacttcagccttttaaactgttgggactacaggcatgagccgccgtgcccggccccttttctcagttttggaacccagtttttttttttccacagaaagtgcttgtgttcctccatctctggtgcagcaattcccagtcatttcctgcccagtaaatacctaaccatggccacgtggcttctcagtacccttccctcaactgacccacttcagatccccgagtgccagggtgggactccctcagggctctgacccggcaccaggggcacccctcaggctgttggtggggccgttgcaggtcagagtctgagtctcctcatcttccctgacagcttcccctcttcctggcaagccttgctccctccaccctgcccttcccaaagggtaaatctaatcatgtcactccagtcctcaagaggaagtccaggctcttaacctggctttctgtgccccttaggatctaggccctcctctcctctccacttccattccttcttatctggccagctcctacttattctgactgacccaggccagacatcacccgttccaggaagccctccctgattgaacccctgcccaccccagtctgtttctttatctgcctccctgctgggctgtgtatttccagcatggccctgagttggtgctcagctgttagcacatgacacggtgtcactgaacacgttaccccaccttcaggagacccttcctgtcttgtgggtgtgggttttgcaggaagcatctcttggaacagaggagaaccccaagctgccttgggtgtgagaggcctgggctgtcggcccccattgctgctggctggtgtgtccctcctcgggcagggagggccctgccacaccctgcacttcctctcattgtgcctcccttcctgtttagctagactgttaggctggagggatttttcctccctttcaggacctgaatggagctatttctccttgcatctctgccaacatctcccaggatccacctctgatccactggtgggctcgggcatcaacagctttgggttccaatcccagctgtccccattcagctgggtggtgagaagccagggtctcacctctctggacctcagtttcctcacttgtaaaaagaaaaataacaaggtggctcgcgtgtttttgcgtgggattatgagggtttaatgagctaaggatgtctgtgcttctgggaagtgtgagccatggctgtgtcacccttgtccctgaccccgctgatgtgggggctctgcagagagcccagctgggtactcactggatgcctgcaagtccaaacatcctgttcttttttgaactcctcactggagaaacagggaaaagctgtagttttttccttccactcatatcgagtgacacaaaaaaacaagcctgtcggggccgagctgcttgactctctgatgtttgggagcagatccgagcagctgagcagggtggctgttcctttcctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagtaggtgccttcgtgttgcatggtgggcttgactcactcctgcacccggctccgtcagctcgggcgaggggggcttccctgcttaagccggggcagggctctgaggctaaggagggagccaggcccaggggggtctgggtgctgagatagaccaagacccgggaagtgggcagcgtgggtgatataaaggtctcgcacttgagtccacatcctgtcccagcaacttactggctgtgtgacctcggacaagtcacttattccctcagcctgtgtcttctctaatttaaatgggaaaacagtacccaactgggggatgggtctgcggactagagataacatatgtcccatagctggtgcctcgtaggacttcttcaactttagctctgggtactgttgttgctagaatgtggggtaattacacacataggctgacattgtctgctatctctagttccaataaaataacaataatgccctctgtttactgaattatttcctcggaccaaatacccaaataccacacccctcgcttcagatgcaatctcatttcctcctggaggcagccctgtgaagtgtggttacttttggccccttttccatattaggaaactgaggcactgagatagagtgacttgctaatccaatgcggaagttggaattcacccacaggctactgggctcaagcccaggctccacctccctttgtaatccaagtacgctccagagcgcattacacccccaggagagctgcccttccagatccagctgcccatcgtgttccttgatcggtgcctttgtcccactttgaatggtgatacaattgggccactctgatcctgctgtaggggtctgagactggttctctgtttccaactaagtggatctagccagctgcctcacacagagttgatgctcagtaaacacttaagaagtgcgaaggggtggatccaagttagaaataagaatggggaattagccaaagccagggcctctcagtcccctgtgccccaacatctattcttctgatggcagatggttcacctagttgagcagcctctgggggctctgctcagcatcccacccactgactcggtcgctcaccccatgagagagattaggagctttcacaggatcttggaacatccactacaggctgtgtggagccttccctctgtgaagttgctggtctgtgagggtggccacgctgcgctggggtggggaggggactcaggggcctagaaaagagcagggccttcatctgagcattcttccatccctcctgggtaaggcacacaggtattcattcattccacaaagataggttgtacttaagaaataattgcttgattagttaactataatggtttgtaggtgttttaccaaatgtgcctggctcagcaggtgcttaatgcatatttgactaattaatgactagttttcaggcccttaaccagatgtgcttagcatagtgcctgtgccataggtgtgcagatagtaaaatgaataaattaatgtttgaatgaacgaaggggtaggaaggaagatcaggctgggaacagcctttctctgctgagtgtatgtatattgtgtgatcgtgtcctggtgtgtgtgtgtgtgtgtttgtgcctcctctgctaacaggacacaagctcgtcatcctctcctgccactgccatgtcgcctcagcctaaatcagctctagttctgaaccccctcctggtcagtgtggaccctggccagcacgtctgcacagctcttggctcagagcagcgggagctggccagactccggcagccagtgttaccctgagactgcccctcggagctccaaagatatgtcttcaccagaaaccaggggggagtccccacgggccagctcctgatgatcagacccaaaacatttctgttgttattgcccagtggggccccttgggaggaatcctgcttctgcctctgttgtgtccctctctgggtctcagaagggttttctccagcctggacctgggagaggaacattcttcccctggagtggagctgggcagagtatcaggtgacccctgagccacctgggaaagcagtgaccaccccagatattaacagtaacctcattacccaggagcaggtgctggtgctggccacatctgagcaaacatcaggccagtcaaagcaaatctggccgggcgcagtagcttacgcctgtaatcccagcactttgggaggccgagatggacagatcacctgaggtcaagatgttcgagaccagcctgaccaacatggtgaaaccccgtctctactaaaaatacaaaaattagccagggatggtggcgcacaactgtagtcccagctactcaggtggctgtgatggtgcacaccggctactcgagaggttgaggcaggagaatcacttgaacctgggaggcagaggttgcagtgagccaagatggcaccactgcactccagcctgggcgacagagcgagactccgtctcaaaaaaaaaaaaaaaaaaagaaagcaaatctgatgattctgaaggccagcctctgggaatgtctggacacatagtacgtgtttacttaccttcctgctatgcttcctttccagaaacatgctggtgctttgcaaacagaggcagcaaaacaaacaatacattctccaagaacatattttaaagaaagcattctacacagttttgaggccaggctgtccagatgagtgtctgtaaattaaatctaggatctgtttctgctttctcaattgatcacgcatgtcccaacggaaagaaatgtttgctgcctctgcaggtggtgaacaagtgctgaataaggcctttcattcattcggttgttcattcaaaaacacgtattgaggccgggcgcagtggctcacgcctataatcctagccctttgggaggccgaggcgggtggatcacctgaggtcaagagttcaagaccagcctggccaacatggtgaaacctcgtgtctactaaaaatacaaaaattagccaggcgtggtgttggatgcctgtaatcctagctactcaggaggctgaggcaggagaattgcttgaatccaggaggcagaggttgcagcgagtcgagattatgccactgcactgggtgacagagcaaaaactctgtctcaaaaaaaaaaaaaaaaaaaaaaagcacgtattaaacagctgctagttgccaaacacagtactagacaatggaaatataaaaacgcataggatattggcctgccctgaagttcacattctagtaggagaaatgaacaaggagatggtcgtgacatagcacagtagcagagcaggcacccaggccgctgaggggcccagagagggaagggggtcgatgaaggtttccgtaggaagagggggccttagatgagggggcctggaaaccatgaggtcatcaaaatgcatgaagcacttcctgggccaggaatatttcatgaagtttctgcaaaccattaaatagttaaataatcaagccattgctccttaagcacctcgtaggtccctagcccaatgtccagcaaagtaggcacttagtgaagaactcaaatttctgagactgctttatttatttatttgagacagagtctcactcttgtcgcccaggctggaatgcagtggcgcgatcttggctcactgcaatctccgcctcccgggttcaaaagattctcctgcctcagcctcccaagtagctgggattacaggtgccccccatcatacctggctaatttttgtatttttagtagagacagagtttcaccatgttggccaggctggtctcgaactcctgacctcaggtgatccgcccacctcggcctcccagagtgctgggattacaggcatgagccaccgagcccggcctctgagactgacttctgggactagtttcttgttttgtttttaaacccaagtccctgtgtgataacagcaaaaacctttatcagttaattaatcagtctgtctctctctcacacacagacacatacacacagattctgatgcgtcttcccgcgttaggctcactctcagcctgtctcctgggcatctccaccagccaagatgttgtaaaattttccttcctgtggttcgatgtgtgaaaacaataggtattcttttccttctctaagtatggagttatatcgtaatactcaacaggctctttcaacctacatggaaattctttccctgccccataaagattctggtgccttccccgagtttgggagtggagcatgcaactgtgattaagatgatttgatttagagatatttaaaatggcaccatcacccccaccatttcctttctctgttttcatgtgtaatggctccataatttttttatggcacacctctcggctgtgaacaataatttttaattgttgtgtgattatctcaaagtcagatcaccctgattttcctgctgttgtgcagctgctctgagccctttgtcagccacccatctgaaggactatgtgtttgtcatcaaatgttactaattccacaaatgaacctctgcccactggccttatgttcctgagtgaggggaacactgcccatactagctcgtgcgttctttgctgctctctaaagactggcctgaaacttcagaccctgagacttgaggaagctgagcccccgtgcccagccatggccatcatcactgtgaaatctgtgaaattggtcctacctttcttcctaacttttagatggataaactgaggcatggagcgatgaggtcacttgcccaaagccccactggcaaacgtagaaagctggatttgaacccaggtctagtggcctccaaagcccaccctgcctcactgcctccctgtgtggtggggaaacggatctcagcagtcaggctgcaccagcccctcgtgtgactggcagagaggtggggaaggaaagcagaaaaacacagccttggcatggctggaccaagacaggcctgggcccagctctcagctctccgccctcccacatagctgggcgaccttgttccgttcactccctcagtttcctctttaactagggacatgatgcctgcatctgatgacttgtaatgagttaaatgagatcctgaatgtgtgcaaagtgcccagtacacggccacgttcagtaaagtccctttggtcatcagcacagcctgggtaaacggacgatggggctgggcctgtgattctcgatcctgcacagtcagcttcatgttgctgcctcaggccaggcctctgcgtaggccacccaggctttgggtcctttgggagagctcagccgccaaccttgaggcagggctctggccctttcctcttgcctctggcaaaccagtctcctcgctcttatcccccaggattgagtgcaatggctcgatcttggctcactgtaacctccatctcccgggttcaaacgattcttctgcctctgcctcccaagtagctgtgattaagtcggcctcccaaagtgctgggattacaggcgtgagccacggcacctggcgtagcctttgggtttttgaggattccctgaggtcactcactctcctgcttgtacgtaggagtgatttttcctatttcctccttctatttctaataggctttcctccttcctatgtcctgtcatccatactgtctacatcacccttttggcacatagtaaatgttcagtttatttttgtagaaaggaggacagacatttctcctactgttccattttgatttatgtgtatatccccaactgaattgttagctcttggattaaaggactctgcctttttatgcccaataccccagtaccctacacacacacacacacacacacacacacacacacacgcacacacgcacgggcacacactttcacgcaggtgcacacatgcacacacacgcactccatactcagcagagaacctggaaggtagtcattatcttgctgaataaatgaatgcatgcgtgaatgaataaatttgttgagcatcaaggaataataaagagtcaatgaatatttatggaggagaaggttgattaagagaaacacctgggttctgggtaccttttagccacaggaaggattttagacagctgagtagaagtcttgtgttataagcggaaatcatttctctgtaggggtctagtgaccgtccagttccaaatctgtgtggtcagggccagggtgggacatgtggcccctgggccccaagcccccttctctgccctccctgcttcttccctgcctgcccttcactggcctcttgtccttaacccttccaggatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcggtaagcatccagcatggagaccaataaatgggccacagcggggagctgtcagctggcccagccagcttcccagctgcgcctgcttaaaggaggagcttggcagaatgggccgggcacggtggctcacacctgtaatcccagcactttgagaggtcaaggtgggtggatcacttgaggccaggagttcaagaccagcctggccaacatggcaaaaccctgtctctactaaaaatacaaaaattagctaggcatggtggcgtgcgcctgtagtcccaactactcgggaggctgaggcaggagaatcgcttgaaactgggaggcagaggttgcagtgagccgagatcgcgccactgcactccagcctgggcaacagagtgagactcttgtctaaaaaacaagaaaagaggagcctggcagaatggaagaccatagacttgggagtaggtgaagctgggttagaatgtctgccctcactcattgtatgatcctgagtaagtcacatatctctgaacctcagtttcttcatctgtaaaatgagactaataagacccaaggtacagagttttgagaactagagagcacatgtgtaaagcattagcatggtgtgtgtggcatgtagggtgtacacaagaactggtggctgtggtcgttacttttgtggcttcaagcttggcgtagcttttgactagtattgactgtgagttttgaaagttatgagcaaaagggatcgagactgaacacactagatcagattctaaggttgtgatccaatgaaagttctaacaacagcttatcagaggattagttattcagtgtaggcgggaatcatccttagcctcacggtgatcgggcttgcacgataagccctctggtcagagttctctttgcacttcactaggccttgggcacctctagttcacccctgtgttgatggtttttcctcagattagagctccacgttgtcttgtttgcagctgtatccttagttaatgtttgttggattcccgtctgcccactgggctcctcccccagtgtgaaatcatgacacctgtgctgtaccataaagctgcccaccttaaccctcccacagctgggaccatggctgtctccctctgctgctgtcccctgctccatcctgggaccctaaatgctgggagaggctgcattctgaaaagtcagtcaatttatccatcaacaacagaacctagatccgacaaatactgattgttttaaaaaactttaagatattcaaaggcaggtacaatagaagatacccaaaaggggacagatcttcttaaagggacacgaatcttaagagacaggaaatgattctaaatggacaattaacaatttaaggcaactgggtcttttagattacagggaaagtaggcaaaccaggtgaaggagacctttcctttctttcctgccccagccccacagagcagagccgccgctaggtaaaacacacccaccctttctcctggcctccgacagctcctgaagcagcagcagcagctgccttcagcctaacttcctgaggatgagcagggtggtgtgtatggaggtagggttgaagctcagtatgtccgaagcagcaaagccccagtctgagatgtccccctgcctgccttatgccaccaaagtgcctttgaaagggcatgcagcttttcattttagaaccagacacttaaaaggcaaatatgtctatcattgcaagactggaactcaaggacgacccttctccagtgcctaacatcacagctgggggcttggcagggcccatagtccaggtagtataacaaggtgggtcggttcctctgcttcagactcaccaggacctgggttcgaatctggactctgccacttactatgaggtcttgggtcaattacatcacctccctggcttgttttctcatgagtacagtgggaaccatgcctcctctgaattttgaaaattaaatgggaaatacatttaaatgtatttaaaccatgcctaggcttggcatgttgtggtggctgctgtttgtattgatgctactgttattcacccttgacctttgcacagcatttgacaggttacagagctgttttgtagacaccatcccacttgatcctgcagggtggaagctgggaaggtgttgctcactctgttggtagatgaggaaagcgagatccggagaggtcctcatgataggctagtgagtggcagagctgagacttgcttgatgcctggtcttgtgccctttcctctgtcccacaccacctccttcaggtacaagggacagacattagctccctttccgcagtgcctgcaagaacctgcagggggcgcagagcctgagggcctgaaggaaggagagacacggatgtccgccgtgcgctgtgcactgtaccatgctctttagagccactgcttccttaatcctcacaaccccagacttcggaattgttgttcccattttatagatgcagcaactgaggctcccagaggttaagtgactttgtcaaggatataccaccagtccaaaatggtgaggggctcactctctggggagcagttagcatttagaggggatggggcaggacagtggacaggccctctagcttcccagtgaggcccagaatgggctcttgtgcattgtgtgggttctggtctgactggttctggggctggttctcactgggagaaccttaggtctgagccaagattgagtccatccccactgttcctgacaatcaagccgtgggtggggagctgcatccaatgggccatggaacaacccaaaatcatgcattcaaccctgaccccgaggccaaggtctggtgataccaggaggccagaccgcagagttctgaagtcaagcagtcctggtgtgctagctgcttatcactcgtgtggccttggacaagtgacctggcttctctcccacttagtttcattatctgtacagtagggataatgatgcctcctaacacatacagttactgtgagtattgacttgcctgggatggttcaaagtgctgagcactggaatacatcggaatactagcctggcacctagtaggtgctcgtcaaagcacagctgccctccttggtggtggtaggtgagttccaacccagacttcttacaaacaagctgtatgactgcagagaggtcacccagatttttaggtcctcggctcatcacctataaagtgggaactaactgaaactcagctcattagtagggatgctctaagggttaattgggtgggcaaagaacaaagtcattatttcttatttattagagaagcgctggtatgtggacccagttgtcaggaaggaggtgcagaatacagctatgacacactgagcatctcacttgtattatttcattgaattctcatagtaaactcatggagtaggctgcatttgcacattttacagatgagactcatgaatatgaaggaaatgtatttcctaggaaatggtgaggctgggattagacccagagctgtgggacctcaaagcctgtattctttctctactcactctactgtcagattcagcagggagaggccctgggtcggcactgctggcggggagagcagccgagaagtgtggttcgcctgcctcctttccccagcggctgctccacagagttctcagcccaggccagccaagccccagcccaggtccagtgaacacaggagctggggtcacccccatgtcatactgactaggggcttccccggaagacatatcctggggtcctctccctcaaggctcagtcctcggaactagtctggaaatggcccctcacctgtgggcttgatacctgggactttgatacatggaaactcctgaagaggcagatggcaggtgagtgggtgacaaaaaaatgcaggagtgtgggccagtgcattcttgggcttaaggccaggctgggttcagcgtctccaagacaaaggggtcagccaacaggcgtcggaagggagccagagctgatgggcacgggaacaagccggaggtgcccaggccactctgacctgctgaggcgagggcttccctctaggcggagaggggagaagggacatttagagtgccagtgtggattgtgtcagccgatccggcaagatagttattaccatctgcttgtgtgaccttgggcaagccatgcatttctctgccaggtgaattcatgctaggctcctcagaggcaatccaggcagttctgtagcaggtgggccgaactaggccaggtgccactgtggcatgacctggcagtctgccagctggggatgctgacctcagctgcaggacacacagatgcctcgcacctcactctgccactcccccaagtggccagcatgggctgtccttgtaggttttggggagatgagagtgggtggcctcacttcatcagaggaaggaagcagccaggcccttcagcccttagacttggccctgccttggactttccaactgtgcttgtagctcagattattctaccagctagagagcctacaccaccccctccaaagcctccgagacttttctcaaacctgctgcctccattgtcttctgtggctaccaaagggcctctctaggcttgagctacaagtacactgtgtgcacctgtcctgtttgctttactgtattttatactgtaagatgaacgcatacaaaaaaatcaatgcgtgctcattgtgacaattcaagcaacacagattccataaagaaaaaactagcagtctgccttccagtctccctgggagatagacatacaatattccaatagcgttaaacgtgtccatgtcggtgatgtggcaattaatcatgtcaccctgtgacatcgctcgtatttttattttgacatattttcctaatacctgctgtctaattgagtttcatcttcctgcgcatattggaaggaagccatctatggacagcatctgcatcatgaatgctttctatccagtatggtgtctacaggagtgggtgctgccttcctgtttggggaatggttacgtggattgattgattcttagtctgtttgtgctattgtaacaaaataccacagactggatgatatggtttggctgtgtccccacccaaatctcatcctgaattgtagctccctcaattcccacattttgtggcaaggacccagtgggaggtcattgaatcacgggggcggctctttcccgtgctgttcttgtgatagtgaataagtctcacaagatcttatggttttaaaaatgggagttctcctgcacagcctctctctctctttgcctgttgccacccatgtaagacgtgacttgctcctccttgccttccaccacgatggtgaggcctccccagccacgtggaactggaagtccattaaacctctttcttttgtaaattgcccagtcttgggtatgtctgtatcaacagtgggaaaacagactaatacactggataatttgtaaacaacagaaatttatttctcactgttctggacgctgtgaagtccaagatcaaggcacgggcttgttcagtgtctgttaagggttgctctctgcttccaagatggcaccatgaactgtgtcttcacatggcatatgggactgaagaggggggaactggccccctcaagcccttttataagacactaatccattcatagagcagagccctcatgacctaaaggccccatctcttaaaactgctccttaaggattaagttccaacatgaattttggaggggacacagacattcaaataatagcattgactcaacgatgtgaggatgggagggagcgtccagggcttcttagggccagctgggctgcttcagcttcacctccggttttctgagccaacctgcaggaaaggacagggaagcagaaaaggcttaggctccagtcctggccacagccacttttgcgacctaggacgagttacccaacctcttacttgtaaatggagtgtgataacagccactgtggaatggtcaggacaagatgcacacacagccatgcctatgcccatctcagaggaagcagttcactttctcaggaaggcttagaagtccagcatgctacccactagctctgccttgataggccagtttcttcacgcacctgggcctcattttccttgtctctgaaatgggatggtgatatccgcctcaggggaccagggtgaggttgtgacagcagcacagggcctgctgtagatgctgtgagcggtggcagtggtggaattatttttgttctgcagagcaaggcgtctcctttatcagcaccccttccccccagcacaggatggggctcctgaggcctgtgactgtctgaacggagtctagttttatctaaaacaaacactggtcctgccctggtgtggagtcagggccccacaggctcctggccagatggtcccactgcatcaagggaggccgcacgattcccagacacccctatcccagcagcatgtgggggattcccagacacccctatcccagcagcgcgtgggggattcccagacacccctatcccagcagcatacgggggattcccagacacccctatcataccccacagctctgcctgcctgggcgttcatttcctccctgaggagtgatgtggagagggcattccaatgaaaactcccagaggaagaagcggccgatgaaatggtgctctgtcttcctctctgggactttggggtagggactgaggaagcttctggaactcggggcccctagaaggaagtacccaggcagtgtggagctctgttgtgtggccctaggctgccaaaagatcttcatagcacaaggaggccgcagaagtgctgctgtctccaaaatgtgtccccagcatagtgccaggagccacactgttgggtgttggcttcttctttgcctccatgaaatcttctgggaagtaaacatgagccaggggtgtcttaaaggagaccacagcatcaagccctggtcttgctgaactcagagtgacagccccgaaaggggacagtgccagcctggggctagtctgaaaaaagataccgagacgagcaccccttgagaggcaaggttgggggcctgaacgaggggctatggagggttggcacagtcctagagacctttttcttattcagaaaaaggtctgtgcctgatttcactttgttttgttttgtttgaaaccaagtctcgatctgtcgcccaggctggagtacagtggcgctatctcggctcactgcaacctccgccatctgggttcaagcgattcttgtgcctcagcctgccgagtagctgggactacaagcacccgccaccacacccggataacttttgtatttttagtagagacagggtttcaccaggttggccaggctggtctcaaactcctgacctcaagtgatccacccaccttggcctcccaaagtgctgggattacagacatgagccactcatttcactttgaagcccagtcacctcccgcaggctagagtgctacgtttctctgtcattcattcctttattcactcaccaattatgcatcagacactttctgtgtgccaggcattgcttggggctggggattatgtaggaataagacagtcttttcttgtggaagttacattccagcagggaagacagacagtaaacaaataaatgactaaatacatgataggattgtaaagagaagggctcaaaaacatcaagtagggcatggggccagagagggaagaggcgattgtagctgcagcgatcaggaagggatgggctttctcagaagggatgtctgagcagatgcttgagttaaggagagaagagaccagccagccatggggaagagtgtggggcaggagctggagacaggtgggagcgcagaccccgtcacccagggtggcatttctcagcctgcagttatcattacgcctccatgaaatgttaatgccacaggtactctggatgtctgttgctattcttagtctgtatacacagagtaaaaagcgtgagatgctttgtcctgcaagaataaattcctgggggcagtattgcccctgttggggatgcgtgatatagagccttctggccaatttcaggaattggggctgggtgcggtggctgacgcctgtaatcccagcactttgggaggccgagacaggcagaccacctgaggtcaggagtttgagaacagcctggccaacacagtgaaaccctgtctctactaaaaatacaaaaattagccgggcgtgatggaggatgcctgtaatcccagctactcgggaggctgaggcaggagaatcacttgaacccaggagacggaggttgcagtgagccaagttcgtgccactgcactccagcctgggcgacagagcgagactcagtgtcaaaaaaaaaaaggggggggggaattggtatattccagtgcctatttggactaaaaggagttcaagacaatgcactctacagactccccagaccagggctccccttgggtgtctcatagaggcctcaaacttcgagtgtctggagctgagctttaggcagtagctgtgtgcactgaagctccttcctaagcctgcccctcatcctcaggctgcggttccccagtgtcagcagcttctcactcaggccaaagaaacttgactccattcttgactctcctttctctcatgttccaaatacttctcgcccccttctctgccgccatcctggccaagcgcccacctttgctcacctggtcccctgcagcagcctcccgcctggcagcctcacttgggctcttgtcccctggagcctgcaggatagtaggtgctccctgagtgaggaggaaaaagaagaggtgggagagtgtgccgtgggttgtccccgtgggctcctggaaccagggggaggaagaggaaccgtaccttctaccagggctcctgccccagccagcattggcagtggggatactgatgacacacacagagggggcatgaacaccaactcctggcggggccccctcatcctgtccactcctgccccacctgcccgatttcctttaaaaaaaaaaagggaatcttggccaagcatggtggctcacgcctgtaatcccagcatttggggaggctgaagtgggcagatcacacgtcaagagattgagaccatcctggccaacatggtgaaacccagtctctactaaaaatacaaaaattagccaggcgtggtggtacacgcctgtagtcccagctactcgggaggctgaggcaggagaatcacttgaacccaggaggtggaggttgcagtgagccgagattgcgcccctgcgctccagcctagtgacagagcgagactctgtctcaaaaaaaaaaaaaataaatataaaaaaaggaaaccttaggtgggcatccggcctcatcaccctctcatcttccagatgtccttcctctccagaaagggacactgggctctgttcttgcagccaccacctgttgctaggggcctactaggtccctatccagggctggttctggggctgcagggaccactaagacatggaatggcggaggggcagcccaggcacagcccctgcttctactccacattgagttcatccttcagcccgaagctcaaacgaagcttccccggggccttgcttggcttccctggtctcctcccgccctccccttcaaggcctctgggatgttctcacagcgttcaccccgtgcgtaatcagatgctcccgcgagtccttggctgccgtttgcctcactcaccacgctgcatgcctcacgtggacaggcctccagttatgttgcccactgtcccccacacccggcctggcggttgccaggcaaaaggaactttgtaaacaatgtgggaaagcaagtgagcgtggcacccaggtggtgggggccaaaggaatggagtttgaacctggcctgtggcagcctctcagcgaaggagcaagggaggctgtgtctgaaggaggcattccttctccctcccggtgataatttggggcttgcagacaggtgttagggaagagggcctcggaactcgctgtgattagcacagccaggctgctcctgggagctgttctttaggcctcttatctttgtggccttgggggagggagatgccaggctcactcatgggccagagcacacagagtgccttccccagcgctggccctggcatttcagggctttggccggagccagatgtggagggtgagacgctgcatctgaggcctggggagcaatgacgattctcctgctttttcttccaagagcttcattgggagtgttgccataggaacgaggcccctgggaggggcgaggcactccccttttgctctccctgatcttctgtatcccagcttccccatttccgccctcccctcacagagtcctcttctcagagctgccgtggtgcctgggggacatgcaggtgtttccagcacttagcaacccagtagcccatggtctccagggctgtacgaaccctccatagcccctcgttcaggcccctgaccctgtctctcaaggggctctcttgtctctgtgtcttccttcagactagccccaagctggtcccgtccccctttcagggccatcaccctgacgtcagcaagaccggggctcgatgctctgatcagtgaaagccatggtgctatttatggtgaggatcggggggcagggagctctcggggtgaggctgggaaagctgatgaaagactggccaggaagtgactcatgtcctttgctccaagtgactacgccagacagctttcttttctccaagcagtccgcctgccctttcaggcatccccgcttgtccccacactgtcctgtcctgctccgcgcaacccagtggcctctcccctcccttccacctggtgaacaacttcagctttcagaaccagctcaaatggaacgccctctggagacccctcttctccccacccctccgaagggagtgacttttctctgtgttccatagccacgtgcgttgttcatagcactgtcgtgtcttgtggtcatttctttgagtttctgctgggtgccaggcacagggctgggctctgaattttataggcataaataagacccgctttctgtcccaaggagctcacggtctaatggtggacacaggtatgcagagcggtgagggcctttgggaatgaacatcttaggagagccttcatcaaaaagatgtccccgtagaggccttgaggttgagtaggattttaacagggtcccatgcagaagctccttggggacagggatgttttctcttgtgtcccacagcttacacagggcctagcatagagtaagcatctagtatctggtcagagggtggatggatacagttctgccaggaaagtctttgtgaaggagctggggtttgagggatctttgaaggaggcaaaggaaggggcttcagggccagagagaaatgaacatgaaatgagggaatgtgtctggagcagtgagtttcccagaggaggcaagagggacagatggaattgaggggtttagagtatctggcatggcctggagcagggctctgagaagaaggctcatgcacagagccccagtatatagtgggtcccttgtggacctgagtggcaggaagcggtcatcttcaccaggtgcacccaccggagcattgcctttagcaggtggcatctggaccagggcactgaggtgagggagaagggaacagaatctccgggtgtctggggtaaggtctgagaagccactgcaggagggagatgctgcttgctggagttggcaagggcggtggaaaacggccccaggagttggctgtaagcctggtgaacgtgcctagcccctccaaggaggaagcaaaaagtaaattcataatgaatgagccttttgagtttccatccaacttcagtctttatcacaagaaagatcatctggtatctgaaaaccaagaccggcctctgtcccatgcaccaggcaggggtgttcgtaccacacgttatccacaggggaagaacactgtcctgctggtgggcacgtgcggtcaacccggggacacgtctgtgaacccaactggcagagggagagaaacgtggtcgattctttttctttgcagtcagcaaaatttcgggagcgccttcagcttgccaggctctgtccaggggccctcacatactcacggtgacggcattcctcactgccactccgacaggcagatgtcagagctcctttgcagctgagaacaccaaggctccgaaaagagggactgccccaaagccacccagtgggcaagtggggccgcattgcaaactccactgtctgttgttccagaaaactccacggccagcgtgagcgaggcagagagaaaggcgcaagtatactaccgtgcgtgcatgaacgagaccaggatcgaggagctcagggccaaacctctaatggagttgattgagagggtgagtgcctcgggctctccctccccaagccccggcccatgccacctgcccgccccctggcttccactccagccttctggtaccactggcccacctcatacgtccagccggtagcaccaagagaaagacagaaagagagagagcgagtgtgcgagagcacatgtgagtgtgagcacattgcgtagctgcgtgggtgggttgtctgtgcatgtgtttgtgtgagagtgtgtgtcagcatctgttgtagatgtctgtcatctgtctgtgtgtctctctgtgcatctgtgtgtgggatgggggccatgtttagagggaaaatattcctccacgttgctgctgttttttcctcaggggttatgtttgtgtgtgtggaggggtgtgtgcctgttccagaaagacccacagagagtcttggcccagaaccagagccctccccgtgagcagggacccaggccactctcctatacctgcttactcctgagcaggggaagacatctttcttgctttcttgggcacttcccagactctgaggcttcctggtgcagacagtaggtgtctgtggatgttttctgcctgcctcgtgttccctggacagccctgcctcttagcttggctccaggaaagcattgcagcagggttggtggctgcatgcgctggggactatgctagtcccctcctctctggacaggtcccatgtgccaaaccagggaagaccagggagattttttaaaatcccaactttctcgggaggctgaggcaggaggatcacttgaagccaggagtttaagaccagcctgggcagcatagcaagaccccatctccaaaaaatttaaaaattagccaggtgtggtgatacacacctgtagtcatagctacttaggaggatgaggtgagacaatcacctgagcccaggaggtggaggctgcagtgagttgtgatggccccactgcacttcagcctgggaatcagagcaagactccatctcaaaaaaaatttttttaaaatcccaactttgagactaaagtagaccgtaatttaccaaccttcttaaacatgtggagccttttttatcccagaggcacaattgaatttatgttttgatataatcacattcacacaattcattatccaaaatataaaccgtgaaccgggaaaagtctctttcccattctcatcccagccacccagggagcggctggattcatgcctggctgcttggcttgtctaggataagcctttgctccatccatgggtctccagctcatgggtcggaaacccccgatgaagaccaatcctttcctttgctcttgaggctcagagaggtcaggcgactgctccagggtcacagagcaagtcagcggcagaaccagaattcacatctgggtctccccgccacctcatcacctccctgcctgctctccctccccacagctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtgagctagcttgaacctgcagcggtcgagggggcgggcacgacctcttcctgttttgagtttagcaggacctggggtgggagaggggcttgccctgggtgggacggcggtcttctagtttctgagcctgggttatttccagaggccccactggtgagatctttgcaggctgctggccttgcgtagatgggcactgcatacaggtgaaactttgggtgctgatgggtttccgtgggccccaagagtgatgtcaactcctgggcacagctgaacccacatcctggtttccccctccttagcgtctgctctttgtaactcttcttggaatgggtttgaatccatctctccctgtcagagcatgccccagacagaggctcagcctgcccaggggagctccagcactggtctgccccaacctccaatgcagaagtgagaaacccaggctgggggtcctaaaagctgagttcccagcccatctctaccattcagtcactgtgtgaccttgggcaagtgcctcaacctctcagagctacagttaccttataaatcaaatggattgcaataacacctgtcctaggtatgccaagatgtggccatgggcgccaatagtagcaagcagaatttgaccctcccctcctgcttggcaggcacttgaccagcactgtcttcttgaatccccattctagctctgaaggttaggttttattttccctatttacctgagaagaaacctgagaatcagaaaggttcagtaacttggccaagatcacacagcttttgagtgactcttaaccacctggaaagcgttggggagatagaggcactttgccgaggcaagtagctgtttaaaaaggagggtggctctgtccagcccttctgaggagcccaggagccctgcgggggggggccacgtggacaggcaggaatgtgtcatcccgtccctgagtgggcttctcagtgactgtagccagcagtcctgcttctccaagggcctgagctgggcctctgctgccatgtgccagccattcccagggcaggaggccgtgcagtggatacacgcattgcaacacgaattccctctcatgcctgcttctcttgccaggtggaccagtctggcctgggcttgccctcgagagactattacctgaacaaaactgaaaacgagaaggtaagcgtgcctctcccctcccagcctgcctcccagcacggtccttcctgctccgtgtccacacccacacctgtgcaggtctttgaagctaggggagcccaggggtgtcagtgacctgatgggtgaaacaggcagaccctggcaggggagggacacccctaggctggctgtgtcactcaggcatcatggacacaaggggcaagagacaggtatcatttgtcctggttctagagagaggcagaggcagcaataacagctaccacaattcgcctggccctttatacatcacctgtgaccctcccattaaccctgcagatactgaacttcatttgcctcatctgtcaaacaggaattagttttgtcttgccttttacagaagagggtatcaggctcagagatgctaagtgatctgctcaaggtcacatagccagtaaatgacgagcctgagattcacatccggatccacgtgctccgaagcccatggctctccctccccctggcctgcctcttgtgatgcctcttggggcgacctcacctggaactcattcatctgtcctttcatccttccgccggcatgtacttgaccaagcgcccacagagtgcctgatgctggggagatggtagcagacaagaccaccatagccttcgtcccacagggcctgtggtttggtcggcgaggcggatattatttaactaagagaaagtggagctgagaaagtctaccgtggagacctaattcagatcttggaacacgggtggggggtggtcagaaaagatgcattctaagaatggaaagacagccccaggacaagccctggaagacagggaccagcccaggtggggacctgtgagacgagccaagactttgggctttctcctggaggctgtagggaagcagcagagagacacggccccgagatcattctcaatgctgtgtctcccacgggtgtcttcttcttttttttttgagacaaagtctctctctgccgcccaggctagagtgccatggcgcacgatctgggctcactgcaacctcctcctcctgggttcaagtgattctcctgcctcagcctcctgagtagctgggattataggcacctcccactatgctcagctaatttttgtatttttagtagagacggggtttcgccatgttggccaggttggtctcaaactcctgaccttaggtgatccacacacctcagcctcccaaagtgccaggattacaggcgtgagccaccacacctggccccacgggtgtcttgggggcactgtgcagccccctggctccctgtgccggacttggctggccaagccccccaccaactctcgtccagtggatagtgggggggcagccactgacagtttggggtatgggccctgcaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcaggtaacttgagcgccggctgctagggaggctgggatggcctccaggtttcagacagggccctggactgggggcttttatactcatttcatctagtccttgaaactatgtgacaaaggaaggatggttgttatgcccagtccacagatggaaaaactgatgctcagaaaggtcaagttacctgctgaagggcacacagctagtaagtgactccaaaataggcgcctggccgacaccaggctgcttctctgtaattaatagtgtttacttggaggctcggggtcatgaccacaccagcttacattgacagcgcctttccagtctctccagcaccaagcacatcgaacttggttacagtgagcacttaataaatgcatggtgtggattctgtcattacttttcccttttctgagccagatcaaggtccggaggctcctaagtggcagaggagccagccgcagatgggctcactgtacaacagggcgttagatctgtgatgctctctgtcacccattggagaagcccaacgtccaagggctcagcctctgccaaaggctgccctctggtggctgcttggttcttgagggtccagagagaatagcttgctggttccttctttccagagcatcagctggcattgcagagggatcagcagaatggccaccaccgatcttgccgtttcttgacatcacccaggaatgcgtggccaggccttgcttctctgctgaggaggggctcccgcagagtgtcatctccctccttccttaccttgtgaccagccgaatttgacctgttgtccgttccttctactttcaggaagaacactaggtccctgccctttaccctcctccagctgacaggtgtatatgggtccgtcttgggaccttgcgcttcatgtgcttcctggctagtgggggacaccagctagaaacaaccctgtctcattgctgagtgctttgggcaaaagcagcgggccctgggagccaggggtggggagaagtcagggaaggtgagtctaacgatagatgagcatttccaggccaactgggtgtcccaggcggagatgcaggccgtgctagggcccacgatcagggtcaggggagcctggcctcctgctggtgctggctgcccttcagctcccagagaaactggcctgaggctcagtggtgctgctcagaccaggatggagatcaacagctgctgttagataccatctggcactcttttcctgctctgaggccaggaggctgagggtgatgttgtttgtgcattataatttggtttgttccagccgatttctcagcctgaggggcccccgcagtgcctcagccccctaccgtggccatgatgccaactgtctgtgccaggaatagcggagaaggcacaggagccctgagcacatcagcccagcatggccaccaggttccccccaggcatcctatcaccactgcttctgctctcttcttccaagcagaggaagaaaggcttttcctgcctcccagctgcacagctgccaaggtggggggagtttagcagactcagcagcttgtagtacacaagccctgggcttagattcagaggactgtaagccccttggagctctaagtgctgggattataagcatgagccaccacgcctggccaaacagcctctgtgttctaagtacccaaagttcaattaagatctttaggaaatatatggattctctcgagtttttacagatatttctgattaaattctaatgtgaatttggctgccttccttgtaaaatgggcttggctcgttcactcaccccagctgtgtgccagaacacaaatgagacatagcccttgccctcacaagggactgtggttcctcttttttttttttttttttttttgagacaaagtcttgctctgtcgcccaggatggagtgcagtggcatgatctcagcttactgcaacctctgcctcccaggttcaagcgattctcctgcctcagcctcctgagtagctggaattacaggcaggcaccaccacgcccggctaatttttgtatttttagtagagtcggggtttcaccatgttggtcaggctggtctcgaactcctgacctcgtaatccacccgcctcggcgtcccaaagtgctgggattacaggcatgagccaccgcacctggcctgtggttctttttttttttttaatttgagacagagtctcgcgctctcgcccaggctggagtgcagtggcgccatctcggctctctgcaagctccacctcctgggttcacgccattctcccacctcagcctcccgagtagctgggactacaggcacccgccaccacgcccggctaatttttttgtatttttagtagagaccgggtttcaccgtgttagccaggatggtctcgatctcctgtcttcgtgagttgcccgcctcggcctcccagagtgttgggattacaggcgtgagccaccgcgcccggcctgtggttcttaactttaagtcacagagtcctttgagaacagatcaaaaaccatggactatctcccagaataaatgggtatatatgcatatttttaaaattatgtctgacatttaaagacgtcctggccgggcatggtggctcaggcctgtaattccagcactttgggaggccgaggcaggtggatcacctgaggtcaggagttcaagaccagcctgaccaatatggtaaaaccccgtctctactaaaaatacaaaaattagccgggtgtggtggtgtgcgccggttgtcccagctactcggtaggctgaggcaggagaatcacttgaacccaggaggcggaggttgcattgagccaagatcacaccactgcactccagcttgggtgacagagcgagactccgtctcaaaaaaataaaataaaataaaataaaataaaataataaagaagtcctggccccctgaagcctgtgttctaagtaagaatctcttcctggcctgccacacagggttgttggagaataagttgaggtaaaggatgagagttcattcagtaaactcatttgcacaacccagtacaagcataacatattatattcatcattattgttactattcctttgttattagcgatgtcacccaggaacccagcactaaatcaatttgattcattctactctgggacagagaatgtcttgttccctggtgtctggaaatggggttttcttcccatactccaggtaacttagggaaaagcacgccaggtttcacagtgtggttctaggctagccctgctggggtacagaatgcttccaggctagtccccagcagagtctgaactcagagctgtgaatcagacactcttccattacttctgggggcctgaggaccttccccttcctttctaggaccctcacgccaaaggctgtttgggcctgagccccattttctaccccatttctccagctgagatgaagctcagaagcattcttctcttctctcccagtttcaaacctatttgaattggttggtttgtgacccacagtactccttggctgcaggtgtggaaaatggagctcactggtgtgccccagagggtgtgagtcacaagtggaatgtcctagtcagttaaaacagccgtctccatggagatggagctaggcacatgtgtttaagataggagttcactaaagcagccaggatggaaaatgtgaaaatcctggtattcaacacatcttatctgacagtcatgggaacttccctgcacagaacacctgctttccctaaagggccagggttgtgttgaagagtacacagggatttctcaccgtcttatatctgtaccttgatcagagagttccagttgtctgcagtttatggagctctcgtccactgtgtaaacactgacagtttgtaaacttgtcgattttcccaaggcctttgccaacaggtcatgcagtcaggtggctctaatggtggaaccctatttgaggatctcacaagcacagctccagtttttgtagtcacagaaatgttaaagattagcctcagaggttacctgcctgagggcctcctaccaggaggagggcagagaggacaaggtaaagagaaaagaaactcagggttattgggcaagcaggtataagaggcacagatctatcagctctgggaggggaggctgttttcccctttttagagaaagaacggaaaaaggctggaggtcccagagctggttcctcctggggatgctgatccaggtctgctcattcttagctcattcttagcccaagtggctcttcccagctcacctagctggcagggatgcactggagccccctggcccccaagtccgctgcgcacatctcttaccagctccgcaggtattttaccatcagccacggtgggaagagttacccagaaactgagagccagttgttaactgttttgtttttgtttttgttttgagacagagcttcgccctgttgcccaggctggagtgcagtggcatgatcttggctcactgcagcctccgcctcccaggctcaagtgattctcatgcctcagcctcccaagtagctgggattacaggcgtgcaccaccacgcctggctaatttttttatacttttagcagagatagggtttcatcatgttggccaggctggtcttgaactcctggactcaggtgattctcctgtcttggcctcccaaagtgctgggatttacaggcatgagccaccgtgcccggcgcagttgttaactgtttaccagcacgccactgccttcaggacctgccctcctcacaaattcacctgtcctttgaggtccttgttccccagcagctgagttgcccttttaaacccaaagagatgagtgaacctgggttttagacctccacagtggctagttaactatgtgacctcaggaaagtcaccttaccccatctgcaaattcagcatctcttttttttttgagactgagtctcgctctgtcgcccaggctggatgcagtggcgcgatccccgctcactgcaagctctgcctcccgggttcatgccattctcctgcctcagcctcccgcgtagctgggactacaggcgtccaccataatgcccggctaattttttgtatttttagtagagatggggtttcaccctcttagtcaggatggtctccctttcctgacctcgtgatctgcccgcctcggcctcccaaagtgctggggttacaggcgtgagccaccgcgcccggcctcagcatctgttaagtgggggtttatggctacctccctcacagagggtgtcatcagtatttaccaacaggctatagactggtcttacattacagatcaattttactttattgattgatttttccatgtgaaggccatatgtggagcctctctcacctcctttgtcttgcattttgtcctttttcaagaaaacaaaagagaatttggaattggacaggcccaggaacatacatgggagaccttgaacaaagattgtaatggccaatattgatgagttgcttgctaaatgccagacatatccatctaagtgatcgacatgtacaggcatttttgctgtagcagtatatataattccaaaaaaccttgtgttctgtaaaatcgcacactaaaaatagcagtacgtgtggggaaaatagaacaagagcagaacaaaagttatgcaactttacttgaggatactgtgctaagcgaaataagccaatcacaaaaggacaaatactgcctgattctacttatatgaggtacctagaatagtcaagttcatagagacagaaagtagaatggtagtttccaggagtgggggttggggccagtgggaagttattgcctgatgggtagagtctcacatttgcaagatgaaatctgtggggccagacgcggtggcttatgcctgtaatcccctcactttgggaggccaagacgggtggatcaccagaggtcaggagttcgagaccagtctgaccaatatggtaaaaccccgtctctattaaaaaaaaaaaaaaaaaaattagccaaggtggtggcatgtgcctgtagtcccagctacttgggaggctgggacaggagaatcacttgaacccgggaggcggaggttgcaatgagctgagatcgcaccactgcactccagcgtgggcaacagagtgagactgtgtctcaaaacaaaataaataatttaaaaaagcaatctgtggctggatagtggtggtgatggtagcactgcagtgtgaatggactgaatgcccctgaactgtgctcttttttttctgaggcagggtttcactctgtcaaccaggctgaagtgtagtggtgtgatttcagctcactgcagcctcgacctcccaggctcaagcaattctcccacctgggactacaggctcagacctccatgcctagctaagttttaaattttttttgtaaagatggggtgtcaccatgttgcccaggctggtcttgaactcctgggctcaagcgatctgcccacctcagtctcccaaagtgctgggattacaggcatgagtcactgctcctgtccttgaactgtgctcttaaacatggtgaagatggtgaattttatatgtattttaccacagcttttttttttttgagatggagtctcgctctgttgcccaggctggagtgcagtggcgtgatcttggctcactgtaacctctgcctccctggttcaagcgattctcctgcctcagcatcccgagtagctgggactacaggcatgtaccaccacgcccagctaatttttgtaattttggtagagacagggtttcaccatgttgtccaggctggtcttgaactcctgacctcaggtgatccactggcctcggccttccaaagggtaccacaattttttttaagttgcgcaactttgtaatcagaatcctaacaaaacaataattagaaacttgaggagtacctcagcatggctggaggctgccgtggggaaagcaccagctgggaaatgctagctgtggacaccaagaccctgcagataagacagggagctctggccaggtggggtggctcaaagtgctgttaatcccagccctttgggaggccgaggcaggcagatcatgaggtcaggagttcgagaccagcctgaccaacatggtgaaaccctgtctctactaaaaatacaaaaattagccaggagtggtggctcacacctgtaatcccagctactagggaggctgaggcaggagaatcgcttgaacctgggaggcggaggttgcagtgagctgagatcacgccactgcactagagcctagacatgagagcaagattccatctcaaaaaaaaaagaaaagaaaaagagagctctgaacaagcgcctttagggtcacagagaaagtgcaacctgctggaggctgagagttacagggctggaaggcgcctctgtgaggagaggaagccccaggcgcgagcgctcattttcagtcatcttaaaatagagcagaccaggctgggtgcggtagctcatgcctataatcccagcactttgggaggctgaggcaggcgggtcacttgaggtcaggagttcaaggccagcctggccaagatggcaaaaccccatctctactaaaaatacgaaaattaagtgggcatggtggtgggtgcctgttgtaatcccagctactcgggaagctgaaacaggagaatcacttgaaccctggaggcagaggttacagtgagccaagatggcaccactgcactccagcctggacaagagagtgagactccgtctcaaaaaaaaaaaaaaagtagagctgaccagcctgctgtgtgcattagctgagctgagggcttttcctttcttgctgaaagttaatgttcaacccttcccgatcccatgcctgagaaatatcaccttcggaccaatgcagctcagaagttatgctgctgtcttcctgaatttaccaatcatgtagaagttcactgatgttacttacagaatcccatgttgaatagaacaaacagcataagcttgttcagtcctcacaaataacccagtgaagtgggttctgttattatggtgatccccacttctcagacaagatactgaggcccagaaggatgcattaacttacccagggttacacagctagcaaggaagagagctagaagatgagcccaggcagtttggctgcagagtctacaagctcaactgtttcaggcctgtctaaagctcagtctcctcatccatgaagcagggataatagtacctactgcttggactcgcgtgaggaccaggtggaatcatatgcatcaatcatttgccacggctcctggcacacaggagacgcttgctgaatggtagcggcagctgctgcatcttctcattgcatcctcattccatttcaggttaaattttggtgttggactccttagaattctacctacagcatctctgacaaaagcccgccaggctccgcttgactctctgcccggtgcgctgtcagatggcgccaagcccaagctctttcctttgcttcctgtagaagcccgtcctagagccctgggctgtgaggaggagcagccccacagggtcacactgtccttttcccttgcagaccttggcacccgccatcaactggttgccttttctcaacaccatcttctaccccgtggagatcaatgaatccgagcctattgtggtctatgacaaggaataccttgagcagatctccactctcatcaacaccaccgacagatggtaagaggacccccagtggcctggggcacgcctctcacagacagccctcttcttgggcaggtgggcaggggtggggatgacagtctgactcaggagagtgggacctgggcgggcttttacgagaggcagcaggacatcctggttacaggcacaggtttaaatcccagcctctttcaaactaccagctttgtagccttgggcaaatttcgtaacctttcttaagttcattctcctccttcataaaatggtgatacaaatatcacctgtggccgggcatgaacgcccgtaattgcgggacttttgggagacagaggcaggaggatcccttgagtccctgcgtttcagaccagcctgggcaacatggcgagacggtgtctctacaaaaaataaaaaattagccagacatggtgtcgcgtgcctgtcacccagctccttgagagggaggctgaagtggaaggatctcttgagctcaggaggcagaggttgtagtgagctgtgattgcactgttgcactccagcgtgggagacagagtaaaaccctgtctcaaacaaaaaaacctagcacctaccatttagggctgttgtgagaatcaagtgaaacaatccatatgaggtgatttaatagagtgcctagcatatactgggactcagtaaatgttggctattatttttagttaatacttacgattttctttcttttcttttctttttttttttttttttgagatggagtctcactctgtcacccaggctggagtgcagtggcgcgatctcaactcactgcaacctctgcttcccaggtttaaatgattctcctgcctcagcctcccaaacagctgggattataggcgcctgccaccacaccggctaatgtttgtatttttagtagagatggggtttcaccatgtttgccaggctggtccccaactcctgacctcagttgatctgcctgcctcagcctcccaaagagctaggattacaggcataagccaccacacccagcaatacttataatttttaaaaaattttttgaaaactaccaaaaaaatagggaaaaaaatttatcgtatttaacttatttttttcctaactccccaaacttacttgttaaaatttttttaatgagatggggtctcactatgttgcccaggctggtctcaaactcctggtctcaggcaatcctcccaccttggcctctcaaaatgctaagattacaggtgtgagccacctcaccaggctctgaaaaaattttaaatgactcctgttgatcttgtggtatgtgtgtgtgcatatgtagagagaaagcatgggggagggcaggagagaggagggaaagagagatcggttttctaatatgtggtctttttttcccattatcataactaaatgtctagtctccttttcccttgacctgtatcctgaacattttcccccttgtcatctcaaaacctctgcaaacatcatttttcatggttgcatagtactccgtcgtgtacaaatacagttctttacttcctccttctcattatcaggcattttggttgattctgattagaggttagatgttcactacagtctcaaggtgacttcttggcaacggtggcaacagctacagataggttccctgtgccctgcaggtggggcagtaggagctgtcatcatggaaagcttggcctggctgggctgagcttcttttcctgcccctgctattcttagcctctctggccttctggctggggcacctccaagctgtagaagtggtagtcacctctccagcccagccctgtagcatacaccattggggtgggtctccatgctggggcttcatagcttccagacacagagcagctaggcaacaagcatttattgagcacctgtggtatacaagtgactgcactcaacactgaagcgtttcctatggtagaagacccaggcttttcccttgaagagcttacattgcacgtgcttagggagcagtaacccaccaagcccccgcaggctggaaggggcctggggtcacaggccaagtttgagagccccctaggggccagcaggggaagggccgcaatcctccctgcctaggtgtccctgagcctctctggcctcctctccccgcagcctgctcaacaactacatgatctggaacctggtgcggaaaacaagctccttccttgaccagcgctttcaggacgccgatgagaagttcatggaagtcatgtacgggaccaagaaggtgagcctgctactgcgtatgcctgaatatgggctgagcgcctactttatgccaaggtgtctatgggagcacaggaagggacctcagccagctgggggtgggtagaagcttccggaaggagtgcttatgccaagtaaagggtaaagaggagtcctagccactcagccaatttatagcaaaaagtagttgccagtagtgatgatagatgctccccttgaacaactcatgatcctcacaatgcctgtgaggtgagtactgttattagccccactttgcacaggggaccaccaatagtattacttcttccccggaaacgtaaaacacagaacagcacctggtccttagaagcaccacgcgactgttcagtgttattattttcctcccagtttgtattctgggaaaccccaggccaggtgggctctacctgccgttaaatgcccctgccaggagccctgagggtccattcttccaaaggcttcagggaccttccctgccctcccacaggggaacctacccccagtggaaagttccacagccacttccaccttctccccaaggaagtggctgtcaccctctcactcatgcagccgactaatggttactcattgaactcctgccatcgcgtgccaggctctaagcccagtacgggaatactgagacaggtgagctggggtctgtaccccgagagcccacaccggctgagggaggtgataggaaatgaccagttctcgtatgtgctgatgggatacatcacgctcgggccccagagagtggctggaagaggccccgctacagagcagtagaggctggtgtgccaagctcacctggcacagcttccccaacccagacagcagctagcaagaccccaacaatcctccccagagaggaggcagagctgactccagctggaccccactcctgcagcccttcccagagtccaatccagatgaggattggcagagaatggcaggatgtgggctcctgcttcgagccctggaatgcatcctacacgtcctctctcccatccccatgcaaacctacctctggcaggaaggggactgagggagaaggtagctgggaacaagccccatttctaaccagaggcacttccaagggcaccaccagaccttggccacaagaagcatactgccctgcagaggacaaagcgggagcagtgggttggctgccctgcctggccaacttgccttcctgctcctcctgcatctaccttggactggccctgggttagagatggggccaaagccaggattctgttccctgcagaacttggcctcccaggggacttcctacagagagatttgatcaggacccaggatgatggttccaaagatggtctgtgtgtggaacatacacccacatattctctcaccttcccaggttacagatgaggaaactgaggctcagggaggtgaagggactttcatagtcacccagcaagaaagcagcaagggcctggtgtggtggctcacgcctgtagtgctaacactttgagaggccgagacaggtggatcacctgagcccagcctggaaaacagcaagatcctgtctctgttttttttttttttttaatatatttatgtgtttattttaagaaaaaagaaagcagcaagcttgaatgaaaatcccagatctgatatttacaactttgaggcactttcagctactcacttacataatgatgataataaccaaagataccattattggatatctaccttttataggcattatgaattcctactaccgctgttatcctcttccattttacagatgatgaaatcgaggctcagtgagggaaagggacttgttcaaagttgcttataagtggagaggaggctctgaaatccagcctatctgattccatagccctgagctctgtaccactcagcctctgctctgcaggaaccaaaagttaaggtcaagcttccctgtggttgccaagggctgatatggaggaagagggatgaggaattattgtttaatgagtatagagtttcagatttgcaagataaaaaagttctgagccaggcgcagtggtgcatgtctgtagtcccagctaccctggaggctgaggcaggaggactgcttgagcccaggagtttaaggctgcagcgagctatcactgactgcaccactgcactccagcctgagcaacagagcaagaccccatcactttttaaaaaattaattaattagtcagtaatggagtgagcttccctgggccaccttcaaagcacagggtgctgcttgaatatggcacttggagcaagtggggcacagggaggcctcaagagaggcaagggcaagtgggaaccctgaagtgggagggtctgagcaggggtctctggataccccagggctgatgggtgaaggctgctgctcacctgtttcttaatctccagccctccccactccccaactgtgacagagtctgggcccaggccaggtccctcctccttgtgttcagcccaactcaaagccacctcctagctgtgtgaccttgggtagtccttacacctctctgagcctcagtttttttaatctgcaattggagatcactcctgacctcacctcacaggacttttgtgaatggccttcattcgggaaaaagcatagagcatgggaagcagtgtggtgtgtgcgtttgttcatcctggcagggagggagcctgctgtgaggaaacggcatggaatttggagtcagaagatccaagtttgaattgtttcttctaatcacaccttaggcagattgcctcactggggcaggggctcaatctcccatctgtagaaaggggtaacagatccctgccttgcttatccaagggccgcctaagattagacgaggggatccctgtgaagtctcttctgactgctcaagcgctgcatgcagccgtttctcatcagctatcacccatttgtgacttgagacttccagcagggaggaaggaaccccttgctgagtgctccttgtattacagtgaggaagaggttaaaaaaaaaattgcagccaggtcagggtggaggaggctgcctggctgctcttcatcttcccagacctgactcatagatctcctgcaagatgcaggcttcctgaccggtcagatcgatcagaccctcgctccttttggagattttctcaccatcctgtagtacttccaggacttcgtgacctgtaggcagagagcgtggcctctttgaaggaagacattggagccggactttctgagttcaaattccacctcaggccgggtgcggtggctcatgcctgtaatcccagcacttttgggaggccaaggctggtgggatcacctgaggccaggagttcaagaccaccctggccaacacggcaaaagcccgcctctactaaaactacaaaaaatagccaggtgtagtgacacacacctgtaatcccagctacatgggaggctgaggcaggagaattgcttgaacctaggaagcagaggttgcagtgagccggtatcacaccactgcactccaacctgatagacggagcaagactgcatctcaaaaaaaaaaaaaaaaacacctcaaccacttactccctgggtgatccctttggccaagtgatttaacctctctgtgccacagttttttatctgcaaaaagaaacagactgggtgcggtggctcacacctataatcctagcactttgggaggctgaggcgggcagatcacctgatgtcaggagttcgagaccagactggccaacatggcgaaaccttgtgtctactaaaaatacaaaaattaccgggggtagtggtgggcacctgtaatcccagctactcgggaggctgaggcaggagaatcttactgtgagcagtatatgcagtagggcccgctctcactccactgctacacttcactgtgattactgctgtggatggtgcaattacatgtctgtttctctcactggatgttctgggcatttcagttgagacccaggagtacaggctcactgttgattcatctctagcttcgaaagacctagcacagtcaggatgcagggcaactgctcacagaacgctggatgcgtaaatgaatgaaagctcgtgtgaaggaatgggtttatccagagaatctccagagaagacgacacataagaaagtctgtctgtgattcagccctcacagcctggagcctccacggagcttcaaattagagtccccctcgtcctgacatcctgtgtggtcggcctcggccagacacagaccatgtgtccagctttgggcttctcagccgagggagggtaggcgcgggagggagggaaaggctgagggcaaggcatccaaatggacacgtagttgggaaaactaaaaagaacatgggtaagaagaagagtggcccttcctttctttcttgcctagaaggaatttttgtagctaaggcataatttacatacaataaaaatgcagtgtacattaagtattcagttcagtgagtttttggtttggtttggttttgagacagagtcttattctgtcacccaggctggagtgctgtggtatgatctcagctcactgcaacctccatccccagggttcaagcgattcttgtgcctcagcctcccgagtagctggggttacaggtgcctaccaccacacccggctaatttttgtatttttaatagagatggagtttcaccgtgttggccagggtggtctcgaactcctgacctcaggggatccacccacctcagccatccaaagtgctgggattacaggtgtgagccaccatcccggccttttttgtttgtttgttgtttgtttttgttttcaattgagacagtctcgctctgtcacccaggctggagtgcagtggcctgatcttggctcactgcaacctccgcctcccaggttacagctattctcctgcctcagccttctgagtagctgggattacaggcatgtgccaccacgcctggctaatttttgtatttttggtagaaacagggtttcaccatgttggccaggctggtcttgaactcctgacctcaagtgatccacttgcctcggcctcccgaagtgctgggattacaggcatgagccaccacacttggcctcaatgagtttgaccaatgaagtcacccatgtaaccatcaccacagtcaagatagagaatatccccttctgccttgggcatagcatgctaaaaaaaaaaaaaagaaagaaaaaaatgtataaaaaattttagaaagatagagaacattcccatcatccatttgtccagcgccctctgagcagcaggtaccctcatgcccctttcctgtcagcccccagcccccaaggctggtgcagctgggtgtggacggaattatacacgatgtgcctggctgcttttgctcagcttgagtctgtggaatttatccatgctgtcgtatatatcagtagctagttcattcctttttgttgccaagtagtatgttgctgtataaaaataccacattttgttgatccgtctgcctgctgatgggcattttggctgttgtcagtttagggccatgatgaatcagactgccctgagcgtgggtggttgttaaccacctgttctttggggttaagaggacatcacttcctctgtcgtacgagggatttatgtgagcagggccaccacacgtggtcatatatactgtccacagagggatgcctggccggggagtgactggggctgacattagcccagcacgcgtccctgggccatgcccaggaggttgcagcccacagacgcctatttccggtttgcacagaggggttgtatggactgttggggcttgtaggcaagaccaagaaagaatcaaggcattgcaatcccgcggtgagccaggtgtggtggctcacgcctgtaatctcagcactctgggaagtcaaggcaggtggatcacttgagcccaagagttctagaccagcctgggcaacatagtgggatgatgtctccacaaaaaaaaaaaaaaatttttaaatagaaaaaattagccaggcatagtggcctgcacctgttgtcccagctactcgggaggctaaggtgggaagatcacttgagcctgggaggtcgaggctgcagtgagctgtgtgatcgcaccactgcactccagcctaggtgacagagcgagaccctgccaaaaaaaaagaaaaaaagaaaaaagtcctgcggtgttgctgtggtgttctcatttgaggagatcttcaatggcattggagccctggccctggggcagttttttctgtgactcagggtagaccagtcactctccaccgctctttgcctccaggactcctgctcttcccaggaggcaggacgagatgggggtaggtaggagcataggatgtggagtcaggcacgtctcagttctcattccaacaacacttgtcactcgtggggcaccctgggccagcagctgctccgtgccgagtgtgtttccccatcagtcaaacggcttgtaagccccgagggtcattgaatggctcaacgggacactatttgtgaagtcccagcacagagcctggcattcaggaaatggcagggggtgggagtgagggtatcagtggcctcttggtccggtgactaaaataactttactgggtcggaaagctctccctgaacttccagaacaaagcatgggccccacatggtgctacctcccagcaagaaaggggttgggaaacaaagggctggggcccagcgagccccctgacttgtgttttccagacctgtcttcctcgctggaagttttgcgtgagtgacacagaaaacaacctgggctttgcgttgggccccatgtttgtcaaagcaaccttcgccgaggacagcaagagcatagtaagtgccttccccgtggacacaggctgtgaggtcacacttgttgtggcctgcacagacctgccagttcacactccagcccaccctgggcctttcctgctcctgggcaggggaccttagggccacagcctcaatgcagaggcttcacttcctcgagccctgggtaatgggagtctcacgagggcagctcttcagtgccaggcccttatctgcacgagctcatgtgatcctcccagcagcctgcaaggctgtgacagccatccccacctccaagggctgtgaacgacccagagagaatgttggcagaacagctctggcccagagggtgacatttttcttattttgtgggtgacaggtttgttctagacaggcagaggagtgccatggcagagcgccttggagacagcccggcctaagctcagatcctggcctcaccgctggtcgggtggcctgggacagttcttacatcatctgcaatgtggagacgggggcattcctcccacagagagagattaaatgagatgccacacactgggcaccggcatacaataagggttcagctaatgggagtggtcattttattgttacaatcttgatgacaaatagtattcattatgtagctgtcatctgcagccggaggtgagccaaccgcaattcaaatccattacagtgactggcctgtgagcagctgggcagggtctgagttggggtctgctggcccctctgctcttgttgccgcacagctctgccttccccttctctagaaccttcaactttccatcttcgagcttgtctgctcatgacattgtctccctcaagaacacctgtctatatccagcctgagcatggtatttccgaagctgctcctcggaacatgagtactctagatcttaaagcccgctccatcaaaaaggaatgctgtggtccaataaggcaataaggctgggagaggctgtgtcttctcccctctctggaagaatcacggtgcctattattaccatattaaaggctctgaaaagtaccacagcagagacttttccaactttcccgaagctcatcctaagcttattggagcatggagccctgtgtgtggaaggccagtcctgtcttgcagggtgttcacgttaggagcgtggtttggaagcacagctgtggctccccttctcacccagcctgacgcttggaaaattgagtttaatctctggccatcattgttctgcacggggtgcctgttgcatttacctgagaccagtgcgcagaccttactgctgtgatgtgtatctcctcaggccaccgagatcatcctggagattaagaaggcatttgaggaaagcctgagcaccctgaagtggatggatgaggaaacccgaaaatcagccaaggaaaaggtgaggctggccaggcacttggagggggtgctgcggcgtccagcacagatagaggagggtgggggaaggagaggccggtttttttgtttgttttttgaggcagagtttcgttcttgttacccaggctggagtgctatggtgcgatcttggctcaccgcaacctccgcctcccgggttcaagcgattctcccacctcagcctcccgagcagctgggattacaggcgtgcgccaccacgctcggttaattttgtatttttagtagagatggggtttctccatgtgggtcaggttggtctcaaactcccgacctcaggtgatcgacccgccttggcctgccaaagcgctggcattataggcataagccaccgcgcccggtgaggccagttctgtccggcagcacagcctggatgctgtctcgccttcagcgggtgagcggtctaggcctagcaggattcggggtaggcctcaagcacatgattgcttggatgtctgtagaagacaaacctcgctgagtgtacggggaaaaggtgcaggaaaacgcagcacgtcccgtgggtcgggaaggctctggcaccctccagtgggatgggagtcagggaagacttcccttgggaaagtgacatttaaacagagacctaagggataagtagaagttttgcaagggggaaacctttccagaaaaagacatgaaagcccaaggcaggcagggcctggctctggttccccttggcccagactatgagcccagcacccaagttgctcaggctggcctggtcgatgttgccgggcactcacttcctctgtctgtcctgtccaggccgatgccatctacaacatgataggataccccaacttcatcatggatcccaaggagctggacaaagtgtttaatgacgtgagtagctgctgccctgcccccttgcgttcctaaatgcccccttagaaaagggccgaggcagggctgggtccagatggggtgctagaggcagcatggttgtcaaaacacacagggatgatgtggtgtggggcttgggtatgggtcaggcatgaggaagcctcttcttcttcttaatttggctcctgggtcagctggaggccctgcctccccatagccaccatccatcagcagtgcccaccagtcagtacagaacccgtgctgtgtgccccctggaagtggtcagctccatttaatatgtgggaaataatggaggaaacagaccccagaaggtgcagagagaattggtggccctcagacatcaggggtggggtatgaagtgggaaaacccccacaccacctcctccctccctggtcgtgcttccagttacctcctgtccctgcggccctcctccacctccccagaaacccggacctctgattttgactttgaaatgctaatgggaaagaagcagcttaaatccaggtgcatttttaagcttggtttgggcaatggaggtggttgatacatccctgcttattagaacttttggcaaatcactcagttaggtggattgtgcttctgcctcaaattatgaagttttatatcttcttgtgattgaaatacttgaattcaggtatttaagaaaaaattttttttgagacagggtctcattctgttgcccagactggagtgtagtggtgctatctcagctcactgcaacctccgcctcccaggctggctcatattcatgagccaccatgcccagcctgaattcaggcatttaaaaatctaataacctctcgtcatggttatatttagaacctaagactataaagactcattctgagatcatgagactcattctgctgccttttccttgagaatcatttaagatgctccagagtgtcatgacgcaagatccttgggcctctggaggcatcctgggcagagcccaggatccatgtcctgtccctgaggctccagcgtttcaccagaaccagggagaattttgcacctgtcaagagctgagccaggcgcagtggctcatgcttgtaatgccaacactttgggtggctgaggtggggggattgattgagctcaggagtttaagaccagcccgggcaacatagtgagacctcatctctacaaaaaatgtaaagattagctgggcatgttggcatgtgcctatagtcccagctacatgggaggctgagatgggaagatcacttatgctcaagaagacaaggctgcagcaagctgtgattgcaccactgcactccagcgtgggcgacagagcaagaccctgtctcaaaaaagcagaaaaaaagctagaaagctgggccgagtagtgaaaagggtgtacagtgatgcccttgacagttcagatagatttctactttacttatgagatctagtatggtagctactagccacaggtggctatttaaataattaaaacttaaattagtttaaattaaatttaaaagccacacttgccacatttgaaatgcttattagtggccgggcgtggtggctcacgcctgtaatcccagcactttgggatgccaaggtgggctgatcacctgaggtcaggagtttgaaaccagcctggccaatgtggtgaaaccccgtctttactaaaaatacaaaaattagctgggcttggtggcatgcgcctgtaatcccagctactctgggaggctgaggcacgagaatcacttaaaccaggaggtggaggttgcagtgagccaagatcgtgccattgcactccagcctggatgatagatcaagattcccgtctcaaaaaaaaaagaaagaaagaaatgcttagtagtctgccatactggacagcgcaggcatagagcacagaacatccatcatcgcaggaggttctattggacaacatgggagatatttcttgcctgggcccaggcactgctgtaggcacatcctgcaacggtgtcattccatctcgtgccccagggtgaaggccaagagaagagctgaccctgcagccccaagccctgcattccggtctccagcctgcagattaatctcttaaccatgacagcccttggcttcctgtcttggaagatgcacaccaccgagggcacactgtgattgactccacttcttcttttctagtacactgcagttccagacctctactttgaaaatgccatgcggtttttcaacttctcatggagggtcactgccgatcagctcaggaaagcccccaacagagatcagtgagttcccccaggccctgccggcaaggtgccagctccccacctgtgggcaagccttgggacgaactggccttcattgcaccctcactgtgcacccgatcagctatcacgagagccgtctgaagagtggatgcccttgttatcccacttttcagatgaagaaaccaagggcaaaagaagtatggcccagctaggagctgggatgggcttgagcctgcccagcctgttggcagggtgagcctggcctctggagcggagccgatctggcaccttgtctccgctccactgctttgggatttggagccttcatttcattttccgcagaataggatgggaggagctggttctggggtcctcatggcagtcaaatgtgaggacctctggggagcgccagaccccaaggaggccccagcaagagcagctttcccattgttcctcactaccacgaatggtgggatctcaggacagggagcccacagaggcctggggaaggttctggatgggcttgacagctgtgcttcccaaagctcactgcacatcagagtcctctggggaactttttcaaagatacagcttcctggccgggcgtggtggctcacgcctgtaatcccagcactttgggagggcaagacaggtggatcacctgaacccaggagtttgagaccagccatggtcaacatggcaaaaccctgtctctactaaaaatacaaaaattaaccgggtgtggtggcgcacacctgtagtcccagctactcaggagtgagtagctgaggcacgagaattgcttgaacccgggaggcggaggttgcagtgagccgagatcgtgccactgcactccagtctgggtgacagagcaagactccatctcaaaaaaaaaaaaaaaatacagcttcctgaccttaaatcaggataacctagaatgagacctggtctttgtcctttttattactgtctcctcaggtcaatcacagtagctcaggcctgcaatcccagcactttgcaggctgaggtgggcagatcgcttgagcctaagacttcaagaccaggttgggcgacatagggagatgtggtctctacaaaaaatttttaaaattagctggacgtggtggcacgaacctgtagtcccagctactggggaggcagaggtgggaggatcactagagcccaggaggtcgaagctgcagtgagtcaagatcatgccactgtactccagcctgggcaacagagcgagaccctgcctgaaaaaaaagaaagaaagaaaaaaaaaaactgtctcctcaaaaaaattagatgtagtcagcccagttccagtcttcagtccaaggtccttccattcctcagtgcaaacatttgggataaatcttagggaagggtgcaatcaacttctctttgcctctggtgccccctggtggactataggggttcaaacatctctatttccttcatttccagcctccaaccaggacaccccgctatgtacaagaaggtgggcttttaccttcagaacatggcataggctctgttgccagtttatctgaagtattttaacttagcttgaatgtttttatttaaatttccttgcctacccattgaagtatttgtgattatttgaatataaatatgatgttttaaattcctccatatggccaggtacagcggcccacgcctgtaattcgaacgctttgagaggccaaggtgggaggatctcttgagctcagaagtttgagaccagcctgggcaacatggtgaaaccccatctctacaaaaaatttaaaaaattagctggacgtggtagcatgcgcttgagcccaggaggttgaggttgcggtgagctacagttgtaccactgcactccagcctgggctacagagcaagaccctgtctctaaaataaataaatacataaatagagttcttggccaggtacgggggctcacaccggtaatcccagtactttgggaggccaaggcgggtagatcacttgaggtcaggagttcaagaccaatctggccaacatggtgaaatcccgtctctactaaatatacaaaaattagccacgcatggtggtagacacctgtaatcccagctacttgggagcctgaggcaggagaatcgcttgaacccgggaggcagaggttgcagtgaacagagattgcaccactgcactccagcctaggcaacagagtgagactccatctcaaaataaataaagttctcagtatgttcccatggctgtggggctcacctggaggaggcagagtgactgtctaggctcttagaggaaatgtggtacccatctcactgcactcctcactcacccttcccctctgtaccagagaagtcattgaaatgccaaatacctcatgactatataccattactttcaaaaccttttttggtcttgggatccttctacactcaaaaaaattattgctgggcgcggtggctcacgtctgtaatcccagcactttgggaggccaaggcgggtggatcacctgaggtcgggagttcaagaccagcctgaccaacatggagaaaccccatctctactaaacatacaaaattagccaggcatggtggcacatgcctgtaatcccagttactcaggaggctgaggcaggagaatcgcttgaacccgggaagcagacgttgcgggtgatccaagatggtgccattgccactgcactggccctgattttttttaaattttatggaaaataactattttcaaaaaattaatgagaagagaggtatcgttttactttttgcaaatttctttatgtctggcttaatcaaagacaactggattctcatatctgattctgcagtcaatctgttaccatatgttgtttttatatatagaaagaattcttggccaggcgtggtggctcacgcctgtaatcccagcactttgggaggctgaggcgggtggatcacgaggtcaggagttcaagacaagcattgccaagatggtgaaaccccatctctactaaaaatacaaaaaattagccagacgtggtggcgggtgcttgtaatcccagctactcaggtggctgaggcagagaattgcttgaaccctggaggcagaggttgcagtgagccaagatcacgccactgcaccccaattgccctccagcctgggtgacagaacaagactttgtttcaaaaaaaagagaattcttgcctcacataggaatttagttgggaaagggagggatgagggatattttaatagtcttttctggtacttgtgcacgttcttctgatactacaccaaaactcgaaaagtgataattttttaaaggttaattgcactatggaatctgaaaccacatccatgaactttatttttttcttttttctttttttcactgtatcacccaggccagagtgcagtggcataatctcagctcactgcagcctcaactttcccaggctcaggtgatcctcccacctcagccacctgagtagctgggactacaggtgcacaccaccacacctggctaatgtttgtattttttgtagagacaggtttcaccatgtcaccggggccggaatttttgtaatttttttttgcccaggctggtctcaaactcttgggctcaagcagtcctcccacctcggcctcccaaggtgctaggattacaggcatgagccaccatgcccagccttcatgaactttcatactctgttacactaaattccattggtctgtcctgcactttgaatggatcttttacccaggcgtgattttgtaacatcatgtcttagtcatttggaaaacaatggttcactgagtcttacagatcttccaaatggttatacttccaatatacaatagcaaaaaaatccacatttgttaatatcactgctgacctcttgagaaaaaccttccattattattggtaaggtgtcaaacttgtggtggccaatataagtttttcaaaattttaattttagcctgaaacttcaacatttttttaaatctcatatttttatcattggcaacagatggcttgagttgttttccttgaggtgataagctcactttattcattttaaagaaaatgtctgccagatgtccacgtctgaaattccatagtttaccagtcatcctaaaagtaccaacagggttccaggaaagaagcagaatgctttatatgtggatttaatgttactccacctctgtaacattaaaaaaaaaaaaattagccaggcatggtcacgagtgcttgtagtcccagctacttgagaggctgaggtgggaggatagcttgagcccaggagtttgaggctgtagggagccatgatcatgccaccgcactctaacctgggtgtcacaacaagatcttgtcgcttaaaaagaaaaaaaaaaaagtcttgtattcaggggttgagatgtaatgaaattaatcattatgacggcgcagtggctcatgcctgtaatcccaacactttgggaggccgaggcaggcggatcacgaggtcaggagatcgagaccatcctggctaacacggtgaaaccccatctctactaaaaatacaaaaaatcagccgggcaaggtggtgggcgcctgtagtcccagctacacgggaggctgaggcaggagaatggcgtgaaccccggggggcggaggctgcagtgagccgcagtcgcaccactgcactccagcctgggtgacagagtgagctccgtctcaaaaaaaaaaaaaaagatactcttcagtggtgacttttcaaaatctttttcttttcttttttcttttttttttgagatagccttgctctgtcacccaggctggagtgcagtggctcaatctcagctcactgcaacctccacctcccaggtttaagcaattctcgtgcctcagccacccacgtagctgggattacaagtgtgcgccaccacgcctggctaattttttttgtatttttagtagagacagggttttgccgtgttggccaggctggtcttgaactcctggcctcaagtaatccacccacctcagcctcccaaagtcctgggattacaagcatgagccactgtgtgctgatatttcaaaatctaatggcccttcctgctctttgtaagaacctcagtattccaccgtgtgatatgacatcattaattaactgattccttatttatagacagtcaggtgttttctagttttctcctaaaaagcagtcctgcacccaggcacagtggctcacgcctgtaattccagcactttgggagtccgaggcaggaggatggcttgaggcttagaagttgaggctgcagtcagccatgatcacacgactgcactccagcctaggcgacagaacgagaccctgtctcaaaacaaacagtccttctgtagatgtccttgtacttgtgtgcacttgggcctggggtcaaggagagtctgcatttttaatgcccttattcccgatccccaagcagcgctccaggcaggctgtccccacctgcctcccgccctgtgctgagacctcctgcatgtgtgttgcttgcaggtggagcatgaccccgcccatggtgaacgcctactactcgcccaccaagaatgagattgtgtttccggccgggatcctgcaggcaccattctacacacgctcctcacccaagtaggctgcctctggggcccctaccccaattcttttcccccagcccagccctggggcccatacgacctaagccagtctcaccatgtgatctttgccccagtgctccaggttgcagatgtcagagatgttgcagaggaagcaacatcctcacccactttccttccctccagtgagatctggaagccctgcacagtggggtattgggagcatctcatggaatcaagagccctacctcagggaaacgcccctctgacaatgttataacacagtcagagctggggagtggggagggttaaggctgctgtctcagtttgaatcccaggtctgctattggatgattgtgtggtccttgggcaaagcaattgacccattcccagccttggtctactcataaatagagctggtcaatggcgaccattgctaacgctttcgcaatgactgaagaggacagttaggtctgtagagcatctagcacagcgcatggtgcccaataggcacagctgaccacacagactgtgcccagcctccctctggcttcaggggccttgctggagactcaggccatgaccacacccttatccacacagagccctgtggaattttgctatatctctaagcccaggaagtgagggtcacatacctgagcaagagtgagaggccctcctctcaaagcatcatctctacctttgtgtctttccctccagggccttaaactttggtggcataggtgtcgtcgtgggccatgagctgactcatgcttttgatgatcaaggtacgaattccagctgggcacgatggctcatgcctgtaatctccgtgctttaagaggaggattgcttgagggcaggagtttgagaccagcctgggcaacatagcaagacctccatctctactaaaaaaaaaattaggctgtgcatgatggattatgcctgtaatcccagcgctgtgagaggccaaggctggtggatcacctgaggtcaggagttcgagatcagcctggccaacatggcgaaaccctgtctactaaaaataaaaaaattacccgggcatggtggcgggtgcctgtaatcccagctactcaggaggctgaggcaggaaaatcgtttgaatctgggaggcggaggttgcagtgagctgagattgcgccactgcagtccagcctgggtgacagagcgagactccatctcaaaaaataaaataaaataaaattgtatctactaagaaagtaaaaatttagccaggtgtggtggcaaaattttaatagtcctagctacttgggaggctgaggtgggaggctcacttgagcccatgagtttgaggctacagtgaactatgattatgattgcaccactgcctggtacaggttccttggtcccctttagactgggccaatcatcttccaggccccactgcctctgctttctgcatccttcacttctaagggtcttagctttggaggcagaaggatctgggttcaaatccttgctctgccacctgccgattatatgaagtttagcaagcgctgtcatttctccaggcccccatgtcttgtctgtaaaaggagcgtgatggttccaccctcccgtggtgattgggaggactgtgtgaagtgtgtagtgaggtgccctgctcgtggaagttgtcccgctcttggggttcctattaggtttagcagagagtggacattcctccaccactccagagacttctccagtccaactgcagtcagggggcgttgaatcagtccctcctctccaactaatgtccaaaatcctcctcattgcctccttccttgggcactcccgggcggagatggaagaagcagagacctgggtggcctgggcctgtcttgtgatcctaggtcagctggctccatctgcctcttcctaggcatctgttactcagggtcaggggcccttagccagtgttgaaaataagccaggcacggtgacgcacacctgtaatcccagcactttgggaggctgaggtgggcagatcacttgaggtcaggagttcaagaccagcctggccaacatggtgagaccccatctctactaaaaaaaaaaacagaaatcagctaggcatggcggcatgtgcctgtaatcccagctactccagaggctgagcacaagaattccttgaacccaggaggcaaaggttgcagtgagctgagattgcgccactgcactccagcctgagtggcagagtgagactgtctcaaaaaaaaaaaaaaaagaaagaaaacaaagcaagccccactgagcctcgggccacgctggagcttttcccgatttctctccttcatcctctcccgcctctgactggccaccacatccacgtccctcggcactcacagggacctcgtctccccatggtggctggaggacgggggtggacggatgaaccgcttctcaccaggagcagggaggagcagcaggtccctgctgtgcccctccctcccttgacatgacgcctccctctgacccacaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtgagagccccgctccccacacgcgcacggtcccagtgctggctccttccagatgcctgtccgtagaggatcatcacggacaaccagggcaggcgcagcagccgtgcgagcttccgtttcctcttctgcgaaattgggggtggcgaggaccaatcgcgatgccgaccgtggaggctcccccaccacagggcttggcaccagaaggctttgtgctctgagtctggcctgacaaagacacaggaaggggctcgggcttcatccgcctgaagagcctgcctgttctcacctctgcaggggaagctaccaccaagtcagccagctgtgggtctgggaggcccctgaggactaagcagccagggcaaggagcactggtcgtggagccagttctgggttcaagtcccggttctggagtaagtcacagaacctccttgagcctcacttgacttggctctgattagctactacctgcattattgggttgttgggaagataaaacaagatgatttagacacgggctgacccagagagacactcagagatgctcgcggagtcagatgggagagttagtaacagaggccacgagagaaaaacagtaggtgtctgtcagagagattaagacagggcttcctcccaaccacggcagtaagagcagaaatccatagagctgtcatttattgaggccttcttaagtgccaggcttggagtattcccagcagctttacaattaggtattataatccccgttttgcagataagcacactgagcccagaaaccttggataggttgcttaaagtccacgagtcaatgaaaggtattgagaatctacctagcaggggctgtgtttgaagctcatcctgctctctaaaagcttatactcttagtggaggctggaaggggaagaaaggcaaataaatacatcataaatctgtaagataatgtcagctattgaaaaggtgacgaatataaactggggcgaagtaatgaggaataacggggggtaaaaggaataatggggaggacgctggccacggcaggccttctctggggttatgacatttgcatagagacctaaatgatgaggaagagcctgggaaaagctggggaaaatggtctcagcaagaggaagagcaagtgcagaggccacgaactagacacaagcctggcacgtccaaggatgggaagaagggcagggcagagtgtagggaatgcggggaccagaccactccaggcttctgtcggctgcggctaaggaaggacctttggttttgtcctggttatgatagagagacacaatatagggttttaaaatagaggaatgacatgattcaacctaccctttaaaacaggggtcagccgggcgcagtggctcatgcctataatcccagcactttgggaggccgaggtgggcggatcatttgaggccaggagttcaagtccagcttggccaacatggtgaaacctcatctctactaaaaatataaaaatggctgggcacggtggctcatgcctgtaatcccagcaccttgggaggccttggtgggtggatcacgatgtcaggagttcaagaccagcctgcccaagatagtgaaaccccgtctctactaaaaatacaaagattagccaggcgtggtggcaggcgccagtaatcccagctactcgggaggccgaggcagggaattgcttgaacccggaaggtggaggttgcaatgagccaagttcgcgccactgcactccagcctgggcaacagagcaaggctccatctcagaaatatgtacatatttatatataaaaaatagccaagtgtggtgacgcatgcctgtaatcctagctacttgggaggctgaggcatgagaatcttttaaacccaggaggcagaggttgcagtgagccaagattgtgccactgcactccagtctgggtgacagagcgagactctgtttcaaaaaaataaataaataaaaataaaacaagagtcctctgggtgccgtggctcatgcttgtaatcccagcactttgggaggccagggtaggtggatcacaagctcgacttcaagaccagcctgggcaacgtggtgaaaccccgtctctaccaaaaatacaaaaaaattagctgggcatggtggcgtgcatctgtggttccagttactcaggaggctgaggtgggaggatcgcttgagcctaggaggtggaggttgcagagagccaagattgtgccagtgcactccagcctgggtgacagtaagaccctgtctccaaaaaaaacaaaaacaaaaacgagtcagcacacctacagcccatgggccgaatctagctgtgaggctgtttttgtaaatgaagtttcttggcgttgcagctggctccatttgtttccatgtctgtggcttttttttttttttttttttttttgagacagggtctcactctgtcacccaggctggagtgcagtggcgcaatctcggctcactgcaacctctgccttcctggttcaagtgattctcctgcctcagcctcctgagtagctgggattacagtcatgtgccaccgcacctcggctaatttttgtatttttagtagagatggggtttcaccatgttggccaggctggtctcaaactcctaacctcaggtgatccacctgcctgggccttccaaagtgctgggattacaggtgtcagtcatcgcacccggccatgtggctgctttcatgctgcaatagcagaattgagtcattgcagcggtgaccattagcccacaaatcccaatgtgctcactctctggccatccacagaaaaggtttgccagcacctgcttcctaaggttcactgaagttgctttgccaggaggggaatggaattgaatcagcctgagtcagaagactgattagaaagctgttgtgaggttgtccaggcaagagacagggtagagcaatgggaagggggagcggagcagtggtcagtgtttgatctgagagaaagagaagaattgaagaagcgttctgggtttggggcctgggatgatggatggtggtaccattgactatgatgggaaaagttgtgtgtatgtgtgtgtgtgtgcatgcacacacacgatgtggctctgtttataccatgttaagtttgagatgcatcttggctgtccagctggcacagttgaatatacacatcagggaagaggctggagcagaaggtgtaaatgtgagagccatcagtgcgtagaaggtattttaagccatagggctaaacgagtgcacatcaagaagagggctcccctaggctgagcccaggcccagatccccagaaactagtccttgccccaacacgggggagctccctgagacctccataccagtcccctccttcaccacctgccatgggaacccctgagctttggttttctctcctcccaggcttaccagaactgggtgaagaagaacggggctgagcactcgctccccaccctgggcctcaccaataaccagctcttcttcctgggctttgcacaggtgagtccattaggaaaacatgccacacatggtacattctgccatcttgatgtttcaagagcccagagagccgaaaggcaagttccccacagattgagaacttcccaagtcactggactgtgcacagcacatgtgccctgtcattagagagatgcacggaagggcccaaagtaccagtgaagggattcctggatctggtgaatgagaagacgaggtgatcacccagggcccttctggttctagggttctagaggtttcttaaacttaagatgaccagccaggcacagcagcccacgcctataatcccagcactttgggcggccgaggcaagtggatcacctgaggtcaggagtttgagaccagcctagtccacatagtgaaaccctgtctctatgaaaaaatacaaaaaaaaagtcaggcatggtggtggctgcctgtagtcccagcttcttgggaggctgaggcatgagaatcacttgaacctgggaggcagaggttgcagtgaaccaagatcacgccactgcactccagcccgggcaacatagcaagattctgtcttgctgtgatcatcccagatcatcccttcagtcggcattcatctggtagccttctgctggcactcagagctaccaggccattagacaatttgttctgcccaggaaatgagagatctggactaaatccaagcttttccaactggtgtttggacacagtcctttgttcagatggaatcgaatgcagttgcctcagagatgctgcgctggctgaaggagaacagtttggagacaactgcgttagaggctgctggcatggggggtggcacaccagccctacaccagcccactgtctcttcctgacccgctcaggggaccctcctgactccccgggatctcaggatcaggtggggggcttatctccctggtgttgtattttctgggttttgtttttttggagccggagtctccctcagtcacccggcctggagtgcaatggtgtgatcttggctcactgcaacctcaacctcccgggttcaagtgattctcctgcctcatcctctcatgtagctgggatataggcacgcaccaccacgcccatctaatttttgtatttttagtagagacagggtttcaccatgtttgtcaggccggtctcgaactcctggcctcaagtgatccaccgccaccttggcctcttaaagtgctgggattacaggtatgagccaccacacccaaccttgttttgctttttgagacaggatctcactctatcaccgaggctggaatgcagtggcacaatcacagctcactgcagccttgacttctccagctccagtgatcctcccacctcagcctccccaggagctgggaccataggtgtacaccaccatccctggttaattttttttttaattttttgtagagatggggtcttgccatgttgcccaagctggtcatgaactcctgggctcaagcagcccttccaccttggctcccaaagtgctgggattacaggtgtgagccaccgcacctggcctcccctgctgttataatgggggcagtctggcagcccgagggccccacagtgaccctggcctctccctgttgccccttcaaaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggagggccatgtgtctgggtgtctgtcctcccaaggtgctgtgtgtcctttgaggccggcacagggctgtccaccctagcttctccagggctgggcgcatctgtccctgagagcaggggtcttggaccctgacaaatgccagaaggttgctcagtacctgtgcccccagccacccttccttcacctacaagtgtgtgagcaccccctgctggtgagaatgatgcacatcaccacctgggtccaagaggcctcctggtaaaaataatttttctgttatcttcgagcaagggagtttccaggtctcagatgtttgggcagggcaggcagtagggaaaatcaaagaaaggttcaaggagggccaggtgcggtgactcatgcatgcaatcccagcactttgggaggctgaggcaggtggatcacctgaggtcaggagtttgagaccagcctgaccaatgtggtgaaaccccagctctactgaaaatacaaaaattagccaggcatgatggagcacacctgtaatcgtagctatttgggaggctgaggcagaagaatcgcttgaacctgagaggcggagattgcaggagctgagattgcgccactgtactccagcctgggcagcagagtaagactccatctcaaaaaaaagaaaaagaaaaagcagggcacggtggctcacgcctgtaatcccagtactttgggaggctgagacgggtggatcacttgaggtcaggagttcgagaccagcctggtgaccatggcgaaaccccatctccactaaaaatacaaaaattagctgggcacagtggcgcacgcctgtagtcccagctactcaggaggctgaggcaggagaatcacttgaacctgggaggcagaggttgcagtgagccaagatcatgccaatgcactccagcctgggtgacagagcaagactctgtctcaaaaaaaaaaaggaaagaaaagttcaaggaagagtctctgatgtacactgtgcctcctggggtttgcgtgtgttcttcactctgcctggaatgttcttgcctgataaactacccatccttgaaacccccagctcagcttctcctcctctaggaagccttcctaacctcccagtcagtatcaaactcacacaaggcttccttctcctatcacagtgtatgggtttgctagtacctaacaaagtaccacaaacttgggggcttgcacaactcttagttctggaggctcaaagtccaagatcaaggtgttggcaacattgactcggttccaggctctcctagcttctggcaacctttggtgctccttggcttgtagaagcatcacccgggcctctgccttcatcttcatatggcgttctccctgcacgcgtgcctgtctctgtccaaatttcccccttttatgaagacaccagtcatactggattagggccaaccctaatgaccccgttttagctaattacatcagcaatgaccctattttcaatttttttcttttttttttcttctgagacggagtttcattctcattgcccaggctggagtggggtggcgtgatctcgactcaccgcaacctccacctcccaggttcaagcaattctcctgcctcagcctcctgagtagctgggattacaggtacgcgatgccacacccggctaattttttgtatttttagtagggatggggtttctccatgttggtcaggctggtctcgaactcccaaactcaggtgatccgcccgccttggcctccttcctcttccccgctctgagaccctgggacctctcactcctcctctcctccttttcccttctttgttaacaatagatcctaccccctccccacccagctccgtgcctgccccactccccaagcaggaattaaaaccccagcctggcccttcagggatttaccctgcagctaagcagatggaaatacgtgcaggatgcaagttaggaacaaatggaaaataataa

SEQ ID NO: 731 - DNA, 35489 bp, Human
actttctcttcactggatctgagctctgaaatgacttatatttcttttgtcagagataagagataattctccagaaccaaatgacccagaagagccccaggaggtgtccagcacaccttcagacaagaaaggtaagaaaagcctttcttctgtagaggtcagaagggtgaattcagagttgctttctgtttttctgactgtatcttgtcaagagcaccactatgtgaccacagtcctgatgccacacacagttcgtttctgcagtttccatttgctgcatcttccaaaaaggcctttatgaaaattatcaggaaaccagaaggcatttgggggtattgaaatatgccattggaattgcctgttctgaaaaaatcaatctcctatattcacaacttcttagagtgttaattgcacttccctctttaactgaaagttggttccccagagaggaacccacttcctcttaagacatggctaggcattctctgccatccatcactcacacctcatggtgagagacaggttagatgtctgtcctttgctgcctactggccccatccagccccttcctccctgatcctctcctttgagtcttaaccattcaattaaaatgttcactcactcatcatcaatatcatccaataatttccccaataatcctttcaaaagctgcttttctgtcatttcaagtcccagcatcatcctagatgccttcagggtacacacggataacagacaactctgttatccaatactctggcccctcaaatccttcatcttctcattttccatgactttttcctccaccaattcttggcctcccatacccaaaggcaagctatagaccctatcgtcattcaaacctggctcgatttcccaacagttaatttcagaattccttttttgatacctgtccttgagcttttctccttttatagctatcattcaacctctgatcactctttcccagcccaatcctaacaaaagaaaaagaatcaaaaatatatttttctgtgcttatttatttgttgtttcctctgaagttgtccttcaacctcatttggatcaccagtccactggcctttcctccttccaagccatcatctgcttttctttgcttcccagctttttaacattgacactaactcacagtccaagattcatcatttcagtaatctattgccattatcttaaacctgcctttcctctctgccttttcctagaactctctggcaagtcttggaagaccctacttacctacttcctgtacactgcatctgaaagccagcagtgctggagagagttccacagcagggcagagtgcactcactggtcttcatggttccagcacaaatcatctctccttactgtgtgacaatgctacttcctgcaataatcctttcaaacctcaagccctatttttcaaacctctgaccccctcacctcctgctttttgctcaatcagtgactttccctcctgcaccataaggagatatcagatgagaatccccttatttgtgctgctagtcctacaaaccctaactacatctgtctccctcctctccgagttccctccttctcttctaagacaatccttctgcctcatcttatagtatccatgatcccttctctctcaagtattcattaaagcagtatgtctcacacaagaatctgcattacatgtatcacagctcattaaaaaatgctttttcttgattctcatctcacttcaactacttccatatctctctccttcatttcacaaccaaacttctagaaatgagctacctaaactccctgtctctatttcttcgtttctccttttcctctgtcattttagagtccttcttcccctattactccctgaagtaccatcacctaaggtcaccaatgaacttctagcaatgtggtttgaagaccaaaagtaaaagctgaatatcattgacatacaagattgggagatcaatgtttgtaactataaaacattatcctttctttttaggaaagaaaagaaaaagatgtatctggtcaactccaaaaaggagacataagaaaaaaagcctcccaggaggtaagatgagagtacaagaggaagctggaggctggaaacagctcatgcagggcttgtaggtcaagctgtggagggttgaattttattctaaatgcaatgggaagccattgaagagatttagtcagtgaagtgacacaatgtaagctcaattttgctacggtgtaaagaatgagttggagctgggaaagaatggaggcagggcagccattttggggcagatgccatgagagttcttggtggcttggattcagatctgacagtggagatgcagagaagagtgccaattcaagatcagttttgcaggtattgttgacaggatttgacatattattagctacagatgagaaagagaaaaatcaaggcccactcttcaatttctggcttgaacaagtaagtggtaatgcccattgctgagggaagatgcaaatatattgggggataactcttagagttcaattattgacctgttcctttagaggtttctgctagccatctatgcagctgtgtatagatgtgtgttttgtcaagaactgtaaagggtctaagatgttactccacttgcattggtatctccttatatatatgagtgctgcaggaacacaaggtatctggtcagggaaaataattctttactgatattcacaaccagcttatcagccagagcaatattgcagcgtctgtctcccatacacaaacccaaaggcaatgctaagagagctaatggaatctttctattcaaaatagactacaactcatgtataagggatgtagaatgatggatttttctgtttagatacatgagagggatagccatcatcctttcctcctgaaaggaaaagaaaaaactttgctgctttgagataaaatggaaaagatcctcgttccaaagctctccatcctaacctttggaatttaaatgcatctttccaaaggccagagaaactctaggtgttgctggcttttacaacctaaagatgtctccaagttctgggctttaccccttgtgatatataaatacctagggaaagaccactccagttttcctggtactttaggatttaacctaggaagctagtcctgggtgaacccatttggccatctcaggagataagagaggttctattctccctctagatcagagtaattaactagaaaaatagctatagctctaattctcatggtgtgggaagaggaaaatgtttctggggaagtgaaagcaagtatttcctatatttatattgcatacatttctgtgtctccgggactagggctttttacaggaacactgagaaatcaggaagttatattccccacaatatggcaatttggcactcactgaaaaagtgtggtccatatatatatatatatatatatatatatatatatatatatataaaatctggaccagataatatataatatctggaccagatatatgtatatatatgagttatcaataaaataaaggtattctgatctatgggagaagaaaagagaaccacagacctagccctgctctaagtaatcccagtggaagaggaatctagcaagacagactgagggaacgagaccagtgaagacagaggagcaccaagaaagaacatgttagcaagccaagagggaatggttgactatactgagagactaagataaattcagagaagagggccttgagtttggtcacaaagaatcactggaaaatttaagaaaaattttggtgatggaggcaggagccagttgtgtgggaaggataatgaatgggaggtgataacatatgtagacaactctagctgtaaaaggaaacagagcaatagatggcagcctaagccagtggcttaaagctcctcttccctgacttagtttatcattagtatgatcccagtgtccaaaatcacagggctggtgtccttttaagacacttaacagaaatgattccattctaagaaaagtaagtgaccttcctgggcaggaaggagagacaagctgctttctcccccattctacttattagtcaatgccctctcaccatgttatgtgtattctctatgggcctccttggttcattgtaaactagtcagattattcaactcacacttctgagctttgtcaatcactctcacaacttcaattaccacctttatactgatggctcccaactctacgtcttcaactcaggtttgtcttcaagaaacacatagccagctgcacactgggcgtctttgtttgcaagtctcccattgacactacagtctcaatatgcctgaaattaacttcaccttctttaccaaaaacctagtcttctaagtaccattcagacatttattccaacaaatatgcagtgagcactaactgtatatacccattctgaaagctgaagacagattttttttttaaagagagaaagtaagaaagtaagcaaaaaacaaaggggaaagctcatggaggttacatcctggctgggggaaggaaagaatataaactagaaagcacataaacaagataatttcaagtactgatgacaggatgaaagaaaataatggataggattacaatagtgacttgcaggttggggtgggagtcactttggattggatggtccaggcagagggactcaaaagtgcaaagaacctgaggcagagaggaaagaccagtgttgttggtgatgatgaagaaagaaggtggtaggaagtgaaaaagtaaacaagaatcagattatgtagggtttcacaggcccttgggagcctgttgtagtttaacttgaaatgaggaacttaatctacccaggtgccaagcaaaaaccttagtcatccgtgactaactgaactctattagcatattgacaaggtctattggttcaccctcttcttttctacattaaaatctaatttagtttatttgccatgcttaaatcttgtccatggcctcctattgccccttagggtaatgtcactgtcccttaatgtgattgttaaagttctatccagtctaactcatgccttaccctccaactattaatatatctctttccactcaaaactccagtcaaccactctgaacttcattgtcttcccatttcatttctctcccctttgatccttggcatgtgctattctctttggatgctatattctgaacctacactactccccataaatgtttagttatctccttttcatcagtcgtgttgacttatgtctatctcaggaatacatactctgacccctaaattagccaagctggtcccataatttctacagcacccagcactggctcttttggaaggttccaaatactctattgtaattacttacataatgtgtctcttctaggctagatggtaatgtcctggcacaaattagctattaatttttttttaatgaaaaaaaaatgaaagaaaccatactttctgtaacccaaaatttgaataatgatctgacaaaggatagtttatgaattcattattgtgttatgaaaaggggtcatagacattatgggcaccacgtggtgtagatacaaactaaaggttattggagggaaatttccaatacaattctccaaattcttattatcccatatttagggcagacatacgtactctgcacaccccgtggccagcagcccagtagtgagatgcccactctcacaatgctctacacgttataggattagggagacagggaatgtctatgcaactatacaattatgaacactccctggtcagagaagtgactttgttagagaggggaaacctctggagtcagtgtcagatggtcagttctgttgaggtaactctgaccttttgacatctctctgccaagctaccgaaaggagtagactccagtcccttccagatttgcctttcttcatattgtatttaaatgaaatttttcaggttttttaaaagaatcgttttattttaaatgtgacagatgatgtgcttttaattttcttttttccaattttccaattttttacctgggtaaaatacacatgacataaaatttatcatctcaaccatttttaggtgcatagctcaatggtattaaaatacattcacaatgttgtgcaaccatcaccaccatccatctccaggactcttttatcttgtaaaactaaaaccctgtacccattaaacaactccccattcctccctgcccgcagcccaacagagatatttttaagagtcatattattttacatttaattaatcagctttattttttacaaaacaaaacacataaaaagatgtttcaaaattgtaagagaaaaatatatatagtagtgctgaaaatatacataccacactctcatattttctgtaagtgttctcatctccgaaaccctcctttagttatgcagaaaaaaaaccctaaacttggcaatgaaaggcaagttttaggctctatcaggctgccccacctcttctggataaatattcagtaacttccgtgtttgaacttcccgccagccctgggtcccaccgggctttcgcttccgccccctcttaagggttcacccatgccttttcctccggaagtggcctgcggatatcaccgcacttgcgtgcgggaagcatggctgcacactctgtgtcctttctaacctgcagagaaacgttcttgttcaacaggacagcggtcatcctgtgggatcagcttctaaagtcaacagccggtgaaaattgtgttctttttccacaatgaagcaaactcacctctgcaccctctggcattgcacctcctctgggtctcagcctcaccttccatctctccctcatggtagccgccttcttggcagggtccttccctctcagtttttttaataccttgcactttgcccactgaaggcacctagaaacttttggaaatctcttgtaccacacacaggccgtgggggaacctggagaggtgctttataagacacctcctctccacctagacgagactgtgtggccacctcgtggtgcaggccgacacaaacgaaaatcaggaaataagctctaggatttccccagctttatctagttgattgcaacaggtcataccaggagtgaaagcagatggtaatttggggaggcaaagaaaggtacacataagaagaaggatataattatagagaagtaggaggagaaaagtgaggtacaggggtacagagatctgaaagagtgggagttaggggcatgagaagggaagtcactgattgggactgtaggaggctcactgaagaccccaatttaaactattaacaagtcattatttggtccagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagagggtaaggctgatgatggaatctgccatttgaatggctcagtgtgggagggtctctcctgaagcaggtacagagttaagtagatatgtaaagtcaatagtaaaaggaaaaagtacagagaatgaggatggggtataacaagaggaacaaagagagcaagcatctgttgcatctgaaaagttttgtggaagaaacagacgtgttcacagggacagctgtggcctggggcagcagctctcaaattttttggtctcaggactcctttatgctctcaaaaattattgaggaccctaaggagcttctgtttatgttgtttatgtctatctacatgtacctgattagaaattaaaactaataattttaaaatattaattcatgtaaaagtaacaataataaaccaattgcctgttaacataaatagcattattttatgaaaagtaaatatattttctaaaacaaaaaaaattagtgaaaagagtgacatcattttatgtttgtgcaaatctctttgattgtgagtgagctttataaaaagacagctggattcctacaactgtttctgcattcagttgtgatatgttgctttgattgaaggatagaaagaaaatctggccttacacagatatctagtttaaaagggtgaggtaatttaacagtcttttgagatatctgtggatattcacctttaatactacaccaacactcaacaagtgatagtttcttaaatattagttgtaatgtaaaatttgaaaccatatcaattaacttcatactctgttacaataaaatacattaatccaccttgcattttgaatggaccttctactaatgcaagattttataatagtacagctgtttggaaaatatacatttggaattatacagtgagcttgtatctcaatcacacaagtgttttcttgaggccactgtggtacttcaggatgcaatagaagtgctttatatgtgctcttcagtttttcacatagaatattaagatgtcagatatgtactcaagggtagaaatttaataaaattaataatttttactggctcaccaaaaacattctcaagtgaatcttgcttttatttttattttttttggtacagtgagtaggtggcaataaaggatgcagtgattcctgctgagatttggggacactgctttgatgtgtcttaaggcaccagcagttttatctgccattgctcttgctcaatctgtacaaaggttgaaatagtgaaaaaggcaaataacatcatattatgaaaacaatttgaccttgcaaattttctgaaacggtttgacagaccccctaggggctcacagaccttactttgagagactctggccaaggggttcagatggctgcaccccactgtggatgtctccattggtagagtaaccactgctaaccaactgcggtctgctcctcccctgagtggcagacaggcacagtgtcatgagcagcaccaaatctcttggtagatgcattgttaggagggtaagacctggagcctccaagactcaacttcagagtgtgcaagggccttcctgggtctctgggagattctccatggtgtttcccaaggggcatttactaagatctttcattttccagagatcattgatggcacttcagaaatgaatgaaggaaagaggtcccagaagacgcctagtacaccacgaagggtcacacaaggtaaaacttggagattgctggtctcagagtacagtcaccaggaatctaaattcagagctgtcttacactgaggcaatatttcttaacttttttttttcattattactgtgctagagagcccttctggatttttttttcttaatcaagacccttcccatgatatttactactacaaatatatgtccattttatgtaatgtgtccatatgtatgtatgtatatctgcactatataagatttttctcagcactcaagaatgagtttttccactactggcagcaatatcaccattactgagaatgagtgtcctaagtatattcatggtactatactgaaagtacagcttgtccaaagtgcagcttgatccaacccatggatcaagctttttcctagaattccaatctccatatttctcatgtggcctttctgagaaaattgagaagcgaaaaactcattaaaacacacatgtgacactatgactgagcatgtacaactggtggagttgtgggcatgtgctggtaaaattgtgcatgttaattcacccctcactatcgctaccattattcacatttctggagtaagttgataacactatccttagaggggaaaaaacagctagatattcgtctgtttgctggtgatatggtcattgtcacaaaaatcacagaactctcacatgacaaatgtgattttcaaacaacaaatatctaattattgtcaggaaaaatggattaaattttaccaccttaaaatctaaattatcattttaacagtttctcctatattgcactggcttatctagtagtatttcaacttttctcatggataattttattttattttcacaaccacccttggagaagattgaatgacctattccaatttagcagatgaggaaattaagatatggaaaggattaatggatttttttcaggatcccctgggtaagggctggctgccaccgggttaacaacctggtccccaggaactcttttcaggagccatcgttctccatagaaaggaaggggcagaaagaatactgtcaaacctttgtcaattcactattgcccaaaatagaaaactgcttattcaaaaattactttctcattacttccaagatcctatggataatggaaataaactctctctgggaaaatctcccagggcagagcataagtgtgaagaagaaactatttggtctctgtggtgtggattgatgttaccttactgttattatgccattctaggccataaaagacatccaagccagaaaaagcgttatgctttttaaaatcatgatttcactttttttcaacatagaaaagttcctggacttttctaaaagcagtgtgctgtcaccattaggattatgttgctggcccagcacagtggctcatgcctataatcccagcactttgggaagctgaggtaggtgaatcacttgaggccaggagttcgagaccagcctggccagcatgatgaaaccctgtctctactaaaaatacaaaaactagccaggcgtggtggtgggcgcctgtaatcccagctacatgggaggctgaggaaggagaatcgcttgaacccaggaggcagaggttgcagcgagccaagatcacaccactacactctagcctaggtgacagagtgagactctgtctcaaaaaaaaaaaaaaaaaaaaagaggattatgttgctgtgtgtgacagcaaacctcaccccactaaaaaaaaaaaaaaataataataataataataatagtagctaaagcaagagaggtaggtggtcaagagctggtgtcatacactgtagggtcctgggcttattcttgcttgttgctccatcatcctcagcatgtggctccatcatcctcagcatgtggcatcccctttattgaggtccagccagcatgtctatgttccagctaaagagaaaatggcaaagtcaaagaagggcacacctcctccactgaaggactctaaatgcttccggtcacagatagtaatttgctatcattaataatttgctattgggaggccgaggtgggtggatcacttcaggttggaagttcaagaccagtctggccaacatggtgaaaccccatctctgctaaaaatacaaaaaaaattagctgagcctggtggtgtgcacctgtaatcccagctactcaggaggctgagacaggagaattgcttgaacccaggaggcagaggttgcagtgagccaagatcatgccactgcactccagcctgggcaacagagcaagactccatctcaaaaaagaaaaaaaaattctatcattttattgccaggactggttgcacggccacacctgacttcaaaggaggctgggaaatgtaatctttaatctataagaataaggggctcagaatcaggggctttattactaaagaaaaagggagaccagagaaagaggaacaactagcagtgctcaccctgcccatgtttatggtgggcattatgactgccctcctctagttccaattcttctccccttcccagacacttggaaagctccattatcatcccccttgcaggaggcagctctgctatactagctctggcaaataagccagagagatgggtgtcacttctgggtcacagcatgtaagagcccattgcagctctccacattcttttcccgcctgtggaagtgtgtggaagagggaggcgccagaaggccaaagcagcatgacctaccacatagaggacagcagccctggagggccctacagaggacttccagtcctacagagggtcctattgtcctacagagaacttcatgtgatagagaaatacacttttcaatgttaaaccaccaaaatttggtttcatttgttactgcagcacagcctaccctgtcttgtgtgatacaatattcctaataaaatcttcagtgtagaaaattgtaaatcaggctaggcatggtagctcacacctgtaatcccagcactttgggaggccaacgtgggagaattgcttgagcccaggagtttgaaaccagcttgacaatgtagtaagaccctgtctcaaaacaaagaaaaagaaaattatatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaagcaataccattcaggatataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaattaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtacactagttcaaccattgtggaaatcggtgtggtgattcctcagggatctgggactagaaataccatttgacccagccatcccattaccgggtatatacccaaaggattataaatcatgctgctataaagacacatgcacacgtatgtttattgtggcactattcacaatagcaaagacttggaaccaacccaaatgtccaacaacgatagactggattaagaaaatgtggcatatatacaccatggaatactatgcagccataaaaaatgatgagttcatgtcctttgtagggacatggatgaaactggaaaccatcattctctgcaaactattgcaaggacaaaaaaccaaacactgcatgttctcactcataggtgggaattgaacaatgagagcacatggacacaggaaggggaacatcacactctggggactgttgtggggtgcggggaggagggagggatagcattaggagatatacctaatgctaaatgacgagttaatgggtgcagcataccaacatggcacatgtatacatatgtaacaaacctgcacattgtgcacatgtaccctaaaacttaaaatataataataaaattttaaaaaaaagaaaattataaatcataaagttaaacatctatttaatctgcttcccccactttatttttgtataagtatgcatacatttttctttttatatataagctcatactatatagtctattctataaatcacttttttcattgtgtatcatctctgtatcaatgttatctatttttttaactgcatggcacgttacgtatgattcaccgcaatttgtttaaataatcacctactagtggacagtttatttcttatttttatatgaaaatagaaatcaggtttgtgtgtatttgtatctttgcacacttgtccaataatttccttagaattgattcttaaacacaagcttacttggttaaaatctatatcttaattatacatgttaccaatttgctgtccagaaaacataatgatttatattccctttaacaatatatgagtattcatttcctacatcctcaatgctggatgtaataaaactttttaaatgtttaggtatccttaacatccaaacaatgagtttctttgattagtagtaatatagagatgatttctaaataaatttgtcatcttcatttcctccttgagcatttttaacttatattttttgcttattttcctagattaccattcatcttttgctttatctaataaggatattaaccttctatatgctatgtatatttaaattttgtttttgctttaatagtgtcggggtgttttttgaactgtgaacagtttttttcagtcctgctccttctgtatatttttaattttttaaacattcaaatctgtttatctcataactgtgtaatttctggccctgaattttggctaggaaaccttttaatatccatggtttataacaatctttgtctagtcttgaaaaactgcttattaattttaaaattaataaggcatgccggctcatgcctgtaatcccagcaccttgggaggctgaggcaggaggttcacttgagtccaggagttcaagaccagcctggccaacatggtgaaaccccgtctctactaaaaatacaaaagttagcctgggggtgcatacctgttatgccagctactcaggaggctgaggtgcgataatcacttggacccaggatgtggagattgcagtgagctgagattatgccactgcactccagcctgcataacagaacaagactctgtccccaaaaaattttttaaatgacatatattaaatgttagtcctctagtatattcctgatccatctttattcaatccccaaattcaatttccagctaaaatggagtacttttttcacataggtcacatggttttcttgccttctcaaagtcagggaaaacaggaaaaaaattacttaaaaaagtaatgacattgcaggtttgtagatcaatatttgtagccataaaagatgtgggttttttcttttttagaaaaaaggagaaaagaatatggccaagttcaaaaagaaaacagaaaaaaaaaatgcccaagacataaggaagaaaagtgaaattgttactctcttggtgtttatcaggcccctcacctgaccagctggcatgacctcctctccagccacatgtgcctggagcatagccagccccaaccttgtcccctaggccaccccatcagtagactccccaacaaaggaagagcaaacctaacaccaacttggtttatacctagtcttcttttctcttatcatagggagggaatggggttgaggtggacatgaggcatcagacaattttgagattagaattgtttcctgtctagggtcagagcccagaagaatagacacaagtaacctaaatccccaggcaggattcagactttcagttccaaactggattagatttggagtcatagagtgttcagaactacctcagtcaacccatgcttgcttgcatgcctgcatgcatgtgtctactccagtgcacaaactgtgttacttgcagaataagaaacaaaaaagctgcatttttctggttcctctgcttcatcccacttttctttttctcctctgtattctctccctcttccctttctctgttcctttctttttccctttttctttttttaatttattttgtaaattttttgtatagaccaggtcttgctatgttgtccaggctggtcttgaaatcctggcctcaagtgatcctcttgccctagcctcccaaagttctcggatacaggtgtgagcccctgcacctggcccctttttctttattcttttactcaaaattattcacaaagggcctaagatatgccggtcagtggggattctcttggattctatacctttatgggagccagcctgggaagagatcttgtcccagctcccaaacatgaattaggacatgaggctcactgctttggaaatccctctaatttttctgcttgttcccagcatgcctcaatcttggggtttggcctagaaggaaagtcatatctgcctgcttgcacttcccctccctggcctcttcttcctagttccccaccccactgcctccctaggctggaggaaacatactctctgtcatttgctgagtgttcactaccaatgacttataggaaaacttgacattcagacctccaaagttttcttttgataggtacaggtaatttttggaatttataaattcctctttgctcccaacaaatactgtgcttcaagattttgtctaagcttgccaaaatggccccaactgagcagtggcttctcaattctagcaagcatctgccctccccctgaaacctattgatgtaatagtcagggaaatctttactatttgcaaggatgaaaaatacatgattcctcagcagaaaccttacaagctggaagggattggagtcttatctttagtctccttaaacagaataactctcagccaagaattttgtatctggcaaagctaagttttatgaatgaaggagaaataaagtcatttttagacaaacaaatgctgagggaatttgtcactaccagaccagctttataagaaatgccaaaaggagttctaactcttgaaacaaaagattgatatgcaccagaatacaaactcttgaaagcataaaactcacaaggtctataaaacaataacacaatgaagaaaacaacgtatgtaggtaacaattaacatgatgactgaaacagtacctcacatcttgatattaatgttcaacataaatgggcctaaatgctccacttaaaagatacagattggcagaatggatacaaaatcacaaaccaaatatctgctatcttcaagagactcacttaacacacaaggacccatataaattcaaggtataagggtgaaaaaagatattccatgcaaatggaaaccaaaagtaaacaggagtagcttttctcatatcagataaagcagactttaaagcaacaacagtaaaaaaaggcaaagaaggtcattatataatgataaaaggatcaatctaacaggaagatattacagtcctaaatttagatgtagctaacactggagctcccagattcataagacatttactactagacctaagaaaagagataagacaacaacacaataatagtggggaacttcagtattccactgtcagcaccagagagatcattgagacagaaagtcaaaaaagaaacaatagatgtaaactacactctagaacaaatggacctaatagatatttacagaagattacattcttctcatcagcacatggaacattctccaagatagaccatatgatagccacaaaacaagtctcaataaatttttataaattgaaattatagtttgatgggaataacattgaatctataaattactttgggcagtatggccatttccaagatattgattcttcttatccatgaagatggaatgtttttccatttgtgtcctctcttatttccttgaggagtggtttgtagttctccttgaagaggtccttcccatcctctgttagctgtattcctaggtattttattctctttgtagtgattgtgaatggtagttcatcatgatttggctctctgcttgcctattgttggtgtaaaggcatgcttgtgatttttgcacattgattttgtatcctgagactttgttgaagttgcttatcagttcgagaagtttttgggctgagatgatggggttttctaagtatataatcatgtcatctgcaaacagaaacaacttgacttcctctcttcctatttgaatacgctttatttctttctcttgcctgattgtgctggccagaacttctaatactatgttgaataggaatggtgagagagggcatccttgtcttgtactggttttcaaagggaatgcttccagcttttgcccattttatatgatattggctgtgggtttgtcataaatagctcttattattttgagatatgttccatcaatacctagtttattgagagtttttaacatgaagggatgtagaattttatcaaaggccttttctgcatctatcaagataatcatgtggtttttgtcttggttctgtttatgtgatggattatgcttattgatttgtgtacgttgaaccaaccttgcatctcagagatgaaaccgacttgatcatggtgaataagttttttgatgtgctgctggatttggcttgccattattttattgaggattttcgtattgatgttcatcagggatattggcctgaaattttctttttttttgttgtgtgtcttcccagttttggtatcaggatgatgctggcttcataaaatgagttaaggaggagttccctccttttcaattgtttggaatagtttcagaagtaatggtaccagctcctctttgtatttctggtagaatcagctgtgaatccatctggtcctgggttttgtgttgttggtaggctattaattactgcctcaatttcagagcttgttattggtctattcagggatttaacttcttcctggtttagtcttgatagggtgtatgtgtccaggaatttatccatttcttctagattttctagttcatttgtgtagaggtgtttatagtattctctgatggtagtttgtatttctgtgggatcagtgatgatattcccccttatcatttttattctgtctatttgattcttctctctcttctttattaatatggctagtgatctattttgttaattttttcaaaaaaccagctcctggattcattgattttttgagggttttttgtgtctctatctccttcaatttttctctgatcttacttatttcttgtcttctgctagcttttggattagcttgctcttgcctctctagctcttttaattgtgatgttagggtgtccatttgagatctttctagcttcctgatgtgggcatttagtgctacaagttttcctcttaacactgctttagctgtgtcccagagattctggtatattgtctctacattcttcacagaattagaaaaaaaaactattttaaatttcatatggaatcgaagaagatcccatatagctaggacaatcctaagcaaaaaggataaaacgggatgcatcccactacctgactttgaacaatacgacaaggctacagtaaccaaaacagcacggtactggtaccaaaacagacatatagaccatggagcagaacagagacctcagaaataacacgacacatctacaaccatctgttcttcaacaaacctgacaaaaacaagcaatggcaaaaggattccccatttaataaatggtgccaggaaaactggctatccatatgcagaaaactgaaactggaccccttcctcacatcttatacaaaaaataactgaagatggattaaagacttaaatgtaaaacccaaaaccataaaaaccctagaagaaaactgaagcaatatcattcaagacataggcatgggcaaagtcttcatgataaaaaagccaaaagctattacaacaaaagccaagattgacaaatgggaattaattaaactaaacagctacagcacagcaaaagaaactagaaatagagtgaacaggcaacctacagaatgggagaaaaattttgcaatccacccatctgacaaaggtttaatatccagaatttacaaggaacttaaacatatttacaagaaaaaaacaaacaactccatcaaaaaatgggcaaaggatatgaacagacacttctcaaaaaaaaaaaaatttacgtagccaacaaacatatggaaaaacgctcaacatcactgatcatcagagaattgcaaatcaaaactgcaatgagagaccatctcatgccagtcagaatgacaattattaagaagtcagaaaacaatagatgctggtgaggctgtggagaaataggaatacttttacactgttggtgggagtgtaaattagttcaaccattgtggaagacagtgtggtgattcctcaaggatgtagaaccagaaataccatttgacacagcaatcccattactgggtatatatccaaaggaatataaatcattctactgtaaagacacatgcacatgtatgtttatcgcagcagtatttaccatagcaaagacgtggaaccaacccaaatgctggataaagaatccagcatttagactggataaagaatatgtggtacatatacatcatggaacactatgcagccataaaaagtaataagatcatgtcctttgcaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtcccattttggggggttttttagaagaaaaaaattgaaattatattaagtatctcctcagatcacagtggaataaaactagaaatcaactccaaaaggaactttcaaaaccataacaaataaatggaaattaaataatctgctcctgaatgatttatgggttaacactgaaattaagacggaaattagaaaattatttgaaatgaatggtaacagtgacataaattatcaaaacttctaggatacagcaaaagcagtgcttttaagaggaaagttcatagcgctaaatgcctacatcaaaaagtctgaaagatcacaaattgacaacctaatgtcatgcctcaaggaactagagaaacccaaagctagcagaaaaaaagaaagatgagagaagaatgaaataaaattgaaacaaaaaataaaaaagatcaattaaacaaaaagctggttctttgaaaagataaacaaaattgatagaacattagccagagtaaccaaaaaaaaagagagaagtttcaaataaactcaactagaaatgaaactggagacattacaactgacaccacagaaatacaaaagatcattcaggactactatgaacacctctatgcacaaaaactagaaaaatctagaggaaataaataaattcctggagacatacacccctcctagattaaattgggaataaatagaaaccatgaacagaccaataacaaacagtgagattgaatccagcagcccatcaaaaatataatacaccatgatcaagtggatttaatcccagggatttagggatggtttaacacatgcaagtcaataatgtggtacatcacaaaaacagaattaaaaaccatagatcatttcaatagatgcagaaaaaacatttgataaaatccagcatccctttagataaagatcctcaacaaactaggcatagaaggggcttacctcaaagttataaaagtcatatatgacaaacccacagccaatgtgatactaaatgggaaaaaatctaatgcattcccctggagaactggaataagacaaggatgcccactttcaccacttctattcaacatagtactagaagtcctagccagaacaatcagaaaagagaaagaaataaatgacatccaaattggaaaagaaatcaaagtatcactgttccctgattatatgatcatatacctagaaaaccctaaagactccttcagaagactcctagatttgataaatgaatccagtaaagtctcaggttacaaaatcaaatgtacacaaattagcactgctatacacctacagtgaccaagctgagaatcaaagcaagaactcaatcccttttaaaacaacttcaacaaaataaaataaaatacctaggaatatacttatccaaggagatgaaagatttctacagggagaactacaaaacactgctgaaagaaatcatagatgacacaaacatatagaaacacatcccatgttcatggattggaagaatcaatatgaaaatgatcacactgcccaaggcaatctacagattgaatgcaattcttatcaaatatcaacatcatttttcacagaactggaaaaaaaatcttaaaattcatatggaaccaaaaaagagcctgcaaagccaaagcaatcctaagcaaaaagaacaaatctggaggcatcacattaccagacttaaaattatactacaaggctatagttaccaaaacagcatgatactgttataaaagtagatacatcgaccaatggaacagaatagagaactcagaaataaagccaaatacttaaaaccaactgatctttgacaaagcatacaaaaacataaattggggaaatgacaccatatttaataaatggtgctgggaaaactggttagccacatgtaaaagaataaaactggatccctatttcccaccttatacaaaaattaactcaagatggatcaaaaatttaaacctaagacctgaaaccagaaaaattctataagaaaacctaggaaaaactcttctggacattggcctaggcaaagaattcatgactgagaccccaaaagcaaatgcaacaaaaacaaaaataaataaatgggacttaattaaactgaaacgcttcttcgtagcaaaggaaataaacatcagagtaaacagacaacccacagaatgggagaaaatatttgcaaattatgcatccaatgaagaattaatatccagcgtctacaagaaactcaaacattatagaaaaaaatcccacaaaaagtgggcaaatgacattaatagacatatttcaaaagaagatattcaaatggccaagaaacatctgaaaaaatgctcaacatcactaatcatcagggaaatgaagattaaaaccacaatgagataccaccttactcctgcaagaatggccattattaagaagtcaaaaaaaaatagatgttaacatggacgtggtgaaaagggaatgtttatacactgctggtgggagtgcaaattagtacaacctctatggaaaacagtatggagatttcttaaataactaaaagtagatctaccattccatccagcaaccccactactaggtatcaacccaaaggaaaataagtcattatatcaagaagacacctacacacatgtttattgctgcataattcacaattgtaaagatagggaaccaacctcagtgcccattgaccaatgaatgtgtaaagaaaatgtagtatatatacaccatggtgtattactcagccataaaaaaagaatgaaataatgtcttttgcagcaacttaaatggagctggaggccattattctaagtgaggtgatggaatggaaaaccaaatactgtatgttctcacttataggtgggagctaagatattagtactcaaaggcatacagagtgatataacggattatggagactcagaaaggagagggacggaggagggggagtaaaaacctatgtattgggtacaatgtacactactcagacgaagagtgcactaaagtctcagattttgccattatataattcatccatgtaaccaaaaaccacttgtaccccaaaagctattgaaataaaaacaaattaaaaagaaaaatacatttaatattttcaaaactttagtgcctattaaacattcattcagcagtggagtgtaaggtgtgggccaggtatctgtcctaggtcctgggaactcagcagtgagcaagacagacacaaatccctacactagtggagcttgcattctaattgatacacctgtaattactaaacaaaatgaggacttgaaaaagagaaatagaaggaagtattatgagtctggggggaagaaagatacacacaagaaaagagagaattatagagaaatggcaagataactcctgaaagggtaggggctgggaacatgagaagggagctcactaaactattcacaagtctatttggtccaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaaggtaaggctaatgatggaatctgctatttgaatagctcaatgtaggagggcctcttggagcagtacagggtcagatagatatgtaaagtcaatagtagaaggagggagacgtacagaaaagagggacatgaagacagagcacggatctgttgatgtgacagtggttgttggaagaagtgttctcagggtgcagttcaccttggctttgccatgtggatttacatgactactccccagtgtctgctgttttcatttctgttattagagtcaccactactctcttgagtttgggagactcctttctggttctggccaacccagtcttggaagtggcaccaatcctcaaagtggacacatttgcaggattgttttttaatgtttcatttctagaagtgaagttgcttggtcaagtctgcatttttaagttaggacatatttgttgtcaaattgcctaaattgtctgtttatactcccattacatcatacagacaccctttccctccactttcaccaacactagaaataacaagatgtgtctatgatgacggccaaaggtgaagggtgatattccaccggtgtttccctttgaatttcttttcacttggcaggtgatcaaacatgctgtggtagcttgtattacggttctccagtgttccagtgccccacctcctcagaagtctacagccctgcctgtggactcaggaatgcccatgtgataacttagcgaaagaaatgtggacccaagttagagagccactttcaggccaaggctttaagagcccctttgtcttctttctctctgcccaagaccagggatgttctagacagaggctgctctgtctgcagaagccatgagtgtcagtgatgtagggctgagcctcatctaatttatgatgaacaaacagcatgagagagaagtaaacctttgccattgtaaaccagagcttggcaaattttttccaaaaaggaccagaagatgcaactactcgactctgcctttgtagcgtgacagcagccagaggcaaatacgtaaacaaatgggcgtggctgtattccaataaaactttatttacataaacaggcagtaggccaatttggcccttagaccatagtttgctgacacctgtaataaaccactgagatttgggaggatcgtgaattaccacagcattacctagcctatcgttaccaatttacctgttttttaaataaatttgacattggaattttttcttttgagggtcatctgtttgaatttgcccatttttctataagactggccattttttttttgttaaatccgttagggaaattaaccctttgttataattattagtttttctgatttggtttctgtctttgaacttaagaagcttttggttgtggagccatttgcttagttagatagacaaatcagtttacctttagcagtatggtttatgccagagtttctcaatcttggcattattgacattttggactgaataattctttgcttcggaggctgtcgtgtgtgtcatgggatgtttagcgacatctctggcctctacccattagatgccagtagcacctgcttcccagtcctgacaaacaaatagatttccaaacattgccagatatcccctgagagcaaaatcacccagtgttaaccactgctttatgcccattacttcctccttaaaaagcccttcctatgtgatatttataaggccatacagtagcccccctttataagcagttttttgatccatgatttcagttacctgaagtcaactgcagtttgaaaatattaaatggaaagttccagaaataaacaatttataagttaaaaatgatgcgctgttctgagtagcgtgacaaagtcttgcaccatcctgctgtatcccactcggggatgcgaatcatcccttggtccagtgtgtcctgctgtatacgcagcccacccatcagtcacttagtagctgtcttggttatcagattgaagaaacatagtatctacaggggtgggcactacccatggtttcaggcatccactggagggcttgaaacatatgccgtgtggataaggggggactcctgtacatccctttattctagtatttgtagtaaatgtattgacatatattaattagtggaaatttggcttctgtagtatttttagcttttctgcctattaacatgagcttgctgtatttccttagtcaatgctacaaggaagtcctttcataaggactcatatgtaacttgtctctccaaactggtagaaaaacaggaaaaaatgcttgaagattgttaacctatgaggcttataaatctatgtttgtagctataagtgattattaattctgtgtttagaaaagaaaaaggagaaagatatctgttcaagctcaaaaaggagatttcagaaaaatattcaccgaagaggtaagcaagcaagccacagcgcctccccactgggctccccagagccctggcctctgctggaagctccacccgccctctccttcttctctctcccttctcctccaaagttgttctccaccgtcatgggtaccagctgaattgggtgcatcaggagtgctgccagcctaacccacccccttgtgcatggtggccatttccatacttggaaggattctttaacacagagctatacaaagacccaaaaatgattaaggatgatcactaaacctttaagtcaaattctaaaatgaacttctatgtcttccattctaggaattaaaggaaacccttattcaagcacagcctaacagtgttctcattccttttcctgtgttggttgggaccctgggcttgcttcagcctctctgcaccctcggccctctttgcatctctgtcctctccctcccactcctcttcttgcatttatttttcttctgcttttataccttgcttcttcagcatcatttcttgtcaccctctcttccttttttaggcgccagccacactggccctttttattcattatcaaagtataataggtgctacccaaggtggggtccccagactggtgccatctacaagcatgttggttggcaggtctacgagaataaggagcttgtaaaccaactgtgacgctaagcacactgttttcatagcaagattcctcagtggagacagcagtgcattgattctgatcaagcccctgtcgcatcgtaggctggagcactgagtagcactggtgtatgtgcttgcagaaaatggcatgtatcctaagagtacagcttgatggattcacacacacagaaaatgcacccgcacacccagcacgcagctcaagacacaggatgtcaccaacacccataaaccacccctacccgtgtctctagggtcacaccagcctgattcctcacagcataggtcatcagataccgaatgctcccaccttgttcctgctcagggcctcctcacatgggcctcccagctcacccacccaaccccaaagtgaatccccctatcttcctccctttctttgctatacaccctcagacctcaccttttttaaaaatatttattttaagttccaggatacatgtgcaggatgtgcaggcttgttacataggtaaatgtgtgccatggtggtttgctgcacctatcaacccatcccctaggtattaagcccaacatgcattagctatttatcctggtgctctccctcctgctcccctgataggccccagtgtgtgctgttctcctccctgtgtccatgtgttctcattgtttaacccccacttataagtgagaacatgtggtgtttagttttccgttcctgcattagtttgctgaggataatggcttccagctctaatcatgcccctgcaaaggacatgaccttgttcctttttatggctgcatagtattccgtggtgtatatgtaccacatattctttatccagtctataattgatggatatttaggttgagcccatgtctttgctattgtgaatagtgctgcggtgaacatacacatgcaggtatatttataatagaatgatttatattcctttgggtgtatacccagtaatgggattgcttgctgagtcaaatggtatttctggttctaggtctttgaggaattgcttcgaggtctttcacaatggttaaactaatttacattcccaccaatagtataaaagtgttcctatttctccacagccttgccagcatctgttgtttcttaactttttaataatcgccattctgactggcatgagatggtatctcattgtggttttgatttgcagctctctaatgctcagtgatgtggagctttttttcatatctttattggccgcataaatgtcttcttttgagaagtgtctgttcatgtcctttgcccactttttaaaggtgttgtttgtttttttcttgtaaatttgtttaagttccttgtaaattctggatattagacctttgccctcagacctcaccttaaatgtcacttccacagggaagcattctctctcccagcaggtaggggtgggtctccctgacatgcccttgtggagacctgcattttgtcttcatggcacttatcttaactgtgatgaatgatctgtgcacagcctgttcactgcgtgaaagtcacgtgaggtcagtaagtggatgggtcttgtgtgttgctgtatgtccagctccccatgcctcacacagctggtacttcttcaagtatgaataccagtatctgggcctatctgatgcatgtgtgtgagttagaaaaaggtgccccttcctcaattcactacgtcatctgtcagagccaattcttgaaaccaaacccttttctgccttctgctggaagattgttgtactaagcaggtaaactgattctgtttctaatatgaattagagcaccccttaaaggtggagtccttgctcagggcacaacccatacaacttcatgcagtggtcctgataaccatataaatgtgtacattacttcacagttggcaaagcactttgatctacattttgccatttaattaccataataagtgagtgttatcagcccattttacagattcaattaaagggcaaaagacttgaatgagctaaaatcaacctatgtgttccaatttcaagccctttttcctttacactaaaaatgtaaatgaacctagaaagcacctactctcaaacactggtggaggcaggagccccggcaaacgttgacagttgtccctcagcatcagtttcttctcccttctgcactgtctgtaacttctcattaaatgcagagtatctgtgctgttgttgcttgtatgatgtgcagtctcgtggcatttctgatgatgtggaaagagcgctagatactgggtctggcatgtgtaaattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccgctgctgcagctcacctttcaaacaagccagctgccgttagagagccccaagcatcccccaccgggttcctggggctgcagggttccatccttcaaggcctggttggtaagatgagtaggtgaggctgagccagacttagcactattaggaacaggctgccctcaggcataggacagttggctttggaagtcctcgggtctaaaggccccacctcacttgatggcctgcctccactgggtaaggaagggactgatgtttgtcctcacaactctgcacatcagcttgctacccgtggcccccaaagccaccccctgctccctcatctgcttgtgaatgtgtttgggacatttgtgttccctaaagctatattcaccacagggaattagagaagacatttctgtggagacagagaactgtagaagggaaggtccccagagctgtgctaatctccctcaaggtttgcaatagtggtccagagtcacctggagctctgcctttccctcacattaggaacctgcggcagcaaatttcccactcaaatttgataacagtaatgcacgcttaggtaatccttctagtaagttgcagagccaggattacaagcccctcccacccccacccctccctgccccccagtctggctcccaaggccacgctctcatctgctgttccatatttactgagttgagtctagagacaaatggtggagctggccactccatgcaagagggctggctgttgaaacaaagtttttcccaccgtaagttcccacacccccactaccctccacccccatgcctagccttgctgccagcccctgctcctgtgaggccaggcatcctgtagggttctgtcggggggatcacatcctcacttctcagggtccctcctctctcagtctcactctatctgccttgtgtctttccagagaaatgaatggcttcttcgccgctgatactgttccttcacctttccgtcaatgctcttgttttgccatttgttttcctttagctctttcaataactgtttgaggcaagggagagagttggaccaggtgttctcctagattcattttaggtgtaacatcctctgtaactcaacataagacatggacagccccttcatttctccccagagaaacagcccctgctgtctctctttaatgaattcacccatagtgaggttggaggggaaggcagcaggaattgctgagatttattttaaaccctcttgcaactgcttcccctgaatctaaactctggatttctacccaggggttctgagttgccagactgctccatgagcaactgggaaattagttcaaagctctccagggttttcttttattcatcgaggaagaagcagggaagcaataaaatgaaaagaaacagcaaataattaagactgacaccatcccctcagtgccagccacctcactcacccaagtcttcatttgagtcaggaaataagattataaatgaagatttttttttcctctggcaacatgaatgcaaagaaacatttccatcagcacagagagatcagcaggatgcttatagaatagaagactattcagtgacagccaattcacttgcaaattaagacacattcactgaagatgccctatatgttccactaaaatgttttttttttttgatatagtgttggtggcagtggtggtttgttgcaggccactgtgtacacatagcttatctgtcactcgagatgaaagagttcctgcaaactaaccagagaacgttccccaataccctgtacattattggaattcatggaggggagaattcaaaaggaagatggagtgaagactgaataacacaaaactgttctcttctactttaaggaaaacccaaaagtgacactgtggattttcactgttctaagctccccgtgacctgtggtgaggcgaaagggattttatataagaagaaaatgaaacacggtgagttccttggtcttctgctctttggaatccctagatgaaggactcactagaagggaggaaaatacccgtgtgtgtaattgatcaggaaatggaccctgctagctagactgcagaagaaacgcttcttaggaaggaatttccaaactcttccacatcatggtatttctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaaaggtagaaggccacaattaggatgaagaggttcagggtgaattcacagaggatgggggtagatccaagaatgggctttttcttacaggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctgatggtggagaactttaaatgcaagtaaaggagtacaggaactttaaatgccggcaaagggctttgaggtgaagagagatgtaagaacctaaaaagaaactagctgaagacagatgcctgcaaccactcccctgcatcctctacctgacatctactcaaggcccagctcatctggcccccctgcagcatttccaggctgcccagtccgtggtctgtctctccgctgcatgtccacagcacactattcctgtcctgagaacaactagtgtctatgatgacaggacccaacacaaggcctctctcagcaacactcaagaaattatcactaggatgaaatcctaaagattttaatctagagagggagaaatggaaggagaaaggaatggatgggaaaggttaagaaagaagaactagggtcgtgggtttgagtgacaggggaaaaagtgattttatcactaagtgaggtccagaagaaaaactgactgggggagggagctaatttttctttttgacttcttgggtttgagatccagtgtgatgtctgggtacagacattcactaggaagtgggaaggccagtatctacaaaagaaaaacctccagaataacctcattcattgactccttctgtctttcagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagctcatcatgtccatgtgttttagaaaaagatctggatatttggatggctataaaccaaaggtgtcagaaataaaatgctctaagcctaggcaacatagcaagaccccatctctaacaaatttttttttaatcaactaggaatggtggtgtgcacctgtagtcccagctaaggctgaggtaggaggattgcttgagcccaggagttcaagaccagcctgagtgatatagtgagactctgtattgctatacagagcgatgtaatcccagcactttgggagaccaaggtgggtggatcccttgagcccaggagtttgagaccagcctgggcaacaggacaaaaccccttctttacaaaacatacaaaaattagccaggcatggtggcatgcacctgtagtcccagctactcaggaggctgaggtgggaggatcacttgagctctggaggcagaggttgcagtgaggcgagatcatgccactgcactccagctggggcaacagagcaagaccctgtctcagaaaaaaaaaaaaaagaatgctgcagcatgaaaagcaaaagaaaaggcattgaaatagacaggaacagtatatgaaaggacaagaggatcatccatgattgcatactgagtattgctgaatcctccatgcttcttattggtagcaccaggatggaatgacgcctttgaactgagctttgtctctacagggcatccctacagctggaaatggcagtcatctattggctgcactaactccccctcctcaacctcctctacttgcttagatgtgttctccagacacatcagctccactcatgagcttcccgttagttgtgaacttccagcagagacaatggtgcctcccccatcttgccctggaggctggcctgaccaggctggattcattcaaagtttaaggcactggtctcccaatgccatctattatataaatcatctttcccatgctggtctgaaataccctgagaatcaggggtgctcagtgtaacatcataatagcaaaaaattagggacgaacacaagttctatcagtattgcagaataaactgatacagctacagaatggtttttttttaaacttttcttatagaatattagacctttgatataggtatttgtttaaatacatggattcataagtatggagttatccttcaatcaatggaaagccaccaaatggttttgtggtcaggagagcttcaggacacttaatgctagttgtgacgtgtggggaaggaacccattgttgcttatgtgaacgtgtaggtaggtctatgagtgaaaaaatagccaaaagaatcaactgcacttattttgagatgagatcacagggacatatgccttctgtattatacctttatgtacaattggaattactataatgaccatttgttacttttgcaaccagaaaaaaaaaaatctttaaaatccagatcattaattaatagccccaacatggtaataccctctaactctcctaatgccacatgtcagctcataatagccaggggcatgcttgacccagcctctcagtcccaccttccagggccaggttgggagaataagatgaaggtttacctgactgagaatgagccagtgtgggccttgccctcagccccatcatccagtgtcactgctgctcggcagcacgtccgtctgtctccactgcagtctcacttatgtatgtgtacaacaaagagaccgatgctggtactcccaaaatgtgttttgtggttgccctgcagcgtgctgcctccatgacccacacatgatgggcagctggtgtaaagagccacagacttggcctgtgagagcctccgtctccagaagggcttggatgcagccagcagttgccactctatcagcatatagtgtgaggctgag

SEQ ID NO: 732 - DNA, 35489 bp, Human; identical to SEQ ID NO: 731

SEQ ID NO: 733 - DNA, 80490 bp, Human
  misc_feature (1)...(80490): n = A,T,C or G
ctctgacagctgctaccacctgtggggacccttgatgatgttcacgcagcttttctgagtggcacatgctgttctcttgaatactccttgaggtgaagaagaggccacccctacccctatgcacacacagctcctgctctttcctggggctgcaccctgcttgtatttccaatgcagggatgtcagattccaaagagggctccccaaggcattccagaaggcttcaggccagcacgtcccaaccttttcatgccatgggacccctttggcaggctgctgaaaaccatggggttcttctcagaataagggttttaaatacataaaagaaaccacaagaggttacaaaaaaagccaataatattgaaatgtagctaacaaaatgtttttaaaaatttgtgctagagcaatatatatgcttcattattgacatataatatctggctgattgtctaataactactgttatttgagatacttgcaacaactgtgatgtgatgtaaaaacctatggtttctagtgattactaagtcataaatacttatcctactgctactgtagtttgttgtctacgttcataatggcaaaacgtgctaaatgtcagaggttggtgaaaattaagacgtaaattttttctcatccaagttcacagtactcttgaattaattacctctcctcgggttaagaacccctgcaggataaggttgcccctagggccaacacctcactggagccccgcctcatgtcctggagcaggatccttcatgccacctacacagaactcggacctgtctcttggcccagcagttctccccacaactagttctgaaagtccggggctaggaaagaacggcatcgtcgcctgagctcctggcgccactttaaacaacccatccttgacttgcgtgacttcttccacaagctctcctggtcacctgggcaaaatcctaggtgatctggggacaaggcggaacttcggttttctgatctgcaaaaagaaacacctacctcataggactcttagcatgacttgacgtaatggctggcttgtgtccattatacagcactatcaaggtgtgcgctctgatcatttttgagggttcttaggtgtttgagcacccagcacagtctccacagctctactccccacctgttcgcgccgccttaaggaatccctaaccacctgtccgaaatcaatgactccacgtatccatctcgccgtccccctcacatctcccccaaccccctgcacaccccatcccccgcgatccatcccctcgccttctctccatcacccccactaccctctccctcccccccccaaacctcccccgcccccctacccaccaccccaccaccaccacccccacccactccctcccnnnnnnnnnnnnnnnnnnnncagtctacacagctgtagtccccaagtgttgggcacgccttaagcgctccataaacacctgtagaaatgaatgaatgacgtatgcatctgcacgtgggcccacatctgcaagaacaggctgctcaggccatgaggcccggtgcatcacctgcacttctctttataacgggtagtaaagtctccctcgctctgtgctactcggcaaccacaattctgtccacagagggcggcgcagtggggctgcttcgccgcgagctcgcctccggggctcccacgtcgtggcttccgggcaggtaccgggcagctggagacgccagagccggcgggtaaggtgcgggcggtgcgccgggccgcgggcgcgcaaggaggggcgagagggtggggaggggcggggccggcgtcctcgtcacttgataaaacgcctgcgagtctccagagaacaacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgtgagttcccagaccttcccacccccactggggcgccggcctgcgcgcgagttgaggcgagggcgcgccctgttcccgccggccccggggagtatttggcccgtgggtcgcgcccgggccggccgaggcgcacccagcgcccagcgcgctcggctccccgccctgacccgccccgcgcggcgcctccctccattcagctcgggaaggaggacaacccgagggctaggctgggccccgggagagtttacttttttttctgttttaaacaaagtgctttccgccggttcttccctccgggcgtgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttcccagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggctatttaagccggagagggtattttggcgcttagtcgccttaatcgctatggggttgcattcttcatctgtgctactgaaaaataggctgtagcaacaaaaggtctcccctccccacccaggccttgagttgaactaaggaccttccaggaccaacagaccggagaaagcaaagtgcagccacagtgaagagattttgtgtttaggagaggcgaatgggattttagaactggaggaaacctcttgatttcagcggttaacaactttggaattcgtgaatgttgcagcccctgaattttagtcagtttttttttttttctgataacacctgctaggtgaagcacagaaattagctgggggtggggaggctctaggagggtggtctgaggctatatgcctggccagctgcttatactctgctttctctcagaaataattgttgttaagctgtaaatctgaaatgaaaggttcctgttaactcagttaatagatgacgtttattgtctcggaatacttggtgtgtagaatttgagcttgttagtgcagaaatgattgtgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgcctggcatgggtacttgctgactaaatggtagctgttaatgatcatttaaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatgtttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagccaagttggtccgccgagtgactgaggtcagggtctgagcaccttggactctttaatttctcttaggtagttaagattgagtcattcccagaggtggaaggtatgtgatgatgactgtgggtatatccagcctatgaatcatcactcttagctcttctgggaagagatggatctatatatgatcacagggaagaacctagaagaaggagatctataagagatagtctcatgaagtcattttggatttctgccaaccctcattttcttctttatggggtctctctctctgaccaccactgtcttccagaaatgctccaggcccgcggtctgttctgttctgacccttactaggtttgttcttgacttttctcagacttgtcatgttccatctcttaaaatcatattttctgaactagagatcatctagtccaactgcctctttttacagatgaagaaactgaagctgaaagttcagcttgagcagaatcttaacagaatgtggatttgaatctctgacccatgctcatgccatttttaaatggaaaagccagaaatgttcttcagacctagagaaatcggcaagcatctgaattttggaagtgtactatattgtgttgatttatcaaactgcttcccatatgcataggtcagggctatctatttaaatattggtgcctggactcttactattgactctattccagctggccttggaacaagttctgggtccgtccttctttgcctgcctccaccccattcccttctgaaaaagcccagtgaagtgtggctgtagctagccaagaatcagagctgtattcaggatgtgtacctaagcacttgcttccttgcatttattcactcggagtgccatgtggcccagggccatcttccagggattgctgggtcaccttgaatgctaagagtagagaaaaagccaaaacgggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgagacaaaacagaaaatactgttgtaagcttagatgacagggtcaattgtgcctgaaacactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgcctgctagcacctagcatatgccttgcaaatacaatagagactgatattatacactgagtttaacctgtgacatcaactcttcctgctgagggtggagagagggagaaatccctttctttaaccctttgcccttccttgctcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggtactcgggacttgctgaggtggttggttgttatgaggctggacagagaaggatgactgtggaatagagatctttctgaaagcaacttgacaggggtgtgggggtcaaatggaagtgtgcagtacacgtgtgaagtcacttgtgaattgatagcggcaggtttatttcttcaaggatagtaagggaatcttggatatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagccatgccttctacttagcagcccttcgtagctactaagccatagataaatcccagtgaggtctcagtgttcagagatgagtggacagatgggtgcatagacatgacggggcagtgactgtgagctggatacccatggagggtgggtggtgcagttataggttgggcttactgctaaggaataccacctgtctggtttccaggccttcttagacctctatgaccttgaaagcacccccacacctccatccctaggaggctggataacttgcacaacacccagggcaggtttgaaaacgatttatttttcttagttttttgcttggcactaatgtttgctaggaaggagcttgtggattattgatgacaaaactgcctaaggttggaaagtatgtgggcaaatatggaagtagtgtttccttcacaggtttgttaaactggcatttagatttgcaaacactgatctcttggaattaagttaaaaggctaattgttaattagccctgaactggggcaggtagatgggcctctcaccagtgcaggtccctgtcaactaataacagggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaccactaaacgcaagtcacaaagggcaaaaactcatgacatggagccgtgggtatctgcttgcatgtttatttgccaagcggctagtatattttgcatgtcatacaatctgaaacttacttttttgaaaagccatttcagatatagtataagaaaagcctttgagagaaacatgctttctaagcctgggagtacagaaataaaaataaactttgcaataatttgaaaggggcacactggttagttgaagagtaaggaagcacccagtaatgcctctttacccaagagctctgtttgctttgctcggtgatatcaatgtcactgtggtttcttcattttgaaaaggaagttcatttgtactgaggtggttttaagtgtgtgtgtgtgtgtgtgtgtgtgtgtgtgtatgatgcaaatgataataaacatttcagacccagagggcagaatgtcactgaacctaagccctcctgagccaaataactcctttgtccttgcagaatcaggagcccttctcttcaggatatgctgccattatgataaagcattgtgatgtaaagttaacgagaggatccttatccaagtgaatcacagccaaggggtggaatggttggcctctggtagggatgccccattcagcagcactgagagtttggagttgttctgttctctttccttcttgctgagggtagtaagaaatcctccctaggccccattcccctgatatatcttgcgggtgatggcctcttactggcagtgtgattatgtatgtccctttagaacaaaggtatcgaaacaataaaagttgtgaaatggaaatgtttacaattctacaaggctccagagagattagagataggtaggaaaaaggccattgttttccaatcaaaggtgctgagaacctgttgattggacctaaggaatccagctttgccacgacacaaaacccaagagttttgtttcttttttttttttttttttttttttgttgagacagagtctcactctgtttgcccaagctggagtgtagcgatgcgatttcagctcactgcagccttgacctccttgggcttaggcaatcctcccacctctgcctccccagtagctgggactgcaagtgtgcagcaccacacccagcaatttttttgtgtttttagtagagtcagaatgctaccatgttggccaggctggtctcgaactcctggattcaggcaatcagcctggcttggcctcccaaagtgttgagattacaagcgtgagccaccatgcccagccccaagagttttcaaaaaaggaagagttcaaagaggctcagaaatgatcaagtggacatacagagacataattttaggaaagggatattattaatatttgccagtgagtcctcgttactgctggtgagactaggcccaggtaccgacttaaggcgatactttgaaaaagttgagaggtggcttaaagacctgggtgatgaatgaagaagacctccatgactttacaagtgcaaagagagatgggtctgggcactgctgggccttttagaggctcaaggacagtggccttggggaaggctgaaggagacacctattgaattagatggtgccaaggctgagggaggactttcgggaatcccagactagagaagtgttttaatgccaagaacatgggaaacccatttcagatactgtatcagataagccagcttagaaaagcaccttctaaggcttgccctatatttagaaagggctgctacagaggttaactgagaaggggttgtaggaatgtggagaggcgttgtgaggatcctcattcaggatgatctgggaggtaagctctgagagacaatgatacctctccccaagcttagcagccatgccagaagccagctgagaaggtttttcaatatcatagaatatgtaagctctgtaagctcatttatttctctctgtgtgtgtacatgttttaacccaaaagaaatagggatttttgtctgtattcgaacatgcagggaatgtggtctggacctgccagagaaaccgtggccagctttttggggttttcctatagaaattgttcattcaacagatattcactgagtatttactatgtatttggcactgttctagtgctggggctacagcagcaaacaaaatagacaaaatccctgcctatgttctgatcggggagacaaaccataaacaaaaaggtgtattatgttagatagtaataattaatgcagaagtgttaatgcaagagaggggagaatggttgatgtgatctgcaaaaatataaagtagagagggaacagggagtgcagatggggagggaagtggtcagcagtagggctgcctgggaagactttgctgagaaggtgaagctgcattcctggcagagagaatggcaaacacaaaggccctgaggcagaagcatgttcaggcaaagcagtgagtctccttggaggcagattgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtttttgacctgagcagctggaaggatggagttgtattatggtttggggagagatgtgagagtaatagattttgggggcagggcaggagtatggttttagatatgtcaggtttggagtgtctagacagccaagtgagttatttaggcagttgagtaagcagctgagtcaattaaaaaaattgaatttaaaagcctgaagttcagttggaaaggtttgattggtgatgcaagtagaggagcctctaggttgtgtttagaatgatgaactgatgagggcaccaaggacggggatggaggcctgagccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagattggcaatgtagaagccactggtgaccttgtgagagcactgatggggaggagtgggagcaatgcctaattggagtgggtttgtgagagaacaggagagaaggaattggagaccataggaactcttgaggggttttgctgtagaggggagcagagccatggcaacaactgtaaggggaaatagtgggtttttgtttcgttttgtttaagatgggagaagattatagtgagctggtttgatgaagatgattcagtcaaaaaggaaaagttaatgcaagagaggggagaactgttggtgtgacctcaccaactgagtaggtgagaggacgtaccgtgggggaggtggcctgatgactggagcaagggtagctcatcacagttatgaggaagaaaggtcggatgaggggcacagatgcaggtaggtggctaattatcctggtggaagggcatggggtttttccattgcttctaatttctcagtgaataataataagtcattagccctaagttactcagtagttgtgtaaaagtttgcctcattaggagtaagaacttcactgaggcagatggatgtggatttgaatcccagctcctttacattctattgattttgacattggacaaattacttatcttcattggtcaaatgaaggtactaatagcacctacctcagagggttgtgaacattaaaggtgaggataaagcacttagcagagtgcccggcatatccaatcaacatcagcctttactgttagggtcccttaaagtaaaatatgaacataattccctcacactggggagtttttgtagctctcttatcttttcagtctggtggacagcagaggttaccctttgggggccaggtcaaaggttaagtttccctatggaagactacaactggagggcagtccacaggccgccatgaagtatacattgttttgatgaagacaggaaggggaaatatgggacttggaagaaggaagagaagatggcagcatgtcaaaactctttggcaatctgcagacctttgtgctatatttgagctacagagaaccacgactttttattttgagttcttacaagactcattttaggtgtggagagagctcttcccatgtgggtctgcagctctagaattgggtagtgccttggatggcacagtcctggtgtatcctgcaggctgagtggacaggagggcgttgactgggtgtgtgtgatacagggtggaagccagctccgagaacgcagcaggagagccaaggctgtgcttcctgttcctgctggcctggttgatttgtctttgtaatcctagtcaatgcatccagcgtctcagtgcatatattgaataaaaaatgacgaatggccttgttgaattgtcaggagtgtagaaaatgaggctcaatcagcactttgggttctaaaatactgtcgtttttcaatctcttctttcaagattattggtatagaccttgagggaaatctgagttcaaaaggaaatagaatatctttggaattttgcaaaagtgtgagtcatcaggacttgagcatacattcccctggtgtgctgcaaatcagatatgaaacatcttcctgaggtggcatggtggtggtataaaagcttcattatagtacagaatgaagtgtgtacttatataaaacacaagtcttcgaagacattgcaagcttttggtggttgctttgcactgtgcctctgtacatgttcacctgcctctgtcattcagtgcttttgtgaaaatggctgggaagcattgaccagctcaaccttttctctctagaaggaagactgagacccagaaaagtcaagtgacagctagtcagtggtaatgtgggccctgaaacctagctgcccagtgcccagtccacctgatggtatgccatacacatcttccgtttggtgaaatagcccattcttggagttaaacttgtgccacataaatcttgcccttaatagaacagtatcttgggtttttaaatgtcccctacatagtgggctgggagagatagaaaatacagccactgtcaccccttcccctgcttactagggcactccaaatgaccatagcacattttttcagtggagtctcagaattcttcaggtcaacattggtcagccttcactgttgtgtgggtgtttgcaaataagacagcacctgtttgccctcctggccttgctaaatcccgtgcatatggaaggcaccctataaatgtatgcctgatggatatgagtcctgttggtttgtgagcttcttaagaacaaggctgacatcttgttcagttttggttcaaatctaatacatagaaatggatattcagtaggtatttgttgaactctttgattccccaaatacactaaaggcttttagagaacaggaaccagggtaaacatttctttagaatgatcttttacatgctggtactttgaaaaaaaattgtggtaaaatatacataacataaaatttattttaaccattttaaagtgtatgattcagtattgttaagtatattcacatcatttcttgcccggaaatgatgttgtttcatattatgaggccataaagtattgataagctaaacaaactttaactcaatatatgattgtgctgtatcatttagtactatattctaatgtgtattagtggcaatgaaatttaaagtttaacatatttatggtacaagttgaaatttagtctcttagcttattatgtgtttttccaatccggttaaggactgctatgagttgaattcagcagttgtatacctggcaccaacagcctttgagaaaccaagtaatttaagtttttaattgagtaacagaaaattgcaactaataaaatgcctggctatattagcttatttgtcatttatatgttgttagtactccttaactcttggtagctttaagatgaaaccaagagtggtttcagttgcattctgtgttctgattgaagctgaggcttgatttgtggcttgaagtttgaaaggaagtgcctgtttgttcagggaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccagcactttggaaggctgaggtgggaggaaggcctgagcctaggaactcaaggtgagagtgagctatgattgtgtcactgcactccagcctgggtaacagagtggagacgctgtctctttaaaaaaaaaaaaaaaaaaaaaaaatcaaacctcagtgcataagacacaggtgttttcatctgtgaacgagagtagacacattctagtaatacccaatgtttttgtgaatttctttacaattgaaactattttccacttgtagaagttgggaaggaacttggggaatggcctggaaaggtagaccaccatcctcatttcatagaacaagaaatggagacctaggatttgtcatagtcctgcagccagctacagacagagctgtgcctacaattcccttcttgtcctgagttgtttctgcttcatttcccactagaaccccatcccgccctcacccctaagcagaggtccagctagctaatgtgtctgtttttataaaatgccaccagaagcttaagtacgtcggttcgtgtcccatcaaacttgtccagatctctttctcatcatagagaggtaccatcctgagttgctcagatgataaacatttctccattagaaactaggctcggatttgcctgtggccacaaatccagaagcagctgtgtgttccccatgtttctcaccaacccctgcgtcatgtttctgaataaggagtcctggttaccgccacacccctcattcattgctttagattagatgaaaggcgaggtgcctgactcaggccactgactcactctgcttgggtgaacccagctcctcccggtaggaagtgattgccccaggcaggttgaggagtgcccacagcatccaggactaaagcatttggaccctgcagctatttataaacagcactttacagtgctttcagtctgaatattgggactcccctagaaaggacagattcagtcctttctgaaaggaggatagacgaagggtgaggagttcttgttggatgtattttcatagctgaaaggttcccctgaatgctgtcagtgccatggatgttcatagggaaggttagagttcctgtctctgatgtcattcattttatgctgcagctcacttgactgtgggactccctaggaaagcttatctaccttttcagctgttgcacctcttttcttccatgtagtttgccctctgccttacattcactcttcattgtaatgccccagttgccagcacagtgcctggcgcacagtaggtacgtgtttgtgagcttgctttactgatgtgttgtcatgcctctggaacgggctgtaaaaatcaatctttgactctttgccagcaactgcccacataaagagagcatgtgtgagcttgttttatgcaattacaaggtttgcttcatgacttgtgggcgctgattttttttttttaacctcactatctccatcattttctctgcaagattttcagtgaccctcgtgtccatggactgacctccatttttaaaatttcatttttaatttatttttgaataggtagtacagtcacatggtacaaatattaaaactacaaagatggaatgaaagtcagcctcccacccttgatctctgggcatcctattcttcctggaggcaaccattgttttaccagcttactgtgaatctttcagagctacctatacatttacaagcaaatatgtacatagattttttttacccatttgccatgtagattcttttgcaccttgctctttttctcttggtatgttttaatgcctgttcaatcttgtaaataaagagcttccttattatttttaatctctgcataatactcagtttcgaggatgaactatgatttatttaaccagtctgggtattcagataatttctaatccttcgccgttaaaagcagtgctgcagtgaagaactttatgcttccctcatttcaccttaaatgaattaatttaaggtgaattaattaattcctagtgcagagtggcctggccggcgttgttgttttaatggtcacggctgattctggaggagtggctgccctcattcctttctatcctaaccatctgataggaccacaggctacgctatcagtgggtttagtagagtcttttcaacaatcgagtttccagccttatgcccaagctgttggatccctgaaggcttcaatgtttgtgtcctagctgtactttatgcttgttaaaatgtatgtgttaaaattagaatggcttgttggaatgtgtaagattgcgtatagtgtttcatgttttatcactgtgttgagtttacaaagttacttgatgttatttcttttttcttttttgaggcagggtctcacgctttcgcccaggctggagtacgagtggtgcactcacgggttactgcagcctcaacctcctgggctcaggtgatcctcccgcctcggcctcccgagtacctgggactactggcatgcactaccacgcctggctaatctttgtattttttgtaaatatgaggtttcaccatgttgttcaggctggtctcaaattcctgggctcaagtgatcctcccaccttggcccccaaagttctgggattacaggagtgagccaccatgcctggcccatcgtttcatttgatccttgcaacaccctatgagaatatttagatagaacgatttcacagataatccatagtgatactcagctaacgggtggtactgccaagacttgaacccaccattcttgtaacttccttgatatctctaattatggttttggtctgccagtttgttatggagcagaaaagaagatgtaagctttctggaggtagtagctgctacaggcatacactatattatctcagcaatagcaagtccaagtaggactgattcagtatacacaaagaagtattagttgctaaaatattgaaataactttcattctggttggtgcacgttgagtatcccaaatatgaacaaccaaaatctgaaatgctccaaagctggaaactttttgagtgtttttgagtgcctgccaacatgacatgcaagagaaacattcattggagcatttcggattttggatttttagatttgggatgctcagtaagtattaatgcaaatattccaaaatccccgccccccgccccccgccaaaaaaaaccaaaaacccaaaacacttgtagtcccaagcatttcagaaaaatgatactcaacctgtaaatagctttgccccaaacccccctgagtttctttctctacttccctggccagttttcacataggaacccccctaatcgccacgtatttcccccccacaacccagcaataaaggggaaatgccctcataagcgaggagcccctggattgtagctcccgtgctatggccaccatctgtgctcgctaattggttcccaagccatactggtccctaaatattcttaaatctgtaagtgcaggaatggagtattaaacaatgtaagcgtttaggcatataacttgatttctgtaggttttgtttgttttgttttgttttgagagagagtcttgctgtcacccaggctggagtgcagtggcgggctcttggcttactgcaacctctgcctctcaggttcaagtgattctgctgtctcagcctcccaagtagctgggactacaggcgcccaccaccatgcctggctaatttttttgtatttttagtagagacagggttttgctatgttggccaggctggtttgaacttctgacctcaagcgactgcccgcctcagcctcccaaactgctgagattacaggcatgagccactgtgcccggctggtatttatactttgtaaattgcctttgttgttcttagtatcctatttctaaatctgttgtctttttcttttctttttttttttttaacaaaaaaaaaaaaaggccgggcgcggtggctcacgcctgtaatcccagcactttgggagaccgaggcgggcagatcacgaggtcaggagatcgagaccatcctggctaacacggtgaaaccccgtctctacaaaaaatacaaaaaattagccgggcatggtggtgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtagctggtctgaggtgttgggacccaggacttgctctcttattgctccaccactggagcctcaacctcaaactcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtcttttactatgggaaagaggagaactgatgttgggtgacagccagcactctctggcagagctactaagcctgttgtttcatttatctcatttagaaaataaactgtgaccatattaatttccttttcaaagcattgaaaaatttgtatttcctaaactattggagtagtaaaatgggtatggtgacccaccaggtgtgagctcattaagtctatcttttctcttcttgttttttatttaaaatattttattgaaaaatgatggaatttaaagtcgctttttcctttgcagatgaactatttgataacaggttttaagacatgaatcttattttttgagttaacactgataatatttatgcttggtacacttgaaatagaaaaacctgcttggtcacaacatgctagaatttaaaattattaaaagtgatgaattaatgataaaactttattcccataacagaaatttactaagcatctactatgtgccgagcactgtgcaaaggtcagggatggaaatggtgagctcacaatccaagtgtgtacagtttcctagacttggtttcttgaaaggaaaactcactagagattggactccaaatcacaaatgtcatttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttattgtggctctttaagagatgtcttagtggtatgaattgcttggtcagctgaaaacttttcacctaatttaattttatttttaatttttttgagacagagtctcactctgttgcccaggctggagtgcagtggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcctgacctcaagtgatctccctgcctgagcctcccaaagtgctgggattataggtgtgaggcaccacgcctagccaaattttatttttatttttatttatttattttttattttgtgagatggagtctcactctgtcgtccagactggagtgcagtggtgtgatctccgcctcccaggttcaagctattctcatgcctcagcctcccaagtagctgggattgcaggcgtccaccactatgcccagctaatttttgtatttttagtagagacgaggttttaccatgttgactaggctggcctcgaactcctgatctcaagtgattcgcccatctcagcctaccaaagtgctacgattacaggtgtgagtcaccacacccagccccaattttattttaaaatgagctagttatatatttatttctgtacttacaaatttctgttgaagtggaattcttgatcattttaaatgcaggccagttgcttttgtgatttttatgttgttgctaatgttattcttttttccttgaggttattgaaattcttatgttgggaggtaagaagcaagtgttggtggaccaaggtcacaccaaaaatagatcctagggatagaaccagaattccagaattcttttcctgtctcctcctccattttcctgatctgaccgctcttattagcatattccctttaaatagttgaaattgagggttgtgatttcacattttttcccccggtacgtggtaaagactttgagctgaaggagttgaaagttgtggatgttaaaaacacgttctgctttggatgttcctttactgcatgagctcccttgctcttaatgagacacacccatagtaaagtccagacactcagtctggacttaactgagtcaggttaagaactagaacccctcaggcgcaaatgtcacatgagcatcatattcactagaaaatgggtttagttctagcatgctctttcaaggaggcaggaaagaaggcatcttgtgaaattttgggaaggccaggataaaattgctggtcttgtgctccagttaaaggtaacaggtattctttgcctttaattttgcctttagcacagatctcaaagtacttaatagacgttaattataactgaccatgctcttgtaatagattttttttaatgagtaaactggggtgtagtgatgtcatcaaatcaagcagaaaggagactcttggagtagtggtttagagcaagatctgggagcccaggagtgctaggcacaactcctggtttgtcacttaccagctgtgtgaccttggacaagttacttgtcttctcaatttgtgtccacatttgtaaaatgggtaatggcaatagtgtctcttatattattgtctcttatagtgtctcatgttattaggcagagtacctaatatgagagcataggagatgatagctgttggggcattattaataatagcttgtttgcctcctttgaaagtaggctatgtttgtgatttcttagaaggttattagaaatctagtcttttgaatgtggagttgtagtttatagtcaaaagagagcctcagccttttaaccaactttctgtgtaaacatgaaaattccgggctggatttgttccactgtgaattttagctcacacttgcccaactggattatccagtaagtataatttaaaaatagggtttggtttttcttctccaaacacccttaaggttacaaaaaaaagcaggatctgcttcctgccctcaaggagtttatagcctagtaaagtgaaattgggagaagtacttgcccttggagatgatgaaacttgagttaggggtcttgaaggcaaaatcgtaggtaaggcctggagctggagcttggtaattgacagtgtttatggggttgggggcaaggtggcaggaaaatgtgagcacaggcgtcaaagtccttgtgtgcctgggaagtgaaaggaggaggggcagctcctggtggatggccagggtgtggctagatggaggaggagggctcccaattgtggtgggaagaatgctgcacagtgggaagggcatctgctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggacagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccatgggccttgtagaatgtggcaggaattcaaatttcattccattgcccatcggaacccactggagggctgtaagcagaggaatgatgtgatatgacctgagatgtgcaaagaacagcagttgcaaagaacagatgtggaggacgggctcgggtggaacaagagtagaagcaaaccagttagaatgatactatagttgttcaggtatgatgtgatggtgactcaggcctttgttttaggagtttgcaggagctcagagcagacagtgaaagtggccaccttgaagcaaaacacaaatgaaagggttgatcacaaactggattaaagttggcagtgagaatactggaaaggaactactgagaagtggtcagagtaaaatgtggaggtagagcctgtagactttactgatgcattggacgtgggatataagggcaagtgaagaatcaatgatgacttctaggtttctggcctgagcacctgggtagatggtgtacatttagtaagatagagaagggggccgggcatggtgcctcaagcctgtaatcccagcactttgggaggctgaggcaggtggatcacttgaagccaggagtttgagaccagcctggccaacatggcggaaccccatttctactaaatatatatatattttgtatgtatgtgtatatatatataaaatatatatataatttatgtatttatataatatacaaatatatttatatatttatatacaaatatatatttatattatatataaattatataaatttaaataaatataaatatatttatcttgtatatataaatatattttgtgtgtgtgtatatatatacacacacaaaaattagctggacgtgggggcacattcctgtaattccagcttcttgggaggctgaggcatgagaatcacttcaacctgggaggcggagggtgccgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctggtgtggtggtgggcacctgtaatcccagctactcgggaggctgaggcaggagaatcacttgatcccaggaggcagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgagagcgcagctagagatgaggaaaaggtctaagagctggtggaagagaggagcaaccagcaaacttgaggagaaactggcaagtatcgactgacttgtacatccatctaccttgctgtcgtgatcgacccttatgtttgtgttttgcctgaaggtggccactttcactgtctgctgcgagctcctgcaaactcctaataatccgagggacagaggggagtggtggtgtactgttctagtatctacttttatgattcaaaaacctgttctttttgaaatcacatggtacttaaagatatttatattatcttctctatcgtcttttcctcccttcatttttactttggtaattttacctattaagattgtgaaggaacttgacattttagggatttcttgtagatgttgtaatgaaatatggttttggaatttgatttagaaagaggtggaatgtagtccgttttctttctccggcttccctcaaccttccagttctttataggtggttcattgctttgactaccagaggccttaaatgcaggttgcgtagttgaccatgcgacctgtgaggctccctttgaacctttgtccctatttctgtaaaattaggagctcaaatgagatcaaggtgggcttccttgatttcttccagggaacagggactggtgggagtcagtggcagcaagtcttgtctaaaggtgtgagcagcaacaaagcaacacacgaggcaggaaaggactaggcttcattaatggaggtgatgcttcagctgagatatagaggggattgggggctgggcacgtgctttttggagaatgggcagcatttgcacagtgtgggagtgcgaacaaagagcctggtggaccagctccaggtggtgaccccatcaataggaatagggtgattctcctgcattttctcatctataagtagccatgtggggaatccaaaaaccagttaccaacattcaaaattgctagtgctgttagttctgcaagtataaaattagaaacaaagttcaagcttcgtctgccaagttgaagtttcctaagtgttctctcaaaacccatattaatggactcattttggcgtttgtaaccgggtaagttacagataagggcatctgcattaactggagttgccttttgaaactcctcagccctagctttggtttctcaaatgtggtgtgggtatttggagtaaactgctgtaaggctaagctgttagtaagcatttgattttgagagccctctttcctttgcagctcttataaatggattactcagtaggaattgctggaaattagaatcactgcctcctttaataagtctagttaaggcagggaggtgggccccgtcacagcatagggcagagcagtcacttagcaaggagctcaggaaatgtttgctgaatgaaagagtggagagtgaaaggtcgtgttctcaacctggcagctggcatttctacatcacttttactcagagatttgcagacaaaactttttgtttaaaacaatgctatgttaattataatctaactgttacacaatttttttttttttaaatcacagtacagggctgggcgcagtggctcatacctgtaatcccagcacttccggaggccgaggcaggaggatcgcttaagctcaggagttcgagaccagcctgagcaacactgtagaaccccgtctctactaaaaatacaaaatattagccaggtgtggtgacacacacctgtagtcccagctacttgggctgaggtgggaggattgcttgagcccaggaggtggttgcagtgagccatgattacgcactgccctccagcctgggcaacagagcaaaaccctgtctcagaaagaaaatcacagtatacatggaatacaaaggttttttgtgtttgtttttaagaactagagccttcgaaggagcatgtggcttactggtattgggctgaaggatgattgcatggggcccatctggataatccaagatactttcctgggcaggggcattgacagggatattccctactttcttccacctttagaggatttactttagaaatggtttaaggtttctcaaagttttaagtctgctgtgttggaattattaatactggagtttgtcttttaattgtgtaaattacctggcttgttcattacaaataaccattggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcggtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactgtgcaaaggtcctgagccaggagagtggtggtggttggaggggtgtgaaagaagcccactgcagttcaaagagtagagagtgatggagagggttaacccagaatgtgccctttggaaatacctaacctgaaatacttttacctaagccattgttaggatctgagttcttggtgtctgagcacaactgaatgtgaataagaggctgtttggatttcctgctgtggatggcaggatgctattcacaaagaagcctatgtcctgaccctccagacctgctgctacattaggttaaatggcaaaggggcattaggttgcagaaggaatcaacgttgcttatcaactgatgttaaaatcagggaagtatcctggattatccaaatgggcccagtggttcttgtaatgtggaagagggagacttgaagatgctcgcccgctggctttacagatgaaagaaggaaccatgagtcagggaaagttttcctgttgggcactaggcttagtacctgagtgacgaaataatctgtacagcaaaccccggtgacacgagttgtgctgcataacaaacctgcatgtgtacccccaaaccaaaaataaaagttaaaaaaaagctggaaagggcaaggaaacagatcctcccctacaacctttaggaaggaatgcagccaagtgagacctgggttggcctgtggccctaaggaactgtgagatagtaagataagatgaaggctattataataactgtgttttaagccactaagtttgcggccatttgttaaagcagcaatagaaaacatcctgcctacccaactcaacgtctcattgcataggtgggtgttaccaccaagtcacttggcagtgacgacctctggtgcctgctttgctgctcacagagcagtggagagtggctcttactaataatgcctccaggtaaatattgctcagtaaatacttactgagggcctgccacgtgccagaccttgctctcaaagcttgggataactgctgggtgaaaatggtaagatgtgtgccctcaccaagtttcattctagatgcctctcagccctgccccatggagaagggccagcaagagtgtgaatttcacatccagacaccaaccctgactgcagctgctgctaaatagttgtgaacagcagtgacttttccctgaaaaagaagtcccttccttatcttaactacttgtaggaaaacatatatatactgaaatagtttccttccaggttattctgaagtgattctttgggactgataaaatgggacaaactgaatacaataatagttgctgaagcctagctcattactgctggatagaacctgttgtgagtacagagttctcagatgtctttttagatctccaaatcagtcaccaaaataaggaaaatagttttttttataacttaaagtacacacacaccaacatgcatataggctagaaagcctgatatgaggtgttagtctggtagattgacttcttgtttaaagggagaagagtttacagaggcagaggcacagggtttggataaacgcacaaacaagctttaacgcctcctctgcttttcttcaccaggtggggaaggcagggaagtggggggacccttaactaaagagaggagagtaaagactaagcagtcgaggcaggccaccaggtttgctgagggcagccaggaagtggtagagggtgtggacattccctgttaatcactggcccttagagagcaggcacttccccctgcagccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcctgtgaaaccataccagggccagatgcagctgcactgttgagatttgaagtgtggtgctgttgaattcaagctgctgcatcagtcaggtttctttgccagctttctatccgagcctggggtgaccatatcattcatcttccaaactaggacacgtttaatgaaagggagtggagtgaatgttcaatctttagacaacaggtatgatccaggactgtcctggggaaacctggacatatggccagcctagctaaggctagaagcgttaaccattccattggatggtctgatgacccaaaatggctaagtacaacatagcctgtgtgtggaagggcctcagcacccccaggaagagagggattgtcccaggtgcccttgctagcatatgtctgtgcccatagcatagacagctctctgatgtaggggtctagaataggtgttttctttataatccaaatacaaagcaatatttatttttaccccaaaattattctccttgtatttgaacattacaaaattgttctcttatgagagctgcccttctgactactttattttggaatgacacagtcatctgttctaaacaccttggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaccttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattatttttaaatgaatgtttagtatgtgtgattttaaatgtttgtataaatttaaacgatcaaatgtcagttgactttcatctgcgttcataaagcttaaatatatatgttagccaaaaaaaagtttggaatgtttttccccgttatattcatttatttaggcatacatagtatgtgaggagtggtagtcatgataagagagacgttgtggtaacagctggggaaaggcatcccccttcaaactgggggggaagctaggctgggatgaaaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggcgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaactacaagaaacagataatccaggaacacaaagaactgtaggaaaacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacggatgtggcttacttgaagaattttgaaataaccttgtgttcatagcatgatagtgagtcctgagtctctgtgcccagagctctgattagactccaaagacctgaatttatatcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatatgggaatagacctctcaggctctgctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcatttaagggccttggagggaaagggaagaaagctggaatttgagcataaattggattttgtgtgggctgagggtcctcctaggtgtagactgtccctcctggacctgtacccactctgctagctcaggagccaaccatgtcctgaacagcttagaccagcacccagaccctaaatgacctagattaggaagtagataggttgttctctgctgtcattgtttggacacagctctatttaccttatttattgttcctgctaggcacagcctcagctaatgggctgtgatctcctgcctttaaggctggttccaggcgaattaagagcctttgcttgtttcccaaaccagggagggcagctttaccttgaggatgaaggcgcctccagttgctgaatgtggttggggttactgtgttctctcatcaaggtgtagctttaccttacctttcggtgatgggttctgccaccttatcgcggtgggtcccaggagaccgggcgcaactggagcaggggcgccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccgcatgtaagacacgaggacctcttctgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggtctctgacccttcgtcctttagcgctgctgaccaggctgctgatcctcgaccccttcttgtcacccattgtgtccctcttctcccttttctctggctccttcccttgcagcctttgcatatgctgtgttccttacctggccacctccagtcccgctgtcatctcttagtgacatcctcccttcctctccagcaggtgctggtgcccacagcactctgtaccatcctctcattgcctctagctccctgtggtttcatgacctcatgacctgttcacggatcaggcttccccaggccagagattgaggagtgggggcaattccttattcatcctaggaggctcttaatcagcgtttgttgagtgaataggtgaacgaatgtgggaatgggataaacaggaaataagccctgtgcctgccttaggtaacttagtagccaccttgggtgtgggtgagaagaggaagtggttaggaagacacacagttaagacaatgggactcctgtgctgctttttctaggcttctctttgctggtggttacctttacaggaaatctcttacccagccttcactccacccaactgcaataatgcttttcttccttcccctctacttggctctattatcttaacttttatcagcatacagaacagttttggttgtgatgttttatttgtgtaagttttgccctttcaactaggttgtaaacttgaaatcctgggttttacttcctaagcagctttgtaaagaaatggagacaacattgcaccaagataatttttgtcatggccacccactagctgtgagatcttgggggatgagtaattaagctcctcaaggcctctgtttctttatctgtaaaactggaggactggtctctctcaggggcttccagtgtgaaagtcctggggttctgggcctctgatcctggcaccccacttatcccttccagcaccctccacatgactccacctctgacatctgccaagtacagtaatttaacacattcaccttatagtctaggcagttcacctcccaggtacttgtttgttggcattcctgggatcggggacatcactggaataggagtggagcagacctgtggggacccttgtggccccggccttgcctctgtcctctgtcaagaaggttcaggcaccaaggacactgctccagttcctaatttaaaagtctgtgtgtcagttctgtaccttggtgtgtgctgttttgttccttcaaatgtagggtgggtttggaggtgggggctgactgtgactgtccagggatctgggaggaaggacagtgctggggctatgtgttatccatgagccacccctccttctctgtctgggcatcatctggcccccctccctgctttccaggtacacttgcctccggtggcacctgctgcatgatattggtttaaaaaaaatatgttgaatcctttattggaatgattcctttattgggacccaacaggcatgaaggtaatagagactatttggtttgtattttcatttgttttgcttttgcttctgagatttgtgggtttcttgatggccaggagtggcttgttttctgttgtaagaatttgttgtttgtacaggttcgtgttcccagtccttttcctcagctccagccttgtttccaaaactctcagctcttggtttatctctgtccagtcaggtgtgtgttctttgtctttgtttcttgtcctagttgttccatgagtcagccaggcctcaaagattgtaaacctgatggtgagtaaaggtgttagcaaaagagacctagcaacaaggtcattggatctctaaagagcctgtcaagctgtgagatggtgaaattttaaggactgtggatttggactgggggcctccttataggagataaaaacactcggctggggagaagaaggaatattacagtgcctagtacataagtggagctacaccagttgtccctgaatcctttgtgggagactgataggatgagagaggacgaactcttgtaatgtgacaaaagtgcaaggaagtaagaactgacttggaagaacaaacatcaacttgtacacctcaaatatatctgctttttatttgtccattctaccctaataaaactggagggaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctttgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctagtgatgtgttgaggttctgcaggaggttgtggaaaaactcatttcatagcaatgaagagaatgaatgagcgtatcttgtattcatcagccaaaagttctcacatgctgttaaaatatttgggagaaagacagttttaaatatcagacccctttggaatgagagctggctaacagagataaagttttccctcctgtctcagatagagacttgttttgttaagggctctggataggtagaagataccatgaggtaggcatgttgacatccagtgtacctggcttcttgtaggttgagcagagcaattagtgtactgagaagctctagccaaacctcgtttgatatgttcggtctaagtagatttgcagattcgtgtctatgttcttctcttgcttcttcatcttttagaaataacatttgttggccaggcggcggtggctcacacctgtaatcctagcattttgggaggccgagttgggtggatcatttgaggtcaggagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaaaaacccactggcaatctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcctatactgttggactgctggttatgtgccagcaccaggcttacagcaggggacagcagggagcatacattctagcgaacttactgctttaaagcaggaatggatgtcaaaaagaaatcagactgggcgtggtggctcatgcctgtaatctcaatactttgtgaggccaaggcgggcggatcacctgaggtcaggggtttgagaccagcctgaccaatatgatgaaaccccatctctactaaaaatacaaaaattagctgggcgtagtggcatgcgcctgtaatcccagctacttgggagactgagacaggagaatcgcttgaacctgggaggtggaggttgcaagagcaaaactccatctcaaaaaaaagaaaaaaaaagaagaagtaatcacgtaatcaaagccttatttctcctgtgattcctgatatacttagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggattgggctagatggtcatggtaaggccttcctggttggaatatgatctttttgtctccttcaaaatctggttgctgtaacgaaatttatacagaattttgagaaaaaaaatttagtgaacattgagttttgatatttaaggaatgacatttatggaaaattgatttgatactgtatttttaggctgtgtttacatggaggttagccattcataccctgtagaaattatagagattatttctgtctcttctggccttgtaattctctctgccttttaaaagtaggcatattttgggaaataatctcagagctcagggtgtaagttaggactgattacaaggaaatagtgtggggaaaaggaaatgtctttgttttagctgtgtttgtttgatccctatgaaaacaggtccatgatttctctcctctagaacataattacccactttcacactgatgttctgaaggtttatacagccactaaaagccaatttgaattaagaaaatgaaataaggtgtttctctttgtttatgtgacaggtaaatttacaaataaattgcctatggatacagattgtcattcaattttggattggaggattattctgagtgagaataaggcacattctagtttctatatgtcttcataatggtctccttagtgccactttggggaatatttgctggtctgggatccggtcccaagatgaggacatgcttaatcatcctctttagaattaacctctgtattgaccattttattcatatgtaattttttaaaaacaaggtttatagacaagaatgggctactttcttccatctgcttgcagacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggtatgacctttgtatttatagaaatagagattagttcccctaatttctgtaatatgatttagtacattttgagctaaaatgtgttagaagacattcgtatattataaaagttgggtaggatattaaaaatctctaaatgatatgatttttaaaagctaataatagtggaatatatgttttggtgttgacattcttttcccctctaccagtactttactttaattcaggtagttaacttttttttagcaggaatataataattaacattagtattttttgctgttttagatttgtgcgactcatgaagctggaagtgttaattttaagttagtgatctgaaaacttaggaggattaaataatggtatatacaaataacagtgtattaacatggacattaataacagagtattaatatggacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgtatattttaattcatggaaaatatggtttacctgctttataaacctgacctaaaatgtcgccatttaaagccatatagtgatttgggcttactatatgaaatcttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaatttacacaaatgtattttacaaccataaaagtcatctctgtccttcctttttttcctccaaattttttttcctgtaactagtgatagcatgggggatgtttattaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaaactccctcgcagggcctatggcccctggacttctaggctgagaagaggccaggtggggccgggccacttttgctggaatttgataagcttggtgatctagaggcgttaaaccgactgatgcctgggatcctttccttctgactggggctccctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaacaataattactgtgcatttcttggaaaaaatgtaaaaaaaagtctaaacccaaatagtaacctgtttaaaaaaaaaaaaaaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctgtaatcccaacacttcgggaggctgaggcaggcggattacttgaggccaggagttcaagaccagcctggccaatgcagcaaaaccccttctctactaaaaatacaaaaatattagccaggcgtggtggtacacatctgtagtcccagctactcaggagcctgaggtaggagaatcatttgagcctgggaggttgaggttgcagtaagctgtgattgcagcactgccctccagtctgggcaacagagcaggaccttacctcagaatgtttcatttagggattacttatgattaaaatacttgattgtaattgcactggccaagaaaccaatactttggtctttaagatggatggctgtggattttataaatttacttgctgtcagaacatttgaaaatatgaagcattttttctcaaacacatttgccacttttagaatggatttcctcaaaagtgaatgcctgagaaagaaatcaaattcatattgttacattcggtttgtctgtactgtgtggaatctgtcacttcaaaagatcagagggtttgggggaacaaaacgatcctgcttgaggttttggaagctggcaatgagagcagcttgccggatgcagtggtggcctcctcatccagcgagaacagcagtggctgtcctgcctcttaccaagcataattactttttcttcaatttcttccgtcccgtgcatgcgtacaggcctgctgtttttgaccagcgtttcctatacagatcctgatcagtttgtttataaaacacggcctccccgggagcagcctgacacattccctgatgtgatgatgaatagctacctaggtttgtgacctctgcgacgacaaataaattgtcttggttgtggtcattaaatttttttttttgatccatacagagcataaatctttttatgccctattttgtttccattgaagcacacacaaaaagcatgccatggctggggctctgtggccagatggttgtaagagctggactccatattgccctctaatctggtggctcatgtttttcaattcacttcacaatttgagaactgcaacggtagtggtgaagcttttcataagtaaaacccaataaagggggtgagcttatattattctgcatctgcctcacctttctatagaaacatttacttaatttgaatggttttgatatgggcacttctatttgcttttcaccagatctgttatttgtaatctgacatcctacctgatgctttataatgggtgtgtcctaatgttttctgccctctgaacaagtatataactgataccaatgacaacttcctcacctctgttgtttatactaggttctcaaataccatgtatcatcagtcattgttttgtctgcatgtttgtgtctgagaactaagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaatagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtgagaaagcctcaggttatattatgctgcaaatcatttctgctttgactagcttctatacgactggagaagagccgtcctttcaggttcattgacgtaaagaatatttttattgccgcatttttaccagcctatctttatcatttctatgatggcagcagacagacattcatatccctccccagcgtataggattatatttttgattttcagtttttacttatatgttgggatcatgagtctatgagaattaaaatttgaaaaaaattgactcagaaaacacttgcatgattctgttctgtggtttcatatggggctgatggagcatcagctcccgttgaaaacaggaattggtgataaagtaaaaaacagatatgtggctgttggtgccagttgggggggttagaacagtgaggtcttaatgggagtcctgctgtactatggttctaactcgagaaattggctttgagttcttacccttagtatttttcttggggcgtttattataggctaccttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgcttgaacccgggaggcagtggttgcggtgagccaagattgcgccattgcactccagcctgggcaacaggagcgaaactccatctcaaaaaaaacaaaaaaaaaccccgaaaaagccaaacaaataaataatagtgcttgtgtcatcttactttaaaacattttactagagtgtttctaaagcgtttgttaaaatgttaaaatgtgatgttgtcaacagatattgcagttggagctccgtatgatgacttgggaaaggtttttatctatcatggatctgcaaatggaataaataccaaaccaacacaggtaaccaaataaccgggatttctacagctagagtctcaactttttgccctataataaaatatttaggtttaagtgacttttcacacaaatcttattttatttacaagtccacaatagtataaattttttaaaaatgtattactagaagataccttcaaaataaatatataaatgtaatgacttgcttgttctaattgtaaaatttcttagataagttaggaatcaaggtaatccaaagcaaatgaatgttattctaccctgacggcattaagataagaggaaatacgatatattctctttagtagcatactaaatagagatgaaattggtcaaacaaaataaatgactgtaactacatggagaatgtagacaccaaaaattaaaaatgtcttttgagaaaaataagacttgtagggaaggtagggagatttggtttgaaatggcctgattgacttaatacaataaacaagctcatcagaaatgggctcttttctgctttgagatactatgtaaatcggatgacttttatgaaatgaaatgtatgaagtgttagatcatatagaaatttatgacttgtatataatataatttacttataagtgaactctcaaatttcagttcaaaagaaacttgtgtgtctttttcaaagcattgttaagaagctcatggtgataacctaatgtccattcggatgccctgtgtatttcaggttctcaagggtatatcaccttattttggatattcaattgctggaaacatggaccttgatcgaaattcctaccctgatgttgctgttggttccctctcagattcagtaactattttcaggtctgttatctatgattttagtgttaagcatgttctataatcaggttatactaaaatgttgaccttttggactgaaatttgtcatacctatacttcaaaggtttatatgaattgtgaagctatttctttttcttttgaagttagtaaacaatgtaataacaacctattttctaaaatcttttaaagtatctgaggaaaacatagatccaagttagaatttttacttcatatatttttaaaaccttaattttgatgatgaaaaaaacaaaacacatataaaatgtgacagtacaaagaacatacagaaggaaaccccctataattcaccatgcattattaaactccaagatcttgatttctattttattttctgtgattggaccatgtatatttaacaaaattaagaccataattgtgcataattttgtaacctgcttttgtctctttaggatacatagtagacttttcctatgtcactgagtacttttccaaaatgaagttaacaactgtctgtgaggcatcttctgacaggttcagagcttatttaaccaactgccttgctctcactggatggttacgttgcttcgcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacgttattcccatcttccacaaaacttgtgtgcatttctctacttttagggtatcatcaaaaggctacactgtaacttctgctgtctaatctggtttttatttaatcttgggctatctctccttgtcaatacaatagatgacttaactttagtcagttaaatgtttgcccctgtctatgtgtaactgatattttaatatccttactttcctgtcctcataagtaggttgactgtcaaccctgtacacttgttccctctttacttgcagatagtgtgaaagtagaattcaacaaccctttgataagaagaggagtaacttccccttattttacaaatgaggaaactgaggcccaggacttggcttgagcttttaaggctggagcctgagaggacagaatgtagcacctaaatcttcctgacttgaatcctgtgcattttttctactaaattgtactagcacttcagggtagttagtaaataaacaccaattttaaacatgaggcagccaaactaataagacttattttctatgttaaaagacacagttttcataattcatgtatattttgccctcaaaattgtgtgttgtatgtttaaaaaacaaaatatgttctaggcagaaatgtcttaaaattctacagtatgtaaaatactatatctgtggcaactgtgccttttaaatatgctctcaaaacttaagaatgtatctagttagtatcttagaacctagcagctgtctaaatgtaaaataaaaatagaatggtaaacaataaaggaaaatggaaaaacagggaatgtgggcagtatttgaccctttattggaccctaccttcactgtgaatggacttgtgctctagcctaccaacagattgattccagaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacgaaaagatgttttcagatggtgaaccagagtagggcgtggaattggattccagcttctcaagtgtttgcggggttgcagtaggcagcgcagagatgggaagaagtttaaaagtttaagtttttgcttgcagagatatcgtgggggtagaaaagttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcacagatgatgtttgtgaaagcagaaagctcaacaacgtgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtgggaatggagacaaaatatttactttaacccccacatgttgcacatgtactcataagtgtgtacgtttttaaacaaatattgtataatgaggctctgcattgtatacatttatatctattaacagttattttcttcagcaatgggggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcatccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttcaatatgtaagtacctagtacctttaaaatatgtctactttctgtctgccaggttgaaagttctgcataaatcacagaaaaataaaactgcagtggccaacatgggtctgtcaattctggtgtaaagaattaagtgtatgttttgtctcccttttaatcaggagggcacagcaccgtgagggaggaaaaaaactccacttggtcgccatttgagttttccagagcagatggtttaggacagaatggcttggaaaagtacttatttgctaccacaaccatttcctccatttctgtctttgaaaagcagtgtggaaaattgattttgtggttgtgaggtggtgggtggtggctggtggttgtgaggtggtgggtggtggctggtggttgtgaaagggcaacggcaggagccagagcacagcacagagtcactgccaggctgccttctcttccccacgcccctccctcccggaacacccgccctgtgttcccaagagcaggcccctagggaatttgcaggccggccctgagaggtcagagacctggtctctgctcctggtttcagctttgatactgactgacccacagggcaagtcccttaacatatgagtttgctttcctgtccgttcagaacaatgcctagtagtcattagtgcatacagttgtgctggagatcaactgagaagacatgaaaagcactttgtcatttattagatactgttctgcttcctttttttgtaattcaaagtaagatttttttaaatttttgtggatacatagtaggtgtatatatttatggggcaacacaggatttttgacaagaattttgacaccgttaatgatactcttaacaatagtggccgtcgtaagctctcctctggcatgttttaatagcagccacacttcttcagctgtgagtcacctgacccctggctccagagtcaaggccaggggcataggaattccaagaaaatcttttctgcaaagaggaagtgaaaagaatgaggaaattctcaacccgggtccggccatggtcctggcagtttgggattctagtgtactgtatctgccaccaagggacactttgtgaagaacaaggtcattctgtcctttcatatggttgtcagcctttacgatactatgaggtaatgagtcctctgaagtgttctccctgttatctaaagtagtagttttctttatttaaaaagatgtcccttataatattccagaatataacctaattcaaataacctaaagttgttgcttgaaacaggaaaaaatagccacataaggactagggtttgcaatggtgaatcctctcacacgtcacagctctgttcttagctgtactctaattcttctttaactttatatgaagttttatataacactaatgaatgtatccactaagacaacagaatgaagatactgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactccttgacttcccccaaattaatcacctatataaaatacagactttctcctagctgtagcacagcatttgatgccatgtgtattacttttatgttatgtagctactccattaaccaagtgtttatggatggccttttatgggtggaactttcctttgaagacattcaaagaacatttgctttcattgcttttacttccacagtaaattctaaatgaactaagacagaacttctacaaagctacataagttaatacatctaaaatcttctcccagtagccaagaatgtgagcttattgtttgactgggctattttagctcagcagtcctcagatgtggtgttccatacatatagatatctataattgagccgtaatgagtgttctacttggcttgcccctcaagcagttagcaaaggtggcctgcaaagattttaagatgatgtggactgtctggagggttagggaaggttagagtgaatttggcagataaacggttttcctgcacccacacctcccatacttttgctgtgaggggcacttttgctgtgaggggcactcagcgtgtgagcctttatctggttcattgtgaagctagcaggtcacttataaatggatgatgtcaaggctgcagaggcctaaaatgggggagcattccatttggcagctgtgacatttaagaattctccagatggacacaaaaattactattgaaactgtcagtgtttctaaattttgttctgaatagctcacattcagcataagaatgtcacatcgtgtgtgtgcgcatgtgtgtgcaagtggggaaccagttactgccacttctgttcatctgttccataaatcatatgtctatcaggtgttgtgctagttgctggggactgtggtggggaataagactgatgtgatccttgtcctcggctttgccccactgtgggagacaatcaggaaatcacagcgtagtgggcttaaatgtagagactggagagatggaatactctaggatcgcgaagagaggccaggacaggcttcctggaggaggtgaggtccaagctgaaatctgaaggggaagggagggcttagccaagcaggccaacactgctgggaggtggaagggaaaagaagggaaagacagctggctgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagtaatttaagtattggcccatgaaaaacaaagttagcagccacatctaatgaaccaacaaagaatgcgttctgaagtaaaaaaatgagattctgatcatccacatcctagcttccctccaggttccattagtgtaggttatcaagaacaggctgtgccttctagcccagtgcaaggtaggcagtttggttgtgggagctatattatgctgaccgacaggccctccatccactcaaaaatatataatttaccttgtaattcttttttatctttattattatttttttgagaaagttttgctcttgttgcccaggctggagtgcaatggcatgaattcagctcactgtaacctctgcctcctgggttcaagcgattctcctgcctcagcctcccgagtagctgggattacaggcatgcgccaccaagcccagctaatttttgtatttttagtagagacaggatttcaccatgttggtcaggctggtctcaaactcctgatttcgggtgatccacccaccttggcctcccagagtgctgggatgccaggcagaattcactgtgcccatcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgggcctgaggttctgcatcctcacaggccctcaggagatgctgctgttctagagatctttcccagatagcaaaggcacgaggccacttgaataagcattgactggtttaaagggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaaaggaaggaaaagacagcttgatttgaaccatcacaattgtgcaaatgcatattaccaggaaatatgaagagaaacaatggcaatgttttctacaaggaattaaaatcttaaaaggagttcaacatgcttgtggctggattgtgcatgaatgcacttacgttaatatgattttaattttatctagcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggtgagggctgcagatggtcacatctgttttatgaagaggacagaaaaaggttatatggtgatatacagatttctgaaatttattctggcaacctcttaatcaatacaaaatcattgttttggaattccccaatagcatgtacaccccacttaactctgactgcatgcttttcatgcaggataatatcagagataaactgcgtcccattcccataactgcctcagtggagatccaagagccaagctctcgtaggcgagtgaattcacttccagaagttcttccaattctgaattcagatgaacccaagacagctcatattgatgtaagtctctctgactttcattttgccaaagtttttttgccatttatgatgctaaatcaaatgtctttgaagggaatagaactagtgatttgctttaaaggccattcttttgtgttaatatgtttttaatgtacgcaaagttagagaagacttgtttcccaaattagcaataaacataaaaacatgaaatacaatttggggccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctgtaatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctatttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctatgaagttagaatggtggtatctccacgttacctatgatgaaacttggactctgaaaggttaagtgacttgctagctaagtaaggggtagagctgcgtttcaaacccaaatctgtgtggctgctgggtcacactcttctataccacactgcctccatgccctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcagaacaagcaatcaagataatttggctccaattacagctaaagcaaaagtggttattgaactgcttttatcggtctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattataagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaatcacagtgactctctgtcctgttgaataaacataaacatagggtacagagtctgttcgtaactcacacatgggtttaggtctgtgtggctgaaatcacattcctgaaggcatagtgaccactgtggtgaaagcctcaaatggcaagcatgggcccacctgactccggcagaatgaagaggctgaattctcctctgtgtgtctcttagcattatagacacagctggggcaggtggtggtggtggttatgatctctatgcaggtgcagctggaaaagaagtctttgggttctggaacagtctcgacaccaagagggctcttacctcctgtgtttggcttctgccgcaggacgtcactctgttcccagcttggactctcagattcatggctgtcctaataatggttttgcagaatctcctctgggacagaggcagcttcatttttgcagtggatggggttttccagaagcaggttgttggtacactgccttggcccaggacttgtcattggccaagcagggtggttacagggcagttcacaaattcacacatgattttccctgggcgtatgttgagaacatggtatatctacactgctgattctgttgcatacagcagttgttcctagaacgagttagctatcagttgtcctttgacctttttgtttttatttacaaaaatctttaggcacaagtctttattttgaatgccctatctatagtccatttttggagcctgtgcttttattataggattacgttagatattttagcttctttctcttggtaaaaggagctgctacttaaatttacattgagaagattagactgagataatatgtattattttctaacaggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggtatgtcggtagatttatctaatgtctccataaatgcaaattagagaaactaacttgttaggggaaaatcattactgttcttaggaaagtggcatattctggcaggttgactttctctttggttgtcacaatttctcttttctagttgggtaactgagggaggctgaggcatttttgctggttaatgaccattatagtacataaggcagagtcattcagtgcttgctgaggcaaatggtattttctgatgtttcatcatgacccagtatgttacataataaggagaactgggggatgctcctggggtaatagtagctgctgttatccaggggccagccagtgttcactccaagtagaaccaaactcattggaaaagataatggcatctcagcaagtaaccttgaaagctttttatgcttatttttaaaatagtaattatttattgtgtactcattgtgtctcaggaactatgctaagcattttgttttcattttctcatttcattctctggatggtcctatgagggcgtttcattatcctcaccatttcacagatgaggacattaagattcagagagcaagtaactctctcagtcactcaggcgttaagagacagattccacatacaagccctgctctgcctgatgtcaaagcctgtactgttaacccctctctctatactgctccatgcttagataactggcctatcatttgtgttccagtttgatgaaggtttgcatgtttatttcttttattttaaattctaaggtgactgggtatgatcagtgatcagagttggtggcttatagcatgatcttctactcatcaatgttaaaaatcaagataatcggttattactaatctttgctataaggaaaatgcaattttaaaagttcttgtatggcttagttttcattgctctgctctgaatgagctatataatgggtctttttgcttctttctctgttcttcagtgtcacttattccttcaagatgtgctgactaccatgttttaggaacagagctggaggctagggatacaggaataagatttgatctctgatctcagtatgcccacagtttggtggggatacagaggaacaaagaaagcatatttctctttctctgagttttaaggtcagagtgggaatgaattacttagtcctatgagtaaatcaataaacttgaatttagagtgataatacttgctggttttacacttacttctgtgcctttggcaggagagaggcaaatattgttgattatgtgaatctggcactgtttgggaggatatgctcaagaggcttgtatggtaatgacaaagaattacataaattggaactattttggatataatttttttcaggagtctcacaactcaagaaagaaacgggaaattactgaaaaacagatagatgataacagaaaattttctttatttgctgaaagaaaataccagactcttgtaagtatttttcaagagctgtgaatatttgagaggatgaggggaaggatttcttcagaacaatgtcttttgatgaccattcttctttttctctctagaactgtagcgtgaacgtgaactgtgtgaacatcagatgcccgctgcgggggctggacagcaaggcgtctcttattttgcgctcgaggttatggaacagcacatttctagaggtatgaccttggcttgaggctgtcccatggaagtaatttgcctttgcctaggacacttttcacttccctaatgcattcactgtctccaaacaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttggtgctcatttccctcatagccccattacggagaaaactgtcttaaggtactggcactgcaagctgtattttaatagaatcattgaaaaaaagaagtaaatctagggtcatccagttcagcagtgcccatggtaggtttgagaactactggctcaattcagagaatgggtgcacctcacagccctctagaaacctgtgtcttctaccatctctaatgctgcagccattggtgtaatgccccagtgatggcccatcccttggccagctgtaattattaaaaaagatctcttcatagctgactcctgaactgaaccttgtaagtccctggttatgcccctcaaacaagtctaaaataagttctctctcttggccatgtagcagcctctcaaataattgaaggaaatggtcatgcctccttggatgtttcttattcttctcagagcttatgcacccagctcttgagttatgcgtcacattgggcacagctgaactggctcctggcctctcccttcctgggcaatttgattcccacgtggacagagcagctgaggtggggtctgcttggtcccacttaccctggggcctttacctctcagcatctcggcaccacacttctgtcagacctgcctaaaatttgctttttcaaaccattgctgagcagcatgtttgaatttctagcagctgctatttttgtgttagtgttctactgaaacttccaggtgttttcatcagaatttgttgtcaagctgtgtttccagtatcctgtccttgagctatttgtaaaaatctaaatgtatgcctttaagtgtatccttacattttatgtgatttgctttgggtccattgtttcagtttgcaaagtaattctgaatcttgcttcatcatttgctttctcaactttctatccctgaaagttttaaaaactgagaagcatgttctctatgtcttcatccaggtaatgacaaatatgttgaataggactaggtgtagaaccttgtagtgaaccaatagtgaggggttccctgtgggagtctagaacccacagggacttgtataaagatctcgaggcagaatgactgcatgtcatggtgggaataatgaatgggaatgttttgcaaaagagactggagaaagaaatactgtgaattactgttcttaagttaatctgccagtctacttatggaaatgttctggcttcagtcatttagctagctgaaaattcagggagcctccctaatcattctgttttctgaaatatagcagtccttacgatttattatccaagcaagaatacatttttgtttttatttagttttttgagatggagtcttgctctgttacccaggctggagtgcagtggcgcaaacacagctcactgcagccttgaatgcctgggctcaagcaatcctcctgtctcacctcctgagtagctgggaccacaggcatgccaccacgcccagctaatttttcagtttttttgtatagccagagtctcaccatgttgcccaggctggtctttaactcctggactcaagcaatccgcctgcctcagcctcccaaaatgctgggattataggtgtgagccactgcacccagccccaggatacatttgcctgagacaaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctgcagcttactagatactttatactctatcattcaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatgtctcctcttcaagtgctgtcttcttctggaagatgatggaactctgggggccctggtgtccagtctgatgactgggtcacaaatgaaagtgaggttctcttgggcattttatgttcttagagcttggagaactcatgcctcccagtgggaattgatgtcttcacaaattggtagatttgtgaatgggttactggtctcatatctagaacccatgtcttttgaaaattgagacattttcttaacctctagtcttctgacaccttttctgttttctgtgatttctgacatacaatagctcagatgtcatatctgcacatttcttgagtagtttgagctgtagtttttctgggcttgaagatctaagcttaatttggcttaaaaaagcaaaaaaacttttttgtttctttataaccccacgaatttcaagagttttgtgttcatcttttaataaaacacagttaaactttgggaggccaaggcaggcggattgcttgagcccaggagttagagaccagcctgggtaacatagcaaaaccccatctctacaaaaaaatacagaaattagccaggtggggtggcacatgcctgtattcccagctacctgggaggctgagctgagaggatcacctcagctcaggaagtcgaggctgcagtgagccaagagtgtgccactacactccagccaggacaacagagtgaggccctgtctcaaaacaaacaataaaaaacacttctaaattaggatactattataatgaagtcagggagagcagaagtcacatgattgagccaggtaagccatgctatattttagcatcagttaaattaaatccatcttgttaataaacacccatgaaagacacatgtatgccttccctgtgctaaatgttagagatgcaaagttgggtaagatacagtgtcaactgttaagaatgtcatgctgtaggagacagaaccaggaaaacactgtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttggcagttgacaagctaatgtagtctcagcactgctcactggtaatcgaatttaatgcatcaacagagcttatatccctcttccccttatgggcacatggtggatgagtttcacaggtgtgcgtcatccccatggaaataactacattgtaatgaaaccaaaggtaagaaattatttttggagttgtaaagctctacagtagtttctactcacctgttcatcagtaacagttggtgtgacaagacagaacaaggcttggagctctgggaatcacagcccaccctttgtcttccatctttggtcacctggctctatggccagcttccccttgttctcaatcccagctggagaatgactgtcataccagaaacaaaaacaaaaaaaacaaaaacaccttcagttgacagtttaagcaaacaaccaataaagtcttcctgactggcctctcgccctccagaaccacggagcacatctgccctttaaatgtgtagccaacccagtccctgactttggttctcagtctttgatgcccagtgagttaacaatatgtggaagttctggtttgaatggtgccaggcctggggcttagagcttcagctggattcccatccaccctgccactccaggctgcaaaatcaaaaattactttgctcagttgttaacaatattggatcccaaccatttatgggggtggctttcccctactgtcagctgttttaaagacacttgtgcacagtgtcattataataaagctgattctccttgccgaagaccagtttccactctccacttccagatttactggaactttttcttacaaatgaggatggcccttccacatgaccatcttgccctgaggatacactgtacaccttccttgtgttagataatagggcaacaaagttaaacaagatacagtttaggctaattgaaatcatctatttggtttgtttcattgtagtcagcttaccaaccacgtaactattctattgcttcactggtctgtccctgtttcttcttcccttctttgtagatgtccctgtgctgaacgcagtaatctcttccctgtcaggggagggaaggagaggggaagtgagccacgaggccaccttggggctcagagcttgtagaaaacctcatttagagcataacaggaaacatggtggctgataaaggtgttttatgcctgcctgttaccatcagtataattggctaaatctcaagatgtgattgctgtctattgaatgtttaaagaaaagcagttttgctgcttttaagtattttttgtaagtcaggtgaggttgagaaactgtttcctagaagtggaaagggaagtactttgatgagagatttttttaaagaaaaacaccaccgcatagaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaatagaagagtatgacatgaatgaataactctatctcaagggggtcactatagcgtgtatcaaacataaggaaggtctaggttcaatatgatgttcctcattagaatttggccctttgactgtaaataaaatgtaatatcttcccctgattctaccagtaaagagtctacattatgaaaaactgcgtatgagatggatacaaactcttattgcccaaagattacaacctaaaaattttagattattcccagtgagtgatagaggcttacagtcccttatctgccattccaaaaagctctgaaaccttgaagtatatataatgacttatttggcaataaaacctgacgtgatgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacatagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttccaaattgttgtaattacagatgtgagccattgcacccggccttgaaaattattttgatatcaaaaactaaagttggggtttgatatttgaggatgatgttgtgttttctggaagaggtcataaggatggtctttttcagagcattggcagcctttaatgagggtgagacagcagtggatttaaagttagaaacctaagctgtatataatcttggtcaaatcattccatctccctggggcctctgtttgcctcgtctgttaaataagttgattggattattagatgatttcattattttgggagtttttgttttgtttttgtttttttgaagctctgaagtgtccaggctgtcaaggggactctaaaatacgacttatacaaccccacatgagaagcatttttattactttatacttttattcaactgaattatttaatatgttaaagtcataggattttagggtcagaactacagttcaatggcccttaaattggattttgtatatccatgtagagggcaaagctaaactaggcaggatgaagatccctacttcaaccacagtagttcagattgtatccattttaaatatcaggattctgtacaggattttgtttgcaggtgaaaaaaaaaaaagtcccttgggctggtctaaatcaccttcattttgctaacaaagatgctcatgaccagggatattaagaatgttgctggctgggcgcggtggctcctgcctgtaatcccagcactttgggaggctggtggattacagcactttgtggcaggtggatcacgacgtcaggagatggagaccatcctggctaacacggtgaaaccccgcgtctactaaatatacaaaaaattagctgggcatggtggcgggcacctgtagtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggtggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataaatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggacggcttggaatgctttttactgttgctcaggaatcgttttatgctagctaagcatgcaacttccatttcctgcatatctcctacaggtcaaagaccattacaacaaactgattatcagcatgatgggcttttatggccaacttcagaagatgatcccttaccaaagttaccttccatctacaaaattctagtacaaaaaataccctgaacagtttttattgcaatatgttgtgatggagtttgaccatatttcatgtatccagagattttatccaaccttggatctcagttgattttaaattcaagtttctcttatttggaaatacatggaaataggaattgctagtgatccctttcaccatttacgtgggcatgagaggacagaattactcctgtaatcctttccatggcactatcacagtgaatcacaacattgccattcagctttacatattacccttaatttccctctttgtttaaatggggtagacagcagtcatattttgtaatagataggtactttggcttttttttctttttttttgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttctatcaatatcctcattcttctaaactgcattttaaagttgaaaacacctttttttaaaaaaagtaaatatatttcatttaaaaatttaatctcaattcaaattttttcagatatattctcagtaaaaatatactttggatcagattgactatttaaatgaattttatatatatatataaacacacacattaacagtttaaaggtaaatgtatttttgcaaaagaagagaaattagggagtgctctgaaattcagtgtagtgatgcacttctgaagtcctatgcagcacatgatttttattgcaggaaacagttactatgtgattaatgaaatagcttaattagaagcacaatagcaaatccaggcaacataaatgacctcctggctaatgagagaagtgatatgtgtactagagcctcagaggagagaaaaagattataaagttgacctgttggaacactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaat

SEQ ID NO: 734 - DNA, 31769 bp, Human
ccattataatcttacaggatcactgttgcacatgtgtttcctcattgactgaaatgttattcagtgcatgactgtacatatattaaaaatgttatgcaccatattttaacatactgatattactaatgagttgtcctcatggtgactttaaatgtcataattaatgccatcaaccagaatatatcaaataaattcagataccacttgttctgtttatttccttcccctgccaattttttatttttcctggttctgctgaagccaagatggggtgctgtgtaagattttgtttgtgaggaaaggttctgcatgaattaaagttttgcaagccatgggcatttcattgtatgggccgttttgaggtctgtcatcttgcagattagattagcttacactgaggcacagtcacctgctgggctgggcagagagctgcactccactagtatttgagctgtcccggctgttcaccagctggatccacttcagataggcatagccagggcagccgccattcccatttgtgggggaaaagggaagctatcacaagaatgggctgcagctgtgggatgaggtgggcagcccagtgatggtgtcattgtcaaggggccattgaaatgtccttaagcagtcattggccaaatcctgtcctctatggatccagagccacagaatgttccagcagaaatatgtcttagccagcagctctttattgaggactgattgtgggctaggctctgtgctagggtctttacagatgttactaaatcttctcaataaccctatgagacaggcattattatccccatcttaccgatgagaaaactgaggcttagagaggttaagcagcttatccaagatcacagttaataagtgacaaagccagcatcggaacccatgctagtcctctctaaagccttcttagaaatcatgtgatagatgagaagatcaaggtctggagaagaaaagcaagttgtctgagatgacacaaccagctctaattggtggcaaagctgcgcctataactcacctgcgcttttcacaacctgcagtacgtgaccactgccgaaatgaagaggcaggggtgtgccccctcccaccttctgagtggctcaggcacaatcagtgttgagttggcatgaaatgagaaattaaactcaccatgccactttaagaagaacatggagaaggcaggcagaagtgaccttggagaacagtatctgagccagaaggcaggaggtcagcgggggagtcttgagtgggaaactcaagggtagcctgactgtccttgtcacaggtttagctgggcactgttagttcccccctttgtcagtttgtgggaatctgggcatcagggatctgtttcagcccttcacatttgtgtttgggtgtgctcagcttaaaacgatagcagcctgcaggagcttagctctgcctccatttatggagggaagagaaactaaggaatgccccttggggtggtgttggggagcagctacatgggaaaatgaagggtgcagcaccagtaaaaaggtgctcccaggactccctcccaccagcactcggaccaaggaagaagcatttaatttcagccagatttctagatggttgcttttatttgttttcatctgaatttgtgccaaggattcaacttttcctgcttattttattaaaaactttatacacagcattaataaatagatataaaactgccatatacatgacaaacagaggggctaaatgaaattcccaagggtcagctgttgaataagtaacaaaagcacatcttggcatgatcaaattcccatatatgcaaattagggacagtgctttaccacagagtgttttaattaatatttataaatcacagagtgcctttgaaagggccagtaagctgtttatattattatcatgtcacacaaataacaaaccctttggagattgctgcctactttgcattttggtctgagaagtaagtaagcatgttgtgtgtgtttctctccctcgtaggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggaatatgaatgccacacacccagcaccgataagcaatactttgggagttacagtgcaaagatgaacctagtgggtaaggagaagctgtcttcacgttgccagcgtctggcctgactcagttctttagtagtgtaattttgctttatgccatgcatttgactttaaaaaaaatcccaaaactcccaacatattttaggggtcaacagatagcacaaggaaactaaatttctgtgttcacttctaaataataggtggttgagggtgaaactttaaaaagatctaatgcagatgttaagaatttcataagttaactaaccctgtaactggtgaaaagggatatgaaaatataaggcaaggacgtttgtggttgatgatctgaatgacaaggaagatgagacgtatgacatcagttggaagagaggagaaacctctcggaaggataggcctttgggcagctctgagacccacggggcactgctgaagcaggaagcacatgtggctgcgggtccttgctcagaccttgtacattgaaggtcctttggctccatgcgtaaggaactatgaactggctgtctcccttgttgctccttaatgctgaaggaaacatgaggaagagggatgcaggagcttccattgtgggcagcactggtcatagtgtttgccagtgtcaaagggttaaccattatcaaggctgttctgtttttctgcctatcttaatgtccagtttttattatcacaactaagcagtgggtgttgctagttcttttattaatacacatactatcatttgtttatttttactttctctaactagtctgtgtcccagcaggagaccttttttttttcgtgtgtgtgtgtgtgtgtgtatgtgtgtatgtgtgatggagcttcgctcttgttgcccaggctggagtgcaatggtgcgatcttggctcactgcaacctccacctcccgggttcaagcaattcttctgcctcagcctcccgagtagctgggattacaggcatgcactaccatgcctggctaattttgtatttttagtagagacggggtttctccatgttggtcaggctggtctcgaactcccgacctcaggtgatccgcctccctcaccctcccaaagtgttgggattataggtgtgagccaccgcacttggccgttcccagcaggagacccgtaagacccaagccttgggtgagaacagggagaaaacacatactagttgtgactagggtactctcatcagacagaaaggtggtgctatttaatctccagaaaggtgcaagcaaggatcagggtatgattctgaccaagggatcacggagaaaatctcttctcttgcctgaatctctccagactgtggcttccttccagtgaggacccctttgatcgatgaattatgcgaaaattaaacccactaaaaatagggtatgatgattattttttctaccaaaaatggttttttaaaaaaatcatcttcctagggctgcattgctgaagtaagttacaggatggggatgtgggaaggaaagaaaggatgttgtatagaaatgtaaaactaaaagttccaggaggcatttccattacaggatcagtcagaagtgaagttaaagtatctcagagaagtgccagaatcaacagcaaatgttatttgacctataagacaattgtttaaagacagtattttcagggagtttatttattatgtaatatgaaatacaccccatgttttatccaagtgttattaaaataccagacaggtaagtgtaagcaccaaaataatgcatttccaaatccaaacagaaaactttctgtttatgtgcatttggggctgtctgtggccttgaatcgatggttcaaggatgactgttaggggcgcagtgcagtgacgcctgcgtggaatgggagcttagccctgggagtctcagattctgtggctttgtgactgcactctcaggacatttctgtgttgcagtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactggtcagtccctctgagcctcttgtcctgtcctttacttggtggtgaaggctgtcagatactgggagaatgtggagactccttctttgggcacctctaccaggacagcaggttttcatgtgaagttaaagccggtcttgtgtgcggctggagggagctgagggatgtgtgggacataggtatcctaagacctgagtcacaggcaggtgccacacagactgagtcctgcttagagacatgctttctttgacctacatggtgtttatacttttttgaattagaaactcattttaaaaattgggagatttctgagaaaccatttgtatcttaaaagtctgggctttcattcccattaggcacagttgctgccccgtttaatgatgttgccttcctcaggtacccatctggtttcatttgcagaagccatttgagataatgagacttccatccaaggtctaacattatgaactagagaaattttggcttaaattattattttttatctaataatagtctttggtgatattttttaatttccaaaatgctttatcacatattacttcaccatcccccagacgttctgtgaggtgagtaggtggtagtactcctattttgcaggtgaagatgctgaatgcagattactttatgttggggctcaagaggagtcatagggcatgttgatgaggccagtctgagagtaccaagttccactgtagatgttttcttaagtgaaggcctggaaggggtcctgaggaggttgcatgatgtctttagagctgaggcaaaatgatggtggcacagccagctgaaaccctccctggcttctcttggtatctcctgtggccccagactctactccccagtctcctgagcccaccaggctccaggccagagctgacagctgttgctggctgcctctgctgggctgagggcaggttctcacatgggccttcagatcccccagctttggttggagcatggttgttgtgccatcactaagttggcgatgagtggcctgaaagcctttccttgtgcggaagctcacttctggtgaggactgtggtggttctggtgagtgagtgtggcttgtgggaaatgacctggtgagttgcagtacaggtggggtccttcgtcaggacctgtctcttgggctccctgttccatttgctgcagtcagttgtctgggtctttgcatactttctctgccattctagagtaatgcttcagactcagctaacagtatacattttggggcttcgtcccagaagtcttcaattggaggctcctgggatgggacctgggaagctggatttccggcacgcttcccaggtgattcttctgctatctacatttttttcaagcaaagcttctagggcagaagcaattctctggacatcactttaataagtcatctaatggatgtgaaatcttttaccgtaggggttggtagggatagggagcactttatctgctctgtaggacatttagcagcttctggatttttcaatattaaaaaatctatccaaggggctttattttatatttatcctttcccttcctggatagttttaagatcaacttcaaaaatttgggccaaattttgagtcttaatgcttttaaattaggttgcatcagttaatcttctttattttaatcttaccaatttggaattagaactttttgaatttaccctgaaaatgtatctagactaagccatcaaaaggaaaactaagtgaaaaaaaagttgatgacttcactctgcattcctgtgctgtttaggttcagcagttgcatctccaactctacccttctcagtttatttcagtaaacatgtagccagtctccacagcattgaaggtgtgatggtgataggcattaagggcttcaaagatgactagcactggtccctgcacttaggcagacctgagaaccaatggacaagtaaaatgtgctaagtgcattgatagcatttgtatagagtgctctgggaataccggaaataggaagtgttcttgcaaccatagttttctctgaatgggatggttgataagacaaatccaggaacaccaataagtttcttgagttgaactgagtctggaagcttgaggagtcagcaggaggagaagcataaaagtgcaaaagtgtttgatatgtttgccaagcagaaaggagtcaagtatgactagttccggatgttgagttccagatgtgtgtgatgagagaggaaagggaccccgaagccccaaatgcagtgatatagagccggggcttgactctgtgagccaagagttttcaagctgttcttggaaccctggaagcccctcaaaggtgcctaggaggttagacatgggtgtgtgttggtgttcatgtgcacgtatgtgcacccaggagtgcagggagaaggcatgcgagggcctgggtggtcccctcttgcttcaactatgttgggcagcagaagattttgtatgaataaaaagtccccttcctttgtcctcttcttaataaagtttgaaaacctctgctgcagacagttggagaggaggtagagatttttaagcagggagtaacacaatcagatcagggtttcagaaagaaaaacccatggaggccacctggaggttgattaaatctgttgagtctgaagccaagagaccaggtagaaaagagctaataagagctaaggctaggtcagtgggtgccagaggcaaaagaataaagagcaagtggaaggaggggtccaactgtctagaaccccaggggctggggctggggctctgggggttccttgaactgtgggagggaaggaacaataatgaggacatgcgggacttttgcatttgtggcagcattggctgccttttgtttttgtaaattctaatgaaagagcccatccatcaggtagactctgatagagatgctcagtatgcgaaacacccagtgggtcctcagacacaggggtctggggctcagagaccgagcctgagagtgatcagggccctggaagagcccatggggtaaaaatgggaaaggacctgggagaacagcagcagtaagaggtgaccagagaagcaggtgagagagtggaacagagtgggcaggccagcaagaagaagagcaggagagaagggatcatggagcaggctcagaggcctcaacctgcttgaggaaagcctttggttaggatgggggtaggggtagggtggatcatttgtgacatttgctaagtcagtgaagcctaatttcagtgagatgaagtggaaggggtattggaaaaagcacaggtcagtttctagagatgtaattgactgggcataaccaagggcagaaacgggggtgatgtgggtaaatcttgtgtcttcaacctgggaacatgaaggtgtcaccaaggcatggggggattcccttgagatgagaagagtctttggccgccgaaagaagaaagccagagttacagccaggctaacctggagcaacggaaaggtctgaggtctagggtaccccttgcacagctccagtggtgtttatgtggaaggagtgcttttctgtcattgatgttgggttataaatgactaactgggttgacctgagagataatatccagcagataacacggggactgtcccatatgggtgtgttcatccaggcagatggtggcagagtgaaatgtgcttccttcaatccatgcctcttaagactggtctcttgggagctagaagctgtgacagcagctacttcattggaggggaggccctggagttgatgatgtggttttccctgtcaggaagtttggctgctagaggaagtagttaggtcactggaaagaaggggtatttgcagcaggacactggcctatatcggggggaggggctggagagcctgaggagcgggaggggtaaagctgagctggggctggaaaagaagaatgtggatgctgcttatgcatgattcttatgttttcttggggaaacagaaacctcatctgcttgaagagtgcctaggacgggatgaatgggcaagatcttgaagatagtgggaaaggctagacatgccagtctagggaaggcaggcaaggtcagagctaatgaatctacatggaattcaaacgtctctgccatgggattttttccacctcggtgttctttttagaggaacagagctagaactgggcagtggtcacagctccagtctctaacccttaactccgttttcttccccctgacttctgccgtgggtgcctatgagatacgatagctgtctaatgagattaatagccactgtacactggtacacaggttgtgatgatgctgttagtggtaatgagcccctctttggtcaccccctcatgcctggttaagcacccaactcaacaaaaattagctggatatggtggctactccggaggctgaggtgggaggatggctggagcctgggaagtcgaggctgcagtgagccacgatcatgccactacactccagcctgggcaacagaacgagaccctgtcacagtaaataagtaaataaataaaaattaaaaaaacacctagatcttaggaggctgcttgggtttagtaatcatttcagaggctgtctggctttcagcagaagtaggtacttttcctactaaagtacctactaagtacttactcagtgggaaagtacctactaaggtttaaccaggcgtgagtacttagtaggtactttcccactaaagtaggtactttcctactaaagtaagtacttagtaggtacttcactgggaaagtacctacttccattgaaatctgactagagatttgatctgacaggtggtaaactagtgaacagacattagtttttattttttctatgtaattctgttagggtttgtcatacctacatcttatttctagtattcacatggcggggggtagagagggaattttaatatagtctttgagcatttgttaggattgggccagcacctaggccactctgtaattttttcccacagacctcagtggggtaagtcttacaatatctgctgaaaatgtttataatgctgttgcttaaatagagttctgggtgcatatatcaaggctagatatttgtaatctaccatttgagtgatattagtagcttctcactgacctgggggtctcatctaagacatctaaagcttcagactgagccccattggtcttaactggggtaacagtttgcttagaccgtctgggctgaagtagttttgaattctctctgtgatattcaggcgtttctctggaccttagataacctgggtctgagttggattttactctcaagctaagtgctgtggtcctccccgcagttagtattgtaaagaagaggaaggatagtgggaatgtgctaatgtggtttagttggctggggccctcattcacccaggatgtgtctcttttcttacttgttctctcagacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcagtaagtagagagatgtgctgctttcttctcctttggctcagcatcatttaggagaggtagggggagagagaatagcgtggtgaaggtgaggggaggcagatggaaccctcgaggttaatgcagagctgggggaaaaaccattgagcctctcttccctgttgtagcccacctgcatacatgtagcaggctccccatagcagaggatcaggatcaggggtgtccagaatcagggcagtctagggctgggcataggcctatctgattgctagcagccctgtgcatacacaagcagtgccagctcagcttggagggaaaccaggaatcccagaaagctgtttgctcttgtgtgggaatcaagtcccagaagaagtgggtagatgcctgccttgaaatctcacttaaggagagttggtcttttatgggaggattttaaatcataaagtgcattattaaggatttgccatctgggtttttcaggtataaaggctggcatttccctaaatggcttttccctgttgaaattgtgtttctaaaagtcggtggatgggacctctcacatcttcctggagcatagccttttaagcttagctgatttctgaggctgcctcagtgggctccccagccttcatgtagactggccttgtgtgggtgggtagtggccattgctagggattccagaaactactggtgtttgcttgtgttgtgtttaaacattcatagtatcaagatattcttattaatctcattctcccatagttctgtttttagtaaagagaataaaaacctataatgctctgattttaaacaagtggtaaagttttaagactaacctttaaccttgtctcagctgctcaaactattctttctctgagccttgtaataatttcctttactttttatttatatgttttaatatttaaaatatttctcttcaagtgtgatatttctcttcaagtagccacagcggtcctcttgtcagtcttttcttcttttctcatcaactggattattttctttttatgcttattattattttgttaaaaaccatgcacacacatacctaattatcttgaaattcttttgtttcttagctttttccgccctgcaatgcctagcatggtgctttgcatagagtaggtgctcgctgaatactgtacaactgaaattattgaattgaatgcccactgtctttactattttcctgtcagtctgtgcttgccttaaccacggactctacttttaaatctgcaactaattcctcattgttttctaaggatcaagtgaagggcagccacgctgtttacttcctatattttttgtactaagatttcccccaaccccttctgagaacttgtttgatgatctgtggcctgctatattgcttttccagcagataactgggtagttaaagtcccccagcaccaccagctcctgtcccaaggccacttgggtaagtctgccgaagaacaacaacaatcacatcggtaatggtgacaatgccttggattttaatggcgcttttcctcctaagagaccaaagtgcttctgcatatatcatctccttctccgctcccacctctcaaatcctcgtagaggccaatatgatatccatctaatgaatgaagaaatcagagcaccacacaggaagtgacagagctgattgttcagttagtggttgagcttgcattgcattaggaaatatttgcttctaactccacacccaccgccctgcgcttagcctgtgctacaccgtcaacttcctgatttgaaatttcatttgtgaatgtgtactcagatttttattagttctgtcctagttttcacttaatccagagagtttaaaattgtcggctgccttttctcaggcctggaaattcttgtaaatagtgttagtgggcagtgaggcaccaggtctgtagttgcctttgcctcagctgctataataaaatagcatttcttcttgtagccccacattctaactatgtgggtttccaggcttgctcaagcaacagacaccaccaaacagtagccctttcaataaatgagccaggacttggataagcgtccactgggatgacagtaggggatgagagtgaggtcctgcaagtcattcttctgcttaatacaagtgaaaggattttcttccttgatgctgcagttgcccttttaatcccttattttgaattgataacagtggggatgagtctttaatctaaagaggaatattgttgttattaatgatgatgaaaaataagtacctcatctgatcctctcaatgtcatgccctaagaagtaggcactattagtatctccattttgcacatgagaaattggagctttggtaggttaaggaagaaccacaggattacagagttaggaagtctccaaatccatccccttaaccattagtgctatagatggtgactgttcaggagcctgatcatctctatgaatcatcctggtatgagtcctgggggaggttgccctcctaggaaaattgctattccctgccccatccagaccttttatttttcacataaaacaagcaaatccagaatggatagcaggcatcctcactataataagagctacatgtggaggctcagtgctcgtctttgtttctgcttgttggggaaataaaggagagaaaagatttgattcaaatgcattgttatgtgtatgtgtgtgttttctcttggtaattgggtgtgcctcttaaaatctgggatttgatttaattaattggtttaaaattattgcatgtatttaatgtgggtggtacccaaaaattggagccaaattagttactttgtgttctttaatacttacagaccttctgaactcaatatagataattatacaaaatactacgtgcataattaaaacatattaggctatctgtgatgtttataaaaacaaagagttatgtggaatagtaaaattaatcatgatcatgatgaccagtttttgaaaacctactatgtgttaggtgaatctatatgcatcatctcatttactttttaatatttaaagaattctacaattaaaggtggctctctacctgtcttacagaagaagaggctgaggcatgtcgagtttaaataatttgattgagtgaattcagatagttaagtgagcagcagaggctagatgagacagggaagggagtggaatccttatcccaaacttttgattggccaaatgtttctagaaagagagcaaaggagccccagggctgactggacaggtgggagagtggtggatgacgagctgctggctttgttttattcctgtgtgttaatgaaagaatgaaagcctgctcctcacgcactgcaaaactagaccatctgtgctctcttattacccacacttaagcacacgttatcatccaaatacttactgttggtttttttcccagtatttcctaaattgtcctgaaggactcaaatggcacattatggatattcagcttttatttgactgctgtagtaccgaatggtaggaagagtgaagtgaagtaggattttggagttactcttcttgctgaaaattcaacttgaaaaaccctgaactccagctgaatagattacccaataaattgttttatgccctaaacatcatgccactatgttgtatttcttaggttcttattcaggctcaggtcttagaacctcgttatcacagttctctgcacacagcaaagaacatcctagattatcagatctaaaaccacagggagcaaagcccagaaccagccagggcttgcagcaactagggtcagagtgtttttgaccctctgaggctcaccgtacctgaatatgattccatttgcacccctcctcctgtttcctctgtggggagggcgctgtggagaccataaagcctccagggtgtttctctctccctcttcctagagagcagcatctccgtggaggtggccagcaatgccagcgtcatccttgagggcgaggacctgcgcttctcctgcagcgtccgcatggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggagcgtccagatggagcaggtgcagcccaactcattcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttggtgagtgagcggtgggactggcagtgggtctggcatggagacagcttcagtgtcaaacaccttatcctgacttttctcagtcagagttttagcaggaaactatggccagtcttttacctatagagtttgaagtactttcctttatgtctattttatttcttataagggtttaattaattaagatagtgctagcagggactgagggacccacagtggatgatggggctcctgagggatagcaatagctgggagctgtgactactcctagtctggctgggagagagtgatgttatcagaactctatccaggttagtgaagccacccagccatagtggtggccccaggtggaggagcatggccactgccagcctggccttaaagagagcagagtggctgagcactgtgtggcatgtctttcctgccctgctgcccaggggccagccttcctgaaagagagcagagaagggtataaaatcatctgttgtcatttatttagcatttactatgttcctgcctgatccttaacacttaagcttagttgtcccattgaatccccacctagccaagtgacagacactttcattttatggaggaaactgagactgagacacattaaatactttgcctaaggctagaagtttctactacctgacggggcccatacctaacaaagctattccctcattagcgtggaatgaaaagataccttgagatttgctaaaaccaaggaagattagatttgcttctcatggggtaaagaggcttctatcaacatttatctgcctggatataatcagtctattagattttaaacgaccagtctgtgactttgctgggaaagaaacttgttatgtcaggtcttcctgtttatcaggagacatcggttgtcctcagcaactttatgtcccactccctgggactgtgtcaccaccttccttgcaggtcgggatggtggtgcttttggatacttccagtaaagatggcagccccgagtggtttttgtccttaacagagtcctccattttcttacccctctgagattagaattacatttgttttctaaagcttaatcctaaagattgacctgctttttgcagtaattatatggctcagatttctgtcttagaaacttcctccagtgattgcgtttcctgatcagctcagttcctgtgtccatactcagcacctgtgtggacccagtcagatggaacttgggggacaaattttggatgtccagtactggtgtttttttttttttaaccatcctggaaggttaggaatgtccaatgagtgattagagttagtgaggattgtttctctagaagtaatttatggtatcaggttatcccctgagttttttcttactcaccatatgtctggtggttctcacagccaggggcactgaggagctctgccctgggatctggaggccagcactgttcacctgatctccaccactgagatacttctggctacagccataatcaggtggcccaaaggactgaacaaggaagaatgggagggcactctagactaattaaggttgtcttttcagtctaaagttaacaatgacacacatgaattttcatatcagtataattagatgcaggtcccaaatgtacaatgggccattatggctgttcagttagagcagcttgggtgctctgtgactgtggcatgtgcctgtgtcaggactagacaaagtcatttgcttggggaagctctctccccttcaggtgtgaggccaggagcacctggtgtgggtcctgtccctgaggttctgtcctacaccaccctcatgcaacacctactacacacaggtgcacagtgactgtcagaggtgcttcatgtttaaggatgggcctccgtgtcataaacttttttaaagggtatatagagctatgaaatccaaatcaaaggtccagagttttcagcaaattgtacctacctatttgccaacttaacctcaccatagaaagccaaaagattcatcctgtggccagtctttcacattacagagtttaaagtactttttttaaatttctattttatttttaacaaaatatttaacaaaatatagtatatctcatgtgccaggtactatttgtaatatttataaacactgatttatttaatcttcacagagactcattttacagattggaaaacagaggcagagagaagttaagtaactttaatgtcactcagctgggaagtatcaaagtcttggctgctggctccagagtctagacctttaaccactgtgttatgctttccatgggtaaagcaacctaaaaaggcccctggaatcagttacatgtggttggagactaactctgtcattgacttactaaatgcttgatattgggcaatttatctaacctctctctgcatcagtttctacatctgcaggaagagatgacaagcctgcctgttctacaaggttgttttggggattcagtggagcatgatgagagcaaagcagttggcaccatgcttgcacctagatagtgctcaataaatactggctactgttagctttatgattgtgatcaatgtatgaatattaaacagtatttccaggctgaaggaactctgaggtactcatattgaggagtcagtattagagcttagcagtgctgcccattcaataaggaatattgagagacccacagccgctgagcctgcagaaccctgcatttaggataattgtcccaccccactggaggtccccacctgctctgttcttggatttcatgagggacgtgagaaagggactggaggccgactccatctgcttcccttctcggcaccagtgcgctaagggaccaggaaaagaggtgttggggctgtgtggttgtgttttcctcctgtgcaatggaggaaattggctttggggttttcttttcctgttttctcatggaatctcaagatttctaggagcaaccctgcctacatgcaatcagtccctgagaggattgtgatgtctaattccaggggaggagcaaatgcacgaggatctcattgggaagggttaggctagtgctgctcagggggaattgtggtgggcctttctttggagtcttggaaactcttggactgggcctcagcaggatactaaaagcaacactagcctgagagctcaaaaggggccccgagagcctctgctccacactgcttgctttgccagctgccccattgctgatgtcatactgccctgagaaagccacatgcctcctctggttgaatctctctgctctctctccagaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccaggtgagtgctgcggacctgtgggctatgtgcccatgctgcctgagcagacgtgagggaaaaagaaaggtgtgcgtggagcccttagcgtcacttccccctttcccagctcttcatttagacacattgcaaatcaataggaagttttaagaatcgtgcagtggacacttgtatttcctttccttgatagccagttgttgtctgacggcatttgttttcttcctctgtgtgtatgtttgttgttgtttttgagccattggagggaaagctgtggacattgggacacttccccctaagtacttcagcatgtaactcctaagaacctacccacccactgcaccatcatcacacccttggggttttacgttagtgtagtcctaccacctacatttccccagttgtcccagtcatgccctttatttttccctttcagattaggatccaaccagggatcacacatcacatttgttatcctgtctctttagactcctttaatctagaacaattccctaacctgtgtgtttgtgtgtgtgtgtgtgtgtgtgtgtgtgtatatgtatgtgtctgtagacatggacatttgtgaaatgcacaggccaattgttttaaagaaagcccttttctttacttaacctcatctcctataatcctcatacaattatgtggaagtgatatcattgtctcctgttcatagacaaggaaattctgagtaaagagggagggtaataggcacctattgagcatcttctttgcatgaggtgctgaaggtcagttattctattagaattgcacaacaaccccaggaaagatttaagtgactagcttaaggtcatgtacctagtgaatggtggagccaggatttgaaccccggttgtctcccacaatgttgcctgcacccaggccctgtccagttgtatgggccctgaatttgagctcctttctctatggaggctgagtctgtctcaaagcggatcatcaggatgcattaatttggggagcattagtcagtggggctttctgcaaacactctcaccttcgtcaggctcttctgctgacatgcgggaggagttaagtacatgcagctcttatggttttcctccatctgtccttgtctcctgccaggttagaagctggtggagggtggagcccaggcggtaggctcctgtgttccttccctcacccagcccatgcctcggctagaacagacacctgtgcaggcaagggcaagggtttgactttgcaaagatggctggaacgccttgccaaagggatttttctgcccactaacagccatggttagggcctgacctggtctgcccgactactttaggtggccacagtgtcgttttcagcaacatgaggttaaataacggtaacctttgggtttctccttcacctcttctaaccccataacagagttctgttctgtaccagatttggaacaagtgagttgtataaatgatgagactgttcccttggccaacgagagcctaaactttgactgacaagaggctcagggaagaggctgttttacttaagtggattttcaggttaatggaaggttaagcagagaccccattttatgtgaacccttgttgtggaaaatgtcgaggtacccacttgcctgcgttattgagtgggacattaggattgtaattgcaccttttttggtcccctctggctctcaaggtcagttttctgagcagcattgcccatcacatggttctgcagctgtagaaggtagaggagatgctgacctcaagaccttgtctgacattgcctttttgaatccatccctagtatttgcctgtttctggtactacttggaatctaagactggagtgcctaagggaagaatacagaattagttcattgaaggttctaattatttggattaatttatggtgttactaaaggcagacagggaaaaatatgtatgaagtacctcttggatgccaggtttctgcttagtgctttactcatgttttctttttaaatttatccaacaacctaataatgtaggtgtttgtatccctattttgctaatgaggaaaccaaggctcaaagtggttaggaatcttgatggaggcaagccagctggttaaggggcaaaactgagatttgaactgagattggagcccaggtatctctgacttccatagagcaaatgttttcctttataccataattgcctcctgggtaaagtagctggagggttgggagaccccagatctgctctgaggttgtctttgtgtcttgggtgtcttgagttggtttctgttgtgttttcactgtaaaatgagaatgaacagtggttggcagaggagacttatgagtatcactgtacttgggctgttatgaggcctctacttaaaggtgcacagtaatatacttttatggccctttggaggctaggaagggcaaaggtgggtgcttgaggccgtgcaggactcccagagggcagttgaggcaccaggagagtgcatccccttaagtgttactgtctctcctctattaaatatttatgcatttagcacttaatattttccagagagcttcataagagtttttactctttcttatatactttggtgctggtgcattcattttggggaaatagaagtggaaaaatacatgagagctgactgtgcgctggagactgttggacacttggtgtatattatctcacttaatcttcactgcaaccctgggaggaacatattgctttcccattttataaatgaagtaacagaggctctgagagattctcacttcctcaaattaaacacctagtgaatgggggaagttgggatttgaatccaggtgtgccttgttaaagagtaattgcggtagggagactttgaccttttaaaggctatgtaatcagagattattctttcagcattcagttaatcgtgtcctttacagaagaattttctccttgtagattgatgatgtggaggagttatggcactagtgttactggtagtaacaacagtagcagctaatattcactgagcatttcttgtaaaccactgggaatgctttacacataataacttagttccttgtttcttaatccatgcagtgctgtgagggggaccattttacccaacttcacagatgaggacactgacacagaagttacataaattgcccagtgtgccatagtaagtggcagagccaggattcaagtccagacaggcagtttggctccagagtccaagttcctaattttattattatatgttctagacaagtgtttttcttctcaggaatcctctttggtactgtatacttgtatttaatgtttcctctctctggttaaccacccctgatttcctaatcccctttagcaaatccttaaatttgttttttggaagttggggtcataagacactggtagaggttcctcaagacacagtttgctgatggtgtagaagttttatcttgtgcctcttttaactcctgattcttccagcttctgccacaaggtggctctaagacctggggataccagagctcagaaccagcgctgtcctctcttcttttgctctccctgcgtaccttgcccctcaaaacatagattcttagccctgctctggtgtcttccatagaaatgtcccctgctacccccgttttaaagaatattgtgttaaatattcttattccatcagaatcaaataggaacccagggactgttgactcactcatgctggtctgtttaccatcagccttccactgctgtgatatcatttatcgcagcaagcttctttgtggtctgtgccccagactcgtccctgctggagccacctgctgatcctgcccccatatcagtattcatcagaatctctggttggatggcacagttgacttgtggatctgttatttgaccattccctgtgtgtgcttcctgttgcatatgcatatccccaacagaatcttcaaggaatgccatcactgtcaacgttgccattgatctagcttagtctgatccccattgatcacatagtgtgacccctcaaggggtgcttaggcaagactttcagccagttcacatgtttgattattagctcttaatcagttcttttctcttttaattgtgaagcataattgccttgcttccttctgattttctttagctcaaaacaccctccaattacatatccttaaatacagaagcagtaagggaaatgttagcactcattttccaaatgtttatgacaatatcttggtttggctattaaatattgtacattaaaattgacaaagccataaacaagcttccatgaggacagcctctagtggtggaaagccgacttgtcagagggtgtattctgctgggattttactgatgggcagtcaggatgaatatttaataccctctggatgttgccaaatcggttttcttctatttcttattgctgacccggcagattgggatagcagagggcttttctttgacttccatgagtccagagcatgtgaacactggctctcctttcacattctgagggatgactgccccatccctcagaggactggcctctgccttctttcaggggagtccggggttctccttcttccatcccaggtggcttctgcctgttgtctgtgccaagatagaatgggtgtgagtgcaagagccctaagaggagagcccagcccctcccagatgcctcaggcctgttgtcatggtaacaccggggcacttgttattggcatcaacgagccagggtcactgccctgcctgcagacaggtaaggcagggtagggcgcatctgggtaaccttcattagctatttccacctgcagactcttgctgctttccccttgcccctccctccctgtctctctgcatgcattgagcacctactaagtgccaggttgccatgctggtgaggctgctgagatgggtgtgtcacgttcctgccttgcgggctctgtgggaggcagcaggcctagggacagaggagagcagaaaagcattacaggtgtggaggcagagccagcacagggcatgaacacggggcagggggcaggtgaggagggaatggggtaggggtgagggtgggaggttgggaaggaggagtggagcatttcaggctcagagaagagtgtgaataaagatagtcatggagggtgggagcagcatgcttatcttgagatgactaaagcatggggtctgggaggggttcacccccaggcaagctggcagggatcaagaagtcccttttgtacatgggagcacggggtgagggtgggcatatgtaatagctaaaagcaaggacagaccagacagcctgggtttgaatcccagctctaccactaagccagctgtgtgaccttgggcaagtgtctttataaaattgggaataatatttatttcataggattggtgaggaccaaatagttaatatttataaagtgcttagaatagtgctgagcacataggaccagacgaaagtttgctaaataaataagaatatcctaaactcagaaattaggactttagctcatacccagatcatatactccatttttgtaataatttataatattccctttacccagaaatgaaattcatatacaatataacattcctaatcatatctttaaaatttgctatattgtcctagttgtgggataaagaaagttttttttaaaaaaagtagttcatagtaaaataatgagtttcagtgcgtaaatgctcaggacagctatgctaggaggcacagtcacagtcaacgctgtctctaaatgcacactgacagtcactgtatcagacttggcaccatgagcaggactgccatcctgacagggtttctgaagtcctgagtaactcttgctacaattctgaacaaaacaaaggaaaatcctctcttgactgacctggcatattttaaaaccatgcaaaataaaagtattgtgattatagtaaaacgaaagtaggttctaggcccagaggcataatttttgcccatatgaatgtcattcgaaagtcacacaggacacgaggcagagttttgttgcatggagttgtcccagatacaattttacatctttaatggctttattccattgaatatatacccctccccaaatcaatatggcaaccagagacctgcttgcaattagctgccttattgagaactgctgtcacgggctgtggggtgggcagccgtgggcagtagcatgccccatttgccatttagggaaatcccctggctgtggctaggccgagagggagggagtgtcatatgcaggccaattacaagagcctgagaaagagatcattgagggcccaaatagggaatggtcatgtggagagagcagggagccaaggggtgttaaggacagagggactcaggggtagtaacagtttgactggcaggcgcctgtgccactggcttcccatgcagctcaccctgcattctttccttgtctctcatctgacttgcttctctccacttgaaacatctcctgccgcagccactggccgcctctatctctagcattactgtctgttgtctttaataaagagcagtgtcttcctccctcagtgcccatctctttgcacgtgccactctggctgctgctcacagcactgcacagaaaccaccttctccagacttaccggcaaccacctcagcagcacggctgttgcttctcaaacttgaatgtgcatcagaatcaattggagggctcatgagactgcaggttgctgagccttactcgcagtttttctgacttagcaggggctggcagattcccaggtgatgctgatctgcagatccatggcgtgcaccctgagggccacaggtggtcaggatcaagtacaagctgcaggccccttgcagtgtggccgaagcttacctttctaacctcatccactacacctgagcacttgctcctccttgaatagagtgcacagggtagttgtcatctttttcctcttgtcccctctctctggcgtgccctttgattctccttctctgcttgtttctcagggcctagctcaggggccacataccttttgaaatgttctcttttctatcaaaatcagaattgcccctccttttgaaaagtaaccacatttattcaaccattcattgattagtttaacaatgattgggtcagagtccctgccctgcatatgcttagaattttgtaagaaagagaagactttaaaaattaccttcgttgtaaggcagcagtaacagctatagtggagcgtaagggaatcctttattgaagaaataaatgagttttgagtgagaagagcacgcacagagtggaatctgaagggagggtaggctggctgagaaagctgctgctggtctccgctgcgaagttcttccctcttcctgatgtctcaccttgaaaccaccctatcctggcctgtaacaaacacaacagcctctcctaccatacaaaacacagatcttccaagttttaatcacaagcctgggaaggaaactctccagttgcagaaagaaagggccactccctcaaagcagggcctggcccctgggggctgctgtgaaggcagctgctggcgtgagctggagcagctctcggaccctcttcctgtctcttgctggattctttcttcctcctgccaattcactgttgggggttaaccaagcctcactcttttctttcacgtctgcatttatggcctctcaaagcccgttcactcacacggccaagtccagggtttctcaggcttgaagctacttgtgaatcacctggggatcttgttaaagtgcagattctgacttactgggtctggggtggggcctgagagtctgcatttctaacaagctcccagtgctgctggtccgagaacagcactttgagcaggaagattgccacttatgcttgacaactcccaatctaagtgttgaactttgaacttgggacaaggcacagaaaccaaaaaggaatgagaatagctaaaattcactgggtgtttgttatatcccaggttctgtgctaaactctttttatagacaattgcttttagtctgcacaaaactcctaatggagatagagacattgttcttattttgcagatgaaaacacctgtggtctctaagtgggcagggctctcctagctctgtggaggaaggtggtgcacgcaagctgtacaccgcccagggcagggctctggcaggacatgggagggctccctaattatatgtggagattccagtctcccctgtgcctcaggaaaggtcctacctgccctggagatgtgggaggaaatccagagcatagaataggagctgaccccttgcccacctgtcagacatgcaccaaatttaaaaaatgcctctctttcaagcttctcaacacttcacaatattttgacatgggaaggaaaaaaaatggaaatgctttggaacatttctcttccttgaattcttgttctcagaccatgtgactgaatagaagtttagtcacaggattccagtttaacatatgcagttactatagcaattgaggtttccttagtaacagttgcaaaaataatccggccccaattaataatacattttaaagctctttctactccatgctgaacaacccagtttttttggccaagaaccagataattcaggtggtgtcatttgcactgatatagatatcatttgcatgcggtgaattgggttggaaaggaatgaaaagggagccggttgtttcaagtattataggaatccaatctgaaaagtcgactggcaagcgaatgcaaatctagtttccagagcttgggagcttaatggtaaaccctgtcctggattcctagtgtgccctagaggactttctgcatttgaagaagggagaaggcagaagattggacttgctaacaaaaaagatgaacccgggagggtggggccgtggcacacaggatttctctctaagtggtgcctggtgtgttcttgatggcgtgagaaggtctgtgggtttgtgaattcaacaagtcttcctggagagaatgtccgatttactgcgggagatgctccgcagtgttgctcagtcatggcattgggaattggactttgccacaccttggcttgctaaatccttccatccattcagaacatttgtctgtgtgttacagggagaccaagtggcagtctgtggctttcacaagttttggttctgtgatgcatgggactcaatcaacccttgatgctgccaaaccaagcttaagccagctggcaggccagggtcatgaccagtgggctgggtcctgggtctggatgcagttcctggggttgagctggactaaagagacaagagtctgaccagtagagtgctggagcctggccaggcatccctgccctgcccctgcccctgccctccacacaagctcggttggaggaggcctaggttgctgtccctgggtggaatctgcaccttgcccctgctttctttctcagctgggaagtggtttggtccctgtggcggaaaaactaagtgtgaagagagtggtggaggtggaacaattcttgtactattagttccctaagaggaacttagaattgtttttttgttttttttttttcatttttagtagcgggaaaggcttgggtaggggaatgcagagccgaggttaatgatgatggggtgggtgagatctcaaatcaccttcctaagatggatttcattagaccttggcttcttgccactggcaaggtgaacatcgtcattaattagctgctggggaggcgctccacaggctgccctcttgtctgtttttggagcaggacagtgaggagaagggaggattgtagttggctttgccttgtcccgtggtttactgtcttctcagccttctctctcactcccccagaggaagccccctctccccccgcccgcagcatcctctaattacctgttgccgtgtttctccaacgtgctctcattcgctcacccactcgttcacctatttcagcaaacactgatcaaatgctttcctggcccaggtgctgtgctaggctctgggggtgcagcgataagaatgtccgctaggcagtccaccccatgagggctgggactccggcttactcttcagggcatccccagcacttagcatcctgtgggaaaccgagtgggcactccgtaaatactggctgattgagtggaaggagtttgatccctgccctgggggagctcaccatctaggatatgggagagagatgtgaggacacacagcccagagatatatagagggtgctgaggaagggtatggagcccagggggacgggaatgagggataagtggagagaagggtcagggtgggaggtggcagaaggagacaggcagagaggacagcaagggcaaaggccagggctcagggaaactgcaccaggggcatgcgcctgtggagggtgcctgagggtgagtcgtgagagatgagtcaggacacttgggtgaaggccagatcctgaagggactttgtgctgtgaaaaggaattgtttctctctggcccgtaggtagttcagagccattaaacttttcaagcagagacctgatatagctagatttgtatttcagcaggatcacccttggaggccctgtgatggtgggctgtgcaggcagtggataggggagagatggtgaaggcctaagccaggcgcatggcaaggaggagacagggaaggatgtttagcggtggcctgggctccgtgctgccttcctcacactgaagccagtcggtgttaaatcccccaggaactgtgctggaggaaacctggctcagagcctggaggtggatgggccacgtttctgggagtctgtggtgattcctgtgttcccctttcctttgcagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccaggtaaggccgcagggcacggctgtcctgggccagtgggtttagtgcagagactgcctgggggtgggtggggatctgtggggctggtgtggagagactgtctgcaaggtgcatgctgagtatgggtgcaggtacacggaccatcaccctagcacactgcaatcccatccattttacctgcagtgggtcctgatgctgacggcagactcatggaagcatccttgactctgcttctgtggataccatcttcaccaaggagcagggcagctgtggttagcaaaatgtggcaaggcagggttcatggcagctcctgaatcttcttctgggtttgcagtttgcaccctgaatcttgggctgacaccagctccacacccagagttcctacctagaaggcattttctggttttatgcatctgcatcccccttcttccttagctcccagcccgcccagacaagcctttcctatctccaaactgaatcattcctcctctggcccttccttgatcccatggtgtagcccttattcctctccctcacaggtggcactcaacctctgccagaatgcttccagggagggagagctattcagtccgcaagcctcagttccatttttgggcagctctgattgttaaaaagttcactttcctgtaatttccctttttagatctgcccctggaacaaccaaagagaagtctgcgtcatttcctttcaaatacatgaaatgtatgccccttctctgttaaagatctctagtcctttcaacttctcacatagtgtagcctgaagggcctctccacccctcattctcacatccctgcaattcgttgttgtcactgcctgtccttcttgatgggccatggggggtgctgtgttgccacccagagcctcatctccgtgccttcgcttgtgctgccctcattgtctgaaatgtgtttttcctgctgcttctcccttgtcttcactccatccctaagacttcattcagcaccacctccaagaagcctaccctgatttctcccataccagtaggggtcccttctaaaacacatagcctaataatggtttgcatttcttctgtactactctgtaagcatgttgaggacagggctgtgtcttatatcttcagccactggcatggtacttttagtaaatattggttgaataaggaataaatggttgctttccttgatcaccctaaggcctttgtacttattgttctgtcagcctggaacatgttggccatagatattcatttgtcttgctcttccgtgaagggggattcctagctcattttaacttaaatgtagccccctcatcactctagatttcctttccccggccctttcacaacacatatcaccacctgacattctgttaatttacttattcatatataagtaattatgaagtatttacttataattgacttatcagttactatgtcttattatttttatactagaatacatatatatatacacacacacacatttgttttctatctcttctactagaattgaagcctcctgagtaagcatagggacttggttttcttcactattgcttgtctcctaaggaggcctattcagtaagccagtggaacccgataccaaactccacatgtggcctgtgccctgctgaatgcagtgagtctgttcccctcctttgcctgaggttattatatttccagagattctcactggcctctcggtggcattttctgctaacctctgctggtgcattaaacaggaagctctggtctgaagtgattcccattggcattttcggtgacatatgtcctgacttcaggccagtccctggggcttttgaacattgaaggttgtcattaggcccaccagtgttcttttggttcctatttttcatctgttttcagttctgattattttctctactgaaagaacatgatcacccccaccactctgcatttccactctagtcatcaccattttttcctttcctcatttgtactgaaaccaagagattcttggaggat

SEQ ID NO: 735 - DNA, 6115 bp, Human
  misc_feature (1)...(6115): n = A,T,C or G
cttctgttccctagttggctgtgaataaaaacaagaaaccaataagggatttactgctctctaaaaaagtgtggaatggaatggaatagtggattggagtgaaatataattgaatggagtggaacagagtggagtggaattggggaaagcccttttctgtctctggtgggacagcactataaaatcaagcaagcatgccagggtgccacaaccagggaacttttttgtgattgcagatatttcagaaatgttgagcctatcctaactgcctctattccccaatttcttcctcctgcccaccccaacaacacccctttattttgttcaccaatgtttttatcttaactattattatagcctttcattccacagtgagaaaacacatgaaaattcaaatacttatagaaaaaatattgctaaaatttgacttaggtgtatgctatagcgtaaaagactaatatcattctttcctgaaagtggattttggtgaggagagaggcaatagatactgagtgaccaaaaaagcagaaagaggaactgaaaagtcagagaagaattagtttagaatttaaaagggaaggaaggagcatagaattcaaatttctttacttcacagcttgacctggaacttaccctgaaaaccatcattactcttattaaagaaacaaaaactttaaaaggatgaaatatacaattactttaatactttatggtatagtctggtagcacttaccttcacatgaagacccttcacctttctgagaagtctctgatgtacccaagagtcacaccggacttactctcataagaaagacctttttttttttttttttttttttttccaggactttcaagcaaccctatccaacctactggaccaagcacacccaaaccctgtgaccccagtttgacatttgatgctatcaccacactccgtggagaaatacttttctttaaagacaggtataaaattgaaatatttcttcctttgattcctcttactgacataccttaaaactggattcaaattaagtcacacgttagtcaccttttccttgaattctatacttgtgcttctcatcggaattttttataggttctggggcaccactaggattatcatagccccctgagcttaactttatcatcttcgtcttttaaagactatttgtaccatttttgtgtctatactgaatttatgcaattgagtattttctgggtaactcaagacatccaggagaaaaaaaaaacatgaaaacattcacaaacattcagatgcctttggtgatgtaaacagacatgggctacagctgcttgggaaccccatagctgaaacaccaaagcaccatccagttccatccaaaatcagtcaagtaaatggaacctgcgcttagctagctgtgcagcaaatcatcaaactgagcgaaatttttatttgtccattggctattttgtgagtgtgcaatcacaggctgagggtacatgctgttgcttttatcaatatgttcacagcatttactgggagcaataatgaaagatgctacaaagtaagatttttcaatgtccaaggcaggacaatgccaaatgtaatcaaataagatcactcccataaccttccctgaaagctgtgaagtacttgccagatggacaatatcactataaagcttcgccatatgctggtcactgtgctaggaactttgcattcgttcgattgttatattctcccagcaatcctacaaggaccatcactagcctaaaagtcacaggaactgcctacttagactgttatgtataagtgtgtgtgtgtgtttccttatgttccgttaggtacttctggagaaggcatcctcagctacaaagagtcgnnnnnnnnnnnnnnnnnnnnnnnnnnnnnnnnnnnnnnnnnnnnnnnnnnnnnnnnnnnnnnnnnnnnnnnnnnnnnnnnnnataatttgtaaaaatggaaaagtcgtatttaacacttaacctgaatcattgacaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggaggtaacgtaaactattttttcaattataggttgaaatctgtgtttctctaccctgcttacaaaccttcaagcatttcaaggtttaaaacaatctagatagtctctaataggttttaccgagaatatattcttttttacaggatgattgatgttaccatggcttttgaaatttttcatttctataaaattaaaatgtctatgcaatagtattgaggattctgcatcaagaaacaaagaaaaccttaacaaagcactagggtgagatacaaagaaagatttaagctaattctcacttatgagttcaactcagacatatgcaagcaaatgttatccagatagcctgcagaatttggttcccaagttgaacctattatgtatgtttatatatctatatacacacacaagggagttatactatataccaattaagtaaaagccttgaaaatataagcttactttgggtaataacagtgtgtcagccatcaagcctgttttagaattaatgataaccatatgttttataaatgtgtacccttaggtagagaaattaaccattcttaatcctagtaaacagggcattgtgagaactgaatgaaaaaatatgtgtgaggagactttgtaaattatatacaataaaaaaaatttttttcgttatattctgtattggtgttaaatcggatgacattttgtttttaccagatatgataaccaaagacaattcatggagccaggttatcccaaaagcatatcaggtgcctttccaggaatagagagtaaagttgatgcagttttccagcaagaacgtaagtaggaaaaaaaaaacctaataaatgtgttgtttgtttgtttattatagaggagacagggtcttactatgctgaccaggttagtgtcaaactcctggcctcaagcaatcctcccacctcagcctcccagagttctgggattacaggcattagccaccgcacctggtgtttaaattttttaaatagcatgtttgcatttgaatgttatgttggaacaggggcagggttttctaactgaagacatctgagatattctataagctaattcaataaattatctctctttttttatagatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagccacctaggggaggaggccgtgtgaagacagaggcagagattggagtgacgcatctccaagccaaggaattccaaggactgtaagccaccagtagaagctttgaagaggcaaggaaggattccctccaatagccttcaagtgtgaccctgctgacacctgcagaattcggacttctatcctccaaaaccgtgagggaataaatttcctttgttttaagccaccaactttgcaatactttgttacagcaaccctagacatgaggtactagacacagtacatctacacatatgaaaatgaatcaacacagaatgcagaagtagaacccttgctaaggactactgggcatcttcccaggacagcagccaaaagagaaccaccacttcctctcctgcctcctccttgctctctcctagagtccaaacccaaatgggccagttggatctgatgttcgtcagttctttacttctatttcctggggtactcaggagggcacacactatagataacttgggttagctgcataaaattcaatgtctcattaagttgcattaaactgagcttagatgtgtaagtttgctaacggatgggtttttttgttaagaactataggatttatgggaccaagtctagcgagtccagatatcaaaatcattataatgttatatttgctgttattagaatataatatagcttattatacaataaatatgtagactgtaaaatatatttctcactagtacctcctattttctttctctgttgaagtttttaaatcccacagataattaaattggcacctttatgcttgttcaaaaattaaaataatctattaaataagttcaaattaaagatttttacttcaaatgactgatttgtgatttgcttttaatttcttaaaatgttaccacataattcatctaaagtataaaaaggaatagcaaattttagatgttgtgcagatatataatgcttgtgtcagaattattataatattgataataaactttagatattgcttcagagtgtgtgaaatattttataaatatttgaggtcctcaaaaatttcctcaagtatgttaatacattattctcaaattattttacaaaataagaaaactgaaacaagtatatattatcattccattcattgatttattcagcaagaattaactacctacctactattaattatgtttcagggactgtgctaagaaaagtgagagagatgtataagcgattcatcatatcaacgtaacaaatgcaaaaggatctataagaattgaatattccatttttaatagtagcatcaatttcagactatcatgtttcctaaaactttctataatgccagttatgaaagttttaggaaaatgcaggcatgaaaatgagtgtcttatcttctcagaacacctgctagttgtgctggctatgatagactcttggctcaaacctcatctatacatctttgagatgagaactgatctcatactattttttaaccacatttgacagagtcatagacagtgaactgtaatatgaagtgtaataaagaattcagagttattccttttaaaaaaattatcttgttgacaacatgtagtattttccagctattacattgatattttgaatgggcacaagagatataaagacctaagcttagaatgcatttatttattttttgtttatttatttatttttgagacagggtcttgctctgtcacccaggctggtgtacagtggtgcaatcacaactcactgcagcctcaaacccctggcctcaagcaatgccccaccttagcctttcaagtatttgggactacaggcacacaccaccacactcagttattttcttttgtaaaggtggggtcccactacatttcccaggcttgtctcaaactcctgggctcaagtgatcctcctgcctcggcctcccaaagcgctgggattacaggcttgagccaccatgccaccctgcctaagctagaatttaaacaatgagattcatgtttatcttaggttgagattcttcaaaagcaaagcctaagtcaagacattggtgcaa

SEQ ID NO: 736 - DNA, 10696 bp, Human; identical to SEQ ID NO: 679

SEQ ID NO: 737 - DNA, 33822 bp, Human
aaggtggagaaggtatagtcacagtctacctgacagcagttgctttccagagcctgatctagctcattcaggaaactgccagtagcacataacccatgatgagaagccatgattttttccctctcaggtctatgtggaatagtgaagccaatgagggttatgttgatcatctccaggcaagccttgtgtgtttctgtaactgcttgtgaatgattttagcacagttgtctcagtcatcatctaagaccatctcaccattatgatacacagaagggcagaaaccagagaaattgcactcttggaacataaaaccttcaagtttgattgtataaaggactttgagccctgaggatcactagagggacaccaagtagctggtactgcccagcattctcaactatatttcactatgacataattctcacaaatcgcaaaaggcaatcctgcagctctgtgctggctgggaacacatgtctcctctgcaaacagtcaagataatgctcaggaacggtttctatcagagcagcttgtgcctctcccctcctggagtggacagtttatttttatctggcaggctggggaacagtggtgagtaccacacccctgagagtgggagttcctacaacgatcagccattgtgccttcagagaagaaggcagcaggggccacttcaagcttccctgcttcctaagcttaggttgtcagaagcctttttagagatacatttttagaaaaagaaaaatagtgtggtaacagtttactacttgcttcttttttttttgtttgtttagagtattttatagtaatattactatagctttatgtctagcttaccaaataaggggtgaagtgtgccccagagaacgctgttactgtagaaacgtgtcttagccccaatttccactcattggtaagttctttttcctttctctcttttgcaaggtttcaaataaaattgcctttctagagcacttccccaatccatattcagtttataatctaaaatgtattttacaaagaagtaaatggattgttcgggctccagagatgtcttttttcatgcacaggattttttacttttaacaggatacaatgagtgatcaagcactcgaggctctgtcggcttcactgggcacccggcaagcagaacctgagctcgacctccgctcaattaaggaagtcgatgaggtactgaccttagagttgatttacaaagcttgttagtctgcacattacaaaaccgaatgcactctgcatgtttagaattctcgcacaacttttattggagagtaaaagtgagcattcttcattgtgccttatttattgctgagtggttagcaactaagggggatagttacatgactgacttgtgaaacagctagaattttaacatttgaaatgaacacgaatctcccttgctagagcttaaatgacccttgactaaacaaggtaacaaggaggcaatgcctggtgggaaatagtgaagtttggcaattggaaatttgtattttcagaagggttctgggtgcttctgtttataagagaaggagatgtctatacacggagtgggaagatccttcatttatcactatggggaaagatgttgaaaattttgtctcaaattaaaatcaagcaacaattaccctaactagagctcctgcatatttatagaataatgctgatgagtgtttatcccgccacactccaagatcttaacaagccttctgaaccaaaacaagcttacatctggtgtaggaaagttttaatattaaattataatttttgtggaatttttcaactcagtcctctggggtgaaagaggaaggaaaggagagagttgccggttcctgacaaggcagtgttgtggggagatggaaaggtagcctgggatccccaggagcccgccccacctccatcagctcaggctgggggtgctggcaggcattgctgtcacaatgccccatctctgctgtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagtaatgtattgggaagaagggaaacttgattacaacacaatgtgagatatacattacttagagtagccgacagaagcagtgtcatcttgaggaaagcggggtgttggcagaatcctggggggagtcaggaggccaagctgagttgtggctttaccacctgagggcgacagggccacaagtatattgcacttctgccccaagcttcttacagacacttaaggagagacaattaatgtgggaagggagggtataaacatgtcataaacctcaggatcaaaggagtcttaaaagtgactaaaagcagataagcagatgttaagaaaaaaagtgacataaaataagttatttaaacatgtgggtaactagtttgggaatgcatatgaatgtattaagttccctctagaaaacttcagagtcgcagcaaactaaaattccagcaaaaagaactcctcttttccactcttatgacataatagttgtattagtctgttctcatgctgctaataaagacataccagagactgggtaatgtataaaggaaagaagtttaattgactcacagttcctcatggctagggaggcctcataattacggtggaaagtgaatgaggagcaaagtcacgtcttacatggaggaaagtaaaagagcatgtgcaggggaactcccctttataaaaccatcagatctagtgagaattattcactatcatgagaacagtacaggagagctccgcccccatgattcaattacctcccactgggtccctcccacgacacgtgggaattatgggagctacaattcaagatgagatttgggtggggacacagccaaagcatatcactagttttcctttttaatcatatacaaagtatgaatgtttctaaagaggatctttcagtcctctagattattaacctgaattcttagtacccgacttagtgggtcctttacatcctagatagtctgatgtgatgagaaggctcaggaaggtcactgtcagcctgtaggagtgtccattgccaccccagcataccccagaatagagagctatctgtggaaaaccacacaatactccagagaggaaacccatgcctacttggtattcccatcatctaccataacataaaataaaagttttttattctctaatgatagcccattataagtctcccacatttttaggtgtggctgcctagtctagtgccatttcaattcagtaggctcttttttttcgatgcctactgtatacaaaccagagcaggcatttcaagactataaagatcaaagaggaaaataaaagctctggccgcatgtgtaactttcactgtccacagcctgagattagtggggaggaccgtcttaatacaggtgaccctggatgttcatgaaggccgctgtgccttgacctggggagtgctgctccatgacaggatttctccagatgccgaaatagagcgtgactggaaatgtttaaaagaaaaccatgacttcatcctttaatgagagcttctctataaaacagtgaaactaatcccaaagcatagaacagtgcctggtccattaaaagtgctcaataagtagtaattaatcaactaaccaatcagtgggtttagttacatttaatgtttaaatgttttcatttgttttgttttttatatttcctgtaaaacatgaccagctgactttctctattattgtgcgtatcctgtttaaatgttactaattacaattgtttaagaaccacactcttaggctaagatgcagatgggggccgtgggttgggttggaatatgccaagtgaacctcctaccttggttagtaaattaaatccacacctttatataggtacaaattcttacatattatggaacttcacactacccaccagcaggttaaattgcaagtgttgtgtcctagcagtcagtgatctactatagaactatgcttttatttgtaatgcagctagttgttcatggttcagtaagctagagaagtcctggcattattgaagagagtccttttaaaagaggtaaaacaagttatccatggatcagccaagatttgtgatgggccgcttctcccatatctgaactgggtttaatgtgaaaattagtcgtgtttcctctcccttccttagacagctgcctcgttgagtaagacagatgaaggccattaaaataattgcaactaactgctgcactgtgcttactgtcttcaaaggatcttttatttacttttctctggtgatcttcacaagtcagtgagctagataagggttattagtagccacattttacagctgaagaaactggaccaaataaaggctaagtggcttcccaaggtcacagcagctgggagcagaacagggcagttgcccaggatccctggctgggctacttttgctcagtcacccactgctccctttctcacagctgcccaccatcgtcttgtgctttgtagtttacaaggctcttccagatgcttttaccagatttggtcttctctataacactcgagaagtacacagaggaagtgatatcatctcattatgtgcattatccaactactttttttttcccctccattttcatcaggcaaaagctaaagaagaaaaactagagaagtgtggtgaggatgatgaaacaatcccatctgagtacagattaaaaccagccacggtaaatttttagccacagtgcatgacaacagcatcttgcctttgcatcttgttttgttgtatctgtacccttgacattgtcaaaggacatgtctgtcccccattcagatattaactctgaaaaccctgaacctttttttctctgctccctacagttagaccccttgagggatggtttgtccctgcctggcttcctaagtagtgaccatgtgttcatttaaattcccacagatttaaatgtttcgtttattaacagttcttacaatagatcctaaaactcagaaggaacaatttggggataatttcttttctaactgctatatggataaaagcaccataggtcttctgaggggtagatatgaatgtacgagggtttaccagtatcctaagtgaaggtggttttgttgctgttgtttttgattatggtgaggatggtagactaactcctgtcattacatttgtcatttacttttgaaatcatgcatataaacacatgttggaaaatagttacaattctaagttatgaaacctcatatccaaaaaaactaaaccgtgttataggaatgatatccacctcttcactctaggttggagaattggggttttttaaaagcttcgattaacatagctacatctttattgccaaagaacttttttttcctattactctacccaacagattaaaaacatttttaataacttaaagtaaatgtgcattctgcttggtaacatctcgatttttatagctcaactcctttttttatactttataaaaagtaaatctgaaacacaaactcatgtaaatctaagaaaaaaattagctgacatttcatatcctggaattcccagaaacaaacttgatgggacatgaaagcaaaattttctatttcatttccaatgaattttaatttcatttacaggataaagatggaaaaccactattgccagagcctgaagaaaaacccaaggttaggaaatacatttttttctgatacttaaagaacaatagacatgtaaagtatgaattaagataattttgacagtctggaattcactgtgcagacttgcatgctaacctagtacagaggaaaggggaacttctgatggtaacacttggctgatacctgtagctcctttccatatattttaaagatgatcttcctcataaatcattactagactataaatttctaggtaaaatttattgcacactagaaactgatgtcaagagggcccttaagtcagattaagctagcacttagagttccatcctgatcaaattctctaatgattctattttgccttaagttggtagtaacctgtcacatacaatcagcaacatttattaatcgcttgctatgcacctggcactgcaccaaatgctttttggatattatctttgtgagtcctcaatgaatgaggacggtactgttattattcccattttacagtgaggaaattgagacacagagggcctatgtaaatagcccaaggtcaaggggctataaaatagcaagccaagcccaggacttagaactcaggctgtctggtctgagtcccagcgtctgaatcacatgcccttctatcatgttactgttgttagtgacaatctccacatgccctaaactaataccactctcctgaaagaacaaggggtagcagaactttgctgccaaaatcctgcataatcatagaaacggagtatatcatccgtgttttgacttattcagaagagaagtcatgaggaaataggaaaataataatcacatttaaaaaaattatacagatcttcattgtagagaacaggcaattttatttgaacaaaattcttctgaaactgaaacatcaagggaatgtttgaccaaataaaccattaatactttggtcctgaggtgtttagtatttcttaattgtttcatgaaaattttatcttaacgttgataaatgaaaaaatatgccctttataaattagctttgggtgttaagtatggcctcatatgtgttaatcaggaaaaaaattgctccatgaaaactttttttttacaaaataaaaaagagtccccttgtaatatacagcacttcttatattacagcctcggagtgaatcagaactcattgatgaactttcagaagattttgaccggtctgaatgtaaagagaaaccatctaagccaactgaaaagacagaagtatgtttctaaacatataaatctctagttttgaggtttgtgatcttaaaaaaaaattgtgagacagactgttttagcatcaagcagtctgttagaaagcccaatatgccatcgttttttccatgtcatttttgtcttcctttttggatgtgctttctgccccaacctaaccctgatattcttgcaattgaagtcctgcaatgactccttcggaaagctctggaacccatgccttccttcttatcccagcttctgtaactgacctgattggaactgtcaccacccctcccctctgggttgcagtggcctttctgcagtctccttcatgtccgccggactcattctttctcaagcatgtctgtagttatgtcattcctctgcttctatccccaggagtttcccatccctacaaaaaaaagttcctattaccatattcttgacccagttttctttcctaccaaactgtgtccctgtgtcagtaaacagaacaataagtatgtgtgcatccctggcttttctcacttggttcctctgtcttgattgacctttctttctaatgctagatcaactaaagtcttactcatcttttcaaggctctgctgaaatatggctttatctgctgcttttccctccctaagctatatccatccaacctttattaagcagaacacaacatggcagaggatctgtagttctttttttatatatcactattaaagcctttgttacaaagaagagtttagctgttttagtccctctttaactctaacatttatgccaagtttaaatgggtagtaagttccttgaacgaagagatcatatcctattaatgaccatctgctgagcaccttgcatataggataggcttccataaaagtctagatttaaaacaatttgtttaaaggtttgcttctgttttttttgtttgtttgttttgttttgttttttcttgagatagggtctcactctctctcccagctgggagtgtagtggcacagtcttggctcactccagcctcaatcttccaggcccaagcaattctctcgcctcagcctcctgagtagctgagactacaggtgcatgccaccatgcctggctaatttttgtattttctgcagagctggggtttggccatgttgcccaggctgattcaaactcctggactccagtgatccaccctccttggcctcccaaagtgctgggatcacaggcatgagccaccacacccagccttgaaactttattcttgtgataaaataagatgggacagtggttctcaaactttagcatgcatcaggatcatctggagagtttttttttaaacacaggctgctagactctacccccaaagtttcttagtacatggggcaggggtctaagaatccgcatttctaggttcccttatggtgctgaggctgttagttcagggattacacttccaaaacttgtggcttattactactaccttccattcctacatagctgtatataaagtgctcttaggtttatataaatacaatattttacataatgctatattacataataggcatatttgttatacataatgacaaataaataatagaaataatagcaataattgctcaaatgtattgagctaactgtgttcccaggtactatgcatagcactttgcctgcattgtcttatataggcctcttaccaacccttcagatgtggatactgtcattgttctcattttacacatgtggaaactcagtttcacgagtttcagtaacctgcctaaggtgagaagtaaaaccaagttgaaaaaaatggcagctgaagagttttagcatgctttgacttatttactatttagcaatccttaggtattcaagagaatcatgttcacaccatataatgtagcggagtgtcttgttggtctaccattactcagtcttattaaccaaatatttctaaacttattgagagtacttgtgtctttcctcaggaatctaaggccgctgctccagctcctgtgtcggaggctgtgtgtcggacctccatgtgtagtatacagtcagcaccccctgagccggctaccttggtgagtgactccctgggcatttgagcagtggcttgagaaagttttctgcctcctcctgtcactctctgctgtgtattaccatcattttatcttatcctgacaaattaaaaataaaatctgatatcattatagtatctgttgtttctttgggcttcaggggtgtcgtagaaattcagactaagatttaaatttttaattaaattactcccaactgtatttttctctactcttctgaaattctagttcctcagctattgtggataatcctgccttttcacttctctgcatcttttaagcctatatagatttccaccgaaagcccaaagttacttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatcttccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccctgctctcagctgtcttcaagactagtgtggatatgagccctccccagttttttggggtttcagggtactcttcaggtactttttacagcatgtgtgctaggccacagtggtaaagaaccggagaggaggagggactctaggaggactctggtgaagaaagcaggcaaagaggctgtgattggagtcaaaacaacaatagccagcattccccagtagaactcttgtaaccaaaacctgcacctgcaccacctgcctcatctgccaagtgtgactgcccgggctttagagggctcaattccttttcaactttaccctgactgtagagctgagcattggattgttagaaagcagacaaaccagaacaaaacaaaaagctcttgttttccctttccccgtcctcctttccagggccttaaccccaccaactctggccatggttgcccaggttactgtcactgaggcagttggcatttctgggattgtgacaccctcgaacgccagaaagaatagctgtagagtgtaataaaggtcagaggactcaagaaaggcatgaagattagagagtaaaggaagacagaccagaggaaggagatgaatgcgttccctaggtggttcttgtgtgtataaaagaaaatttattaaggaaacccagagacctgagttgtagttgtgaatttgataatatcaaatactacagaaatagaagttttagtccttactcctgtttccagattcctttgttcttaagtctgcttcttctcctaggttttctttaactgtttcagtaatttcttaagcaagaggttggcaaagggcacaggtttggggaagcagtggtttccaaagattctgtagcatagagtatgagaaaacagaattgtagtgtgagcaggtgtcttaaatcatgtagcaactcacattgcttgcataagacttgggtaccagtgcaactcttgatatccttgattagagtgttgcaactcttaatacttaatacttaatttaggtataatcccaaacaggttagaaacctcagggattttttttttttttttttttttttggtagctcttgggaataaaacccatgcagtattcagccactaggtggtgctaaatcacttttctttggtgatctttccttttgcagtgcagtttatcagaaaaacagcttttcttacttgaaatcatggctaaaatataaaacagaaatacagttttactctaaaattttaataggtgctcattgtgaggtcagagattttaataataagattaaactctgagattgtttgacccaaggccttttacatttttgtttgaccaagaccaacagtgggaaattcattgatattgcaaccccatccccatacactggaagcaacagtttaaagaatagtatttatcccttctatgtatgatgcattttatacacacacacacacacacacacacacacactcttacatttttttttttttgaggcagagtctcgttctgtcatccaggttggactgcaatggcatgatctcggctcactgcaacctcaacctcctgaggtcaagcaatcctcccacctcagcctcttgaggagatgggactacaggcatgcaccatcatgcctggctaatttttaaaaactttttgtaaagatgggatctcactgtgttgccccggctggtctcaaactcctgagctcaaacaatcttcctgccttggcctcccaaaatgctgtgatggattacaggtgtgagccactgtgcctggtcctgttctcttcattaaaaaagaaaagtcctggccatgaaccattaagttgattcttatgacctactaatgtacagacgattccctttattttcccttgacaccattcatcctctgtgttcaccagtgtgattttaaataccagcatggccagagttcattacatttgggggagtacatttcattttgaacaatcggaccacaggtagacagttctcactgtgccattcaggttagttggtcacaggcagagtcatcagaaccagccctgaaactcctttggtcagtagaagccctgtggagaaaacaggcttccgagcctcctcttctgagacaagccaggctgtcccacaggaaatggagaggaatggcctcttgtgggctctctgaaaatctttcctgtgccgtctatggaatgatctccataaagaccacgtctttcttttttcctggtatgcaacttatctgtgatacacctcagtccattgtctttcttatttctaaaccaactctgggtcaggtctcgtaagtttcacattatcaacatataatttgcacacaatgtttaatataagaaatttgctcgaatgttaaacgttttgttttttaaacatagattctaattcagttgataactcgagttattaaaagatagcatgtgccttttatctgaaataatgatatgcctttctgaattgatagcatatgttttaaagggagtgattaaccacctacttaatatatccactaatgcactttcagaagggcacagtgccagatgatgctgtagaagccttggctgatagcctggggaaaaaggaagcagatccagaagatggaaaacctgtgatggataaagtcaaggtaatggcaactgagatgcttctggaaaataaatatcattgatcaccttctccccctgcaaataagttagtcatttgttttgttttttatatttcctgtaaaacatgaccggctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttgtttacctcaaatctagtcactcaggcatgaattttatggagagaaaaaaacatgctaacaatgaaaatggtataatttttctcaggagaaggccaaagaagaagaccgtgaaaagcttggtgaaaaagaagaaacaattcctcctgattatagattagaagaggtcaaggtaaacaggctggagtctttttctattttattttaattcatactgaattcatacacagaacaaaggtacttgggaacagaactggaatataaagatcttgtttcttcatatttcaaacaccaaatagtattagtctactactaatagtgttagaacaccagatacaaagctaaaatattcctaagtagacttgatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcgaggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagagaacctatttaacattgagtatagtgttaagttgccccatttcttctattttgaaagtacagattgtacacaacaagggggaagaccccattatgagtcctgtggtttaagtgcagtcacttaaatgaggcggattcgtggacagttgaacaatgtcagtcatctttgtagcaggccaggatttgaaagagtattcaactaaacttcattaacaattctagaaaatcaaattcatgcttctcactcatccatgtgcactagcccatttatttagcagacacgggaactagactgaactatccgtgattgaaagtttattattctggaaacctttatatttgcttcctgagttttacaattcagttgcagccatagcgtttctattaatttgggctcatttgtacattgctttgcaaagttcctagagagcatgctaagggccacatgttctgtctccactgagtgcccattcagtagaggctggtcaagtgcaggtaaactctcttcatgataggtgattggttggtgatttgctctctccctttactgaatttagtagtagtgtttaaggaagcagttgattcacagtccctgatcactttattctgtagtcatttcatcctcctctgacttacctcacacgttattagttacctattaataacattttcaggcactagcttcatctcatttaaatcctatgttggtattcaccagctatgttcccatcaggtctcctcagtgagatttggctccccgagggcaggccacaacctccccttccagacgcagaatgacgcagtgatggaaaatcgatttcagtttgagtagggagcaaaagtgctcccagagtcccaggcatcacttaggaaattttctgcctttacagctaagagatggtggagaacaagcccaggttcagctttcccctgtacctgaagaatggtcagaaggcaaaagtcagtcatgagggaaacaggtgatccaagttgaatatccctcatctgacatgcctggggaccagaactgtttcagatttcagacttttctggattttggaatatttgcctcgtatctgttgagcagccctagtctgaaaatccaaaatgcccccgtgagcatttcctttgagttgtcaggtcagcactcaaaaagtttcaaattttggagcatttaaattgttttcagattttcagattagggatactcaacttgtacctctaaaccattgcacttcacattttcaatgaaacaaaaaccaaccttaaccagtttctcaggtgaaatattcatatatatgtatatctttgtatttacttatttttgtgtaggtggataaatgggatttactattagtatatagatctccttttactaaagagccccgcatgctttcttcattttgtcgtgttactcaaatgtggcacttggagtcataaacagcttgacctaatctgaaccataagttgcagagcgtttcactgacaggttaaactccctgagggcaaggcctttgtgcgattttctgttgtattgccaatgcttacttaggtcagggcttggcatgtagtccttgcatatgagttagatgtgtggcttacaaggttaaccagcattttccagacaacctctacaaagcccacccccatgtaggtaaagggcttatcccacactgtcctgcaaaccccagtcacagcaccacataccacactatgctgactttcacgttttcctgctgtgatagtctctaggcttctgaggtcacaagccatacctcatccagtgtgcagcccccgtgactcaggaatgcctggtgcttgtgagctgtttgttgccatgaactaattagagcgtattctctggtgagagaatccttcgtgacatgatggatctaatttaaaatgtacaacagcaagtataacctgtagaccctttgtaatgtttacaaggtttcatactttggataaaatgtaaaatgatttcatgccatgtgttttcccccccggataggataaagatggaaagccactcctgccaaaagagtctaaggaacagcttccagtaagcaaaccagttttctctgaagatatcttttccttttggccctgattgcaatggtgtttgttgatacatttcctggttcttgcagcccatgagtgaagacttccttctggatgctttgtctgaggacttctctggtccacaaaatgcttcatctcttgtaagtccaaaactcttggttttatttctttagttttttttttttttttcctttgagatggagtcttgctctgtcatccaggcgggagtacagtggtgccatcttcagtcaccgcaacctccaccttccagattcaagcgattctcctgccccagcctcctgagtagctgggactacaggggtgcaccaccacacccagctaatttttgtatttttagtagagacgggctttcaccatgctggccaggctggtgtcagtctcctaacctcatgatccgcccacctcggcctctgaaagtgcttggattacaggcatgagccaccgcgcctggcctatttctttagttttagagtggcagaaataaatggaaactggtgacttagaatctgacttgggaactcaggaacaatcataaaattaatggccctcaacccactgtagccattaaaaatgtgttgcaccatgaaatactgtcccaacatagtggatgcttttattagtgtaactaatatcaagtaccagtacccctatgaaaagagaatttaaatgtaagcttatccaaaattactcctcagacaactttacctattgatatttctacaatttatcatttcccaaattgcctcctaagggaacttagctccatgtggaatatagagtccctcaaagggaactctgttactcgaaaagtttggacaatattgggtaatgttaagcaggtttctctactgtaggattttcatggctttttatatgcaaatatatagtgagtctgttagagttcccaaacttaataactgcagaaccttttcttgtggggtctggtttatctgtttactgggaactcagtttttaaaccactgaatgtattattagcagtcagttggaaagggattaacagtttctatgacagtggcatggaaaatatatttatatcagttggagaatagacagaatgacaactagaagaaataatgattctttggaattgcctgaagttgttacttttgctgaatgaagcaataaagcccctcaaagaagagcttactaaccagagcatgttattctctgtacccctgtaaaagcaccgtgctgctcagtcacctcatcccgtgaccttcctctcatcgtcttccatacagaccacatcacagcaaagcactccagccttgatttagaaaccataagacatggggaagaatacaatgtgaggagtacgccaggaatgtggagtcatagcattacactgaggcagaacagatgaacaaatagtggggaacaagatctcaattcccttcctcctcctatcattattattattacaattgttaggggtgttttttcttttagaaattcaaagatttggaaaaagtaacaatggatttatatgcccccttcaaagatatgtagcagtgaaatggtgagatgaaacaacctttaaaaaaaatcttactcttagaaaattagcaaaggaaacattagtgccaacaatatagttaataaagtagaaataactaatcatcatgagaaccaaataatcaaaatagttatttagtggaaagtttcaagaaatttgggggagaagtatcacatatggctcataattagtgttcatctgtaaaagagtagctcctgtacgtaccatgctctttgatataatagaacagaaatgctatataaaaagaaacacttaaaactattcccctaataatactgagatcacattgataatagactattttaaaacatcaaagatattacaagaaaaagtctttgagaagcagtcaaagcagtattcctgtgatacattgtcataaacacctttatcaatagtagagaaagagaaaaagagaaacctgataaactaaatgcttattgaattttaaactgaaatttctaaaagttttaataaggtagccaccaaaaacaaagtagcaataagcataccaggaaatgaaaatagcggcatgaaagttaactggccaatagttgtttcttttgaaataacaaatactttataaaatactagcaaatataaaagaggaaaaaaaaccttacaaaaaatacaattaaattttaacagagtaatataataatatagagatcaactaaattattggtagtttaaagccaatagtcagttggcttttatgaatttttaacattttacaaaactgataaatagagaaaataatcttactaataaaatttaacataaatgtgagaaaatacaataatcagtacagagcacaaataaattattaggaaacactatgtacaacaattttctaagattaaacaaaaatattaaactgcgtaattcacaaaacctaaaaaaagactgaagaaaatattgcaatgattttcaaactgtccttctactgaaggtttaaagatgactctaactgttgaacactcagttcttatgtggcataaatatgtcatgaaaaagatggggtcacatagttgcttctatgagtaattatggtgctaatcttaaaatctgacaaatataacggtatcagctaaagttacttaaatgtgtagatgtaaaaattacatacagcatacatagaatataacaaacagttaaattatttgccattataagtattgattcagtagcaggaaaactgtcaatatattgtagtggtatatcaaatagaaacaaataatcatgtccatgtaaaagatctatttaaaattttacatatactcatattataaataaaaactttttaaaaagtaggcaatcccctaatctgttaaagagtctttagttttcagaatcaaatattcaatatcatgctggaggcattttccttaaaagcagaaactatgaaaagtttattgtcatttctgcttattatcacatggaagaatcattaacaacacatgaaaaaaatgacaaacattaaaagggaacatttgaatatatttgtggatagcactacttgtagataatacatttgtaagtaacattatgccatgtttattagtaacaacagatgagaaaatgtaattaatatgagatcagacttaatgtaaactataaaaggagaaatgatcagaaaaataaggacacaaaaaaattgaaggccatacattaagtcagtttaactaaatatcttaaaaagaatgatgacaattcaagtcattttatgtgttaattttttattaaatagcaataagatacttttataactcaataaaattattcaatgatacattcggaaaataaatgtataaaatatgaaaaagtactaaaaagcatttttcagtacttttaggtaagattaatccaactaaacactagcatatgttatacagtaataataagtggaaaatacaataatgttgagaaagcaaactcaaagcatagatcaatgaaaaaattgagaaatggacataaatgatttagtatttttaaagagagtgaaaaatcattattttatgcttttgtgtagcattagatgaattaaataacatatgcacatatagctttgcgatacaaatttccagaccataggttgtttcatacttagtattaaaaggcttaaataataagtcaataagatagtttaagaagagacaatacaaatgtttcaatgtcattcttttcatttgacaacttgttattcttttcatttgtcatataagcaaagatttctcataactaaaaatgaatttaatttagtacattttggattacctaaaatattacattctaaaacggctttacagggtataaatggacaataagtatcttatagttatctaaattagtttaaataatttccaataataacatgctgaaatgaatttctgaatgttggtatctttttaatgtgcttttctccatcttttggtaaaatttgcaattctcctttttcaaaataagctatccatagttggagtcaccaaagagttctggacttttttctggtttttcatcaacagttatacctaagtttttttgtcaaaagggagtatttgaaatgaagcaaatattcaatatttttaaacagaaattatttcagaaagtttctagaatatttaacgttgaaaaaaaaccctgaaacctgacaccgtataccacaatatacaagcaatagtagtatatcattttacactgattatcataataaaagtcaaattctggcaagcaaggccatgggaaaacaggcatgcttattcattgcttttcgcagtatgaattcctagcaacatttgagagggcagtttagcaaaatatagccagcaccataactcactcactagaacttattcagagcaattttaaaagagctgaaaactttgaataacctaaatgtacaacaggaaatgtgtaaacaaaccgtggaactctaagttatattattgcatagtatttagaataatcaatatgagaaggaaatagaaatagcaaattgtataaaataatacaatagagaagaaagaatttaaatttcttttaaaattatatgttattatgagtctatttggtcaagagaataaacagtcattaagctatcgttaagagttatagttaagtgatggcattgtgctcataattttatatacaacatgttactaataaaatttttttcaataaaagaaatttgaagatgctaaacttgctgctgccatctctgaagtggtttcccaaaccccagcttcaacgacccaagctggagccccaccccgtgatacctcggtaagcagcacatcttatttgggagataaatgtttttgcgcagccacaactagaaagaaaatagggcgcctgtttaaagcaaatgaaaataggcagaattattaggaagatcaggcaccttctatttcagaagagccaagactgatgatttagcgagatggcagagattaactttgaaatgattaaatgaaactatatatgtgaaaacattgtacacatagtcaaggaccttaatattattgttgctttataagaattgaaagtgcaataaagtgcattgtgtctatattcaaattactagatttgaaaagttctttagctttcctgataattgattttctcctttatattttttcttatacattctataatttactacccattatttaacctcaagtttattttatggaatcgtcatgtttgagcttttacaaacattttacaaacgtcatggaatagcattgttttcttcccaattcacaccagtaaaaatttgtcactttcatactagcagtagaagaacctcagcatcaatattgttttaattatttacatgctgtgaggcaaggctgtgggaccaaagcttttccagacttccttgactaatcacctgtgcaataccaaattatacattaccaaggagaccacagcacatcaaattataaagggattgccctaaaccagatccccatctcctttggttgagaacagtgcctcatttgctagatggagatgaagtaactttagcgaagtcagctatgcttccattccgtttgatgtagcatcaaagcatatttagtgctgtagtctgagattctgatggattttcatcctgttgcgtcagcttcaggatcatctgaaaatatccagaggcacaaatgacaaagcccagacctggccccgggcagctctaccattagcagctataatcctggattataataaagcacttaaaaccagtaaaatgccccgtgtgtgtgtatgtgcatgtgcatgtgcatgtgtgtatgtaaacacacccacaatgaagaaagtccccatgcaacagaaaggaagaatcattaatagcctaggctgccgtttacacttcagttcttaatattcaggccagagattctgccctgatgaaggctatcagtaaacatttgcaatcaaaaacttttttgcctttaagaagtaggttttacaatgacacttctctgatcacatttcccatcagagaggcttgtttttagttaacattttatttgaagatgtcactaaaacaaggtataaagctttatttagataaaaatattaggaaatcgaagagtcaaataaaccatgataattcacgggagctttctttgctgtgattattagattgttactaacagtgttacatacactgaaagcatttgaagacatgatttcaaagatctgtgtaataaaatcactccaacaggaaaactgcttcaaagaaaatagaagatcatggatgtgactaagcatgacagggaaaagctttatcagtcccaagacctgggttctattcactttttaacaatttgttttcaagcaactgacttagcttccctgagctttttacctcaaaaaaaaaaaagcctgcttagttcactgagaaccattgtgggcatcaaataaaactggatagtgtatgtgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatcatttacttttctcagcaacttaggagtataagtactactattattcacatttcacggccaaggaaactgaagctgaaaggggttaaataagctgcctgaatcatacagtaaataaatgttagaggaaataagctatcttagttacagtgatattgttgtccataatttttttcctctagaataccagctcccatttctgcaatttcacttccatgagcttcctgaagatgaaaagagaggtttccccaccagttcagaaattctctgaagtctttcagggcactcatcaccagtgtggcagacaagccccttccactctcctgaccccagattgtctctggggttttgtgctttaggaagtattaggatggcagtgccgagctccatggcttcccacaaactgcgggtcacgctgcactttctgaaatgcacccctcaagatcttagagttttagagaggacccacagaaccaaagaaacacttaccctctatagttgcagaatcttgcttcctaaccatctgacaacattagtagatgtttgttttcatatccagttttctaatggtgtttaatttctaaatgaaaggcacacatgattggttcatttgcttttggaccctttatgtgacctccaggtcacccactggatatggctcctgaggctgccactaagacctccttaacctggtgggatcttcaccaagagatgggcagggttgggtggaaggtgctggccctccaaccccagtagggtgacagatactgccgctcttctcctgatcttccattcctagccttctcttctctgaccctgtctactcccctgccccagccccagatgtctttttcttccaaggaaacaggttccctcctgaaaagatggagttcctgggctaatttgcctctgatacagtttggctaatgagtgactaattcagcattatttacttttcagcagagtgacaaagacctcgatgatgccttggataaactctctgacagtctaggacaaaggcagcctgacccagatgagaacaaaccaatggaagataaagtaaaggtaaaaaaaaaaaaaaaaaaaaaaattcactaataagtgaaattttaatccttgggtcttgactctgtcattgtcataggaatattgatgtgaacttaacctatattttaaacatgaaattataatgaaatagaaaaatcaatctgtactccactggaggggaaggtcactgaatctgtgacagagataccagcggagcctccctgaggggattctgggaggtaggtgtggggtatgcatggcttcctcccatgcaacacaagcagtcagcacatccattcaaattagctgttgtccttcagggttgcttataaataggcaaagttgtaaatgtgacctctctaaatggcaaggtacagtggcctgattttgtattagaaaagtgaaaccatacagaaaaaaagaaaaagatattttatacctttgggttctaatctcctaacatggtttctgaagataattatttaatcatttatttccatttaaaatatagctagaaaattcacagatatgaattgacatacagaagcatacgggattttatattttagccaactagcagtctgttgaagtcatctgtgttgttctgttgcttaaaaaataaaaacagaccatatgttttgcctcatgaaagtacaacaaatgctgaatgctgcatttgacaatgtattttctaagtgaaagaggaaatgaatattaattctatctgctcactgttgatataggaaaaagctaaagctgaacatagagacaagcttggagaaagagatgacactatcccacctgaatacagacatctcctggatgataatggacaggtaaactgaggcaaattgctagatcggatttatgctaccaagatctttaaattcaaacctcccttgaaataaatagtagctatactcctttacagtagcataaaacatatcatgactgactgcttctaatgtgtcaccaaagccgaccagcaggtaaatatttatttgagccaatatcattatatatgcatatgctaggctctgtggtataaacagggttgaatactgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataaggcagctccaagacctggggtctccctatcttctcctgcatcatcatcagcactattgcaagtgaagacaggcaaagcaatattcccaatcacaaatcctgtttctctgccaaaaagtccctggccttttgtctcccacatgatagaggccagtctttcgtaggtcaaccaggcctgtcccccacctctttcctatttagtttctaatttttgagtcaattagatgataaataaccctttccatgcctgttcatcaaataagaaacaaggaagaccaaattacacccttctctttctgtactgattcattttggtgagtaagatgattcctggtttaaatagcagtgtcagcttcagggtctcctattacaggaaccaattctccttgcttgcattcagtattcctcaagatagcaattccacatcctgctagagcccttcccactttgatagtaccaactcaccctgcttgcgttctttgggaaatttattatttaaggcccttgcctttgaagctgggaaaaatccctgatgactttctaagtgtaataagctatagtaaataagatgtaaaaacacaagtaactttttataacactttaagtagaattataagtgataatacatgatggcagaaggttcacaaatagtgtttctttcacttccaggaccagaccctttcatatgtttcccccaagtctacacaaatgattataaagaatagtaattaagcaaagctggtaaagaaatagtggggactcaggtttattagttattgcaagtctacactccattttatccaagtcaagtcatgggacaatagattctctactgcctaaacctaagtaaacctttacagatatctatgcttaaccaatagtctgccttctttttaaggacaaaccagtgaagccacctacaaagaaatcagaggattcaaaggtaaagaccataggaacatatttccattaaattttgttttattctagccataggggtatttggcattttagaaaactaaaacatattgaatgcctactctgtgcctggtactttgtcaaagcatgcatataaatgtgtgtgactattgtttacctctcttttagtcttcacaaaagccctttagggtggaaaactgaggctcagagaatgctaagcaacgtgtattaaagagtagatggaaaaaaagccatcaagattttcttgtttttctatctcctttacaatacattattattaataaagaatgtcagtcagtttttttcttatagaaacatcttttatttgtaagtgatgtgggaaaagaccccatattgcattttgccttctgcttcttcactgatggttatttctactcatatctcagaaacctgcagatgaccaagaccccattgatgctctctcaggagatctggacagctgtccctccactacagaaacctcacagaacacagcaaaggtactgtgctttttcacatttcactctttgaaatgtgtgtgtgtgtatgtgtacatacatataagttttatttattgattgatctatctatcggtctgtcttgtaacagggtcttactctatagcccaggctggagtgcagtggtgtgatctcagcttactgcgatctctgcttcctgggctcaagcaatcctcctaccttagcttcctgagtagctgggactacaggcgtgcaccaccacacccagctaatttttgtatttttttgtagagagggggtttcgccatgttgccaggctggtctcgagctcttgggctcaagtgatctgccaacctctacctcccaaagtactgggattacaggcttgagccactgcgcctggcccttacaatttttaaactgtagaatgaatcaaacgatgatatagagaacctgaaaatgaagaaaagaaaaaatgcctataattccactgcccccaaaacagtattattttgtggatttccttttttttctatatgtatattttacataattatacttacagtccacttataaaacactgcttaacgttatttcttaactgctactttgtaatttccatagccaccattttttatctccacactatatggttgtgccacaataatgctatgtctgtgttcatttaaagtgagagcaggccctaactacatcaggcactctcatgctcatttgctctctggagcttcctccccttttctgtctgcttagcccaactggtctactcttcattcctcagggcacagctcaagcatcagctccttagggaagactttcttgtcttacatcttctcccttcccagtccaaagttagaggcctctcttccatgccctccttgctctctgttacctctctgtgcttgtgtatcacaccactgagctacgcatttcatacagtagtgatgtgtcttttacctctgtgctcctcattagcaaaatgcctggtacttagcaggtgctcaaaacgtgattaaaagtgaatgagaaacaactgtgtaattcaacaagtgtgaggcattttccctcaagctacaccctcttgtaaatcaaatagaaggaaacgtgaaatgagtacctccttgttattttcagaagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttccttggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctattttgtatcctttgacctatatctctgtttcctcctcctgttccctaccatggtcgccatgttttattctctgtgtttttgagctttttcttttatatatattctacatataagtgaaatcacttttctttctgtgtctggcttatatcatctagtataaggtcttccaggtccatccatgttgtgacaaatagtaggatatcgttttttaaggctgaataatattccattatgtatatatacatgacattttctttatccattcatcaacaactaggttgttccatatcttggctattgtgagtaatgttgcagtgaatatgggagtgcagatatctttataaggtgataatttcatctcctttgggtatatacccagaagagggattactgggtcatacagtagttctacttttaatttctttaggaacctatatactgttttccatcatagcccataccaatctacatccccactgacagtgtactagggttcccttttctccacacccttgccaacatttattatctattgacaagctctgttttgattagcaaaataaggtctgggtgagtcaggcaccacgggaattagagcatcaatgtcacccacatttccctccttatttctatcctttttccctcctgctttaaacaattctctgacaccgttgttcaaaaaaaatcatgaaaaaacacccaaagtcttccattatttaattaaattggagatctcagaatggtctggattaatttaactgcagcctagttaattgctagatggattggtgatagccatagcctcattacatttcctttgctttaggataagtgcaagaaggctgcttccagctccaaagcacctaagaatggaggtaaagcgaaggattcagcaaaggtaaatggagcagtaaatatactacaaattagtttagcagttacacagagtagggtttatcatttcagtcatttagtttcctactggaatctatttagaataaaatttcttaaagtactatctatcccatagcatcgcttggtaaagtaattgaatttgtataaatacatatatttttaagtaactggtgctttaaaatcctaaatgaatgttcttgacacaacccaatttgcctgtgttttgcctgtctttcttgccctaattaaaataccaccatagtatgtggtttatatagattttagaacatggaagttggaaacttcctattattaaaattactcaagctgtgatgagaaatgaaaattggattagacaacttctaggtcccttccaattccaagaacatatgatttaaatgattattactatgatcccctggctataaggaggagttaaaggtgtagctttaaagacaatagtccagttacaccaaagcttttaaaacaatatattaaaatcttcctgtagtagattcccttaagggatataggaaacagcattgataattggcagttatgccattatatctcagattaaatacttatttgcctattatttaatttcagttatacgaagtacttaatcagccctttaacaaataatagaaagcataataaccctttatgatgagtggatttactggacagccatgaccctatgtacaggaaaggaaggatcaccacagaatgaaacattgccatttaagaacacctatgcatattttataacctaccctagccttaaaaaaataaagctgagagtgatacatttaggatcaggatcacttaaggttatttttagcttataagcttgaggaggaagaactcacaatattttggccagatgaagaagagaaactgaaaggaccatcttatttttccccactgactgccatcttttgtcccctaattctgagaaggccatctcctcatacttaatacagaaaagaaagctcacggatggttttgctttcccttttagacaacagaggaaacttccaagccaaaagatgactaaagaaatacaagttaaggtatctggtaagttgggtgtttatttgtaaatgaagacaactgtatcttctgccaatttatgtgttatagatgagagaagtgaagtccacctcttgagtaattcatgctcactttacagtattggcatgaaatgcatactgcaagatctacagagtaattggtcattctctgaaagcactaaatgggatgagtttgctattgaaatgtttaaaaaccttaatcttataattaaaagcttttaaaaatattaggccaggcacttagaatgaccatctgaggctagttgaatctttgaaatccaaatgctcattactgcaggttattgtggcaaagcaaaattagcatgttacaacttagcgaaatgtcctgaagatattggcattccccagaataccaatacatggtggggtggggagaagtaccctttagagtctggtggaaattacagggttttgggaacaagggcaaaggaaaagattggccatttttatttgtcattattttggaaagtaaagtactgtgtttgattctaatttataattgctgaagaaactggacagattgaagggatttctgagatcttcagaactgggcccttatcttaatcttcagaaaggagagggcttaatgtaagccttaaaagcatacaagcacttactgaccaaagcctaaaagaaatcaaagtataggttaaatcgggttcagctctctcaccatgatccatgtttatttcctaggaaaaaggagctatattaggtagaactgctctaacatttttcccaaaattaaaaaaaattctattaatccactttcatgtttacttataggaaattccttctgtctgttatacaatgcttttgctaagtggtatatttactatgtctgtaacaagaaaattacatattaaatgattcactgcattttttatttgaaatttttaaggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcatctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggcc

SEQ ID NO: 738 - DNA, 197337 bp, Human
  misc_feature (1)...(197337): n = A,T,C or G
cgctgtgtaaagaaatacccaaccatagacacggcaggaaggtgcagaacatgccccttgaagtaggggcggctgctggttgggtttcactcgtgtttcgaagaggatggaagcgctgacaaccacaggaggaatgcgtcatgggttccaggacagcaactggctggacccaactctgggctgcctagctcccccagccttcacaattcaactcatgccacctcttacaggaagtcctcctggatgcccagctctggagtcatctctgtggtatactaggattccagttccaactttctctggaaccagttgggtcatcacaggtcacgagagcagatgcctacagagagtgaggagaggcgggacctgccacaaactgcaaggtaagtgcccatttaatggttgctaagcaggactgtggggctagcgtggccacatcttccaatatctcaagaaaagttaccaatctaaatttccatgtgacatctcaccatgcctgggagctggatccagcctcgggcacccttaggtgacacagaaagagtacagcttgcaggtgaagatggctgtccagctgcgatgctctcacacccaggacccacaatcgaaagaaccaaggacgtgagatcacagttagagcctgctgtgtaagtcgtgtttcccccaacgactgggacctcctggccagcagggagaggcctgagtcatctccgggtcctctgcccctggccaaagcaaagaccaaagccctggccacacagacctggggcagggcaaatgagaaaatcaaaggggtgggtgttcaccctctggggaagtgaggcagaaattgggggtcccagggcagagatgatcaacagcctgagagggggctctcaggcaggccctggagagaggccgctgagctcagacagcatgggaggatcagggccttgctggagaggagggactggggaggggttccggttggcaacgggctctaacagcaaactggccccagaatgggcccaggtgtccttggatgcttgggtggaaaaggtaggcagagcttggagaggccatttcaggttgggggccgggagtgcaatggcgggaggacagaatgcatacgtggggttgaggacagatgagggcaggagcctgactgtgctcatgggcagagagcccaggtctggcaggaagaggctgtgctgaggctgcagcggagggatgggaaggcagatgggggacaggggacagggacttcagaggaagaggaactggggactgaaggagccttgcctctctcagtaagggcaaaagttgatctttggggtcgcgccctgggtgtaccctcctaacagcatcttctggcctttgcggcctctatttgggcattcggcctggctcagaccttggacccagtagtcagtcccccctcccctttcattccctcaccctgtcctgccccagagcacagagacagggggatgcaccccttgaattccagggctgatgggtgggacccggcaccccaagggctctctaggtggggacgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgcctgggttttggaaaagggttacctgggagtcccttgggagggcaaggcctgcgctgaggactttccgcgcccttcccgtgctttagtgagcctcgtgctccaactgaagggcttggctggaaagcaggttgttttgactggtctgagcagggggccatttatgcatggggagcgcccgggtctccaaaaggctcagcaggcaggagcgtgcgcctctctcttttgcctgcctgaacaggtctctggcttgcatccgggggtgggtccgtgtatgtgtgtgtacctttgtgagtgtgtgcacatgtgttgtggaacgttggtgtgtacctgcatctgggtgcccgtgcacctgtgtgaacatgtgcgtgtgccagtgtctcttgtgcacgtatgtgtctgggtttctgcacatcagtgtgttgagcatctgttgagtttgtgtccgtccttgtgcatactggcgtgatatgtgtgtggtggacttatgggctggcagtcagtcttcctgtttccttgcgtgcgggtaataccagcccagggagctggcagtgatgctgaaatgcccagttagccctctgccccttggctgaccgggaatcattggtttttctgctgtggtttcctgttgaactccagctggttctttgaaaagttggttttctctattttgagctgaggggtgcatttggaaatgaaggctctagtgcccatgagctgctcgatcttttgggggcagcgcctgaaggacaagagagaggctaggggatcccttttgagactgcctgcgcctctctagtcctgtgactggagctctgggaagctctgcttcctggagagggcaggagggaccgtggctcagcacaagggggcctcagaggaagcctggatcgatgctgagggaggaggctgacattggcggtgctctgtccggctgcccggggcctggcacacagcagaggccactgcagttttctattttggattgggtgtgtggtggtcaggctggctgtgctggccagacatctgaagccgcccaccatgggttccgctctaattgctactcagggaactcctgccccgagtgagtggccactctcccagcccccgtggcccctgagcacgcccgtactcgggcagctgaggctcatcctacagtctgcagagccggcaattacaccagggctctgcaaccactgtcattctttttatggagacacagaaaatatcacttgttgctttggaaaatcactgcctttggctggatttagttagaacttggccatattgcaaacaactgtaaatatccctggaggagctgggttaaaatggtgagcccttgacatcgcccactgtctctgaggacatcctgggcctcagaggtgtgtcccattttacgctggaggttaatttcctaaatgaaaggagatgtttgctgcggacttagggtgaggtaaggtggtgggagttgacatggggttgcagtctgttggtgggccaacacctgtgtactatgcattcctgatggagagcattttggggaggacttgtcactgtttcattcattcagcagttcatttggtgattcatttttcagccagcaccttctcatatgtttatcccctgtactggtcagcaatgaggcaggtctggtacccacccagggctcctgtcgtcagggtggctgacggacactctggccaggacttggagagtgtgctcctggggggctgtttgaatgggggctggaagaatgagtggccagctggaaaagacgcaggttggcaacccgggcagagggaggagcgtgtgcagaggtaccaggtgtggattggcctgggcaggacaggcctgctgaagtgtcccatgtaccagacagagctgggaagaatattggggttggaagaggagctgggacctgcctgagcggcattgaatgctgtcactgaataatggccttggacagtgggacagcaccattggttctgttttctttttttttttttttttttgagacggagtctcactctattacccaggctggagtgcagtggcgcgatctcagctcactgcaagcgctctgccttccgggttcacgccattctcctgcctcagcctcccaagtagcagggactacaggcgcccgccaccacgtgcagctaatttttttttattttttttaaaatttttagtagagacggtgtttcaccgtgttagccagggtggtctcaatctcctgaccttgtgatctgcctgcctcggcctcctaaagtgctgggattacaggcatgagccactgcgcccagcctcttttcttttcgcttgtcctctttctcttctcttctctttccttccttccttccttcctttttttctttctttctttccttttgatcaggctggtctcaaactcccgacctcaagcgatctgcccatcttggcctcctaaagtgctgggattacaggcctcagccaccgcgcccggcctcttctttccttttctgactttgttgctgcgtatgtgtctgtcctactgttaaatccccctctgctgccaccacgataggcttctttgctaaggacctgggtctttacacagggcacctcttgtcctcacagagccctggtcggggaggcatctcatccctggttacaggtggagcactcaggctctgggaggttgagtgactagacggaagttattcataataatatccacagcgaggggttattcatagtatccacagcaaaatgtccctttgcacaaggcatgagcaaaacaggctgcacagagtggtgttgtgcctcacgttgctgcggaagagttttccagtatctcctgggcagcgtggtaggcgtgctaatttcacgtggtttttacatgcccattaaaaacccagtgagaagccttttggcgtaaaaggtaatgatggtaagtgacagttgactgtgttcctattaacattgtgtgccaggctctcagctgagccccctgtgccacctcgccttgtttaatcctcacagcaccctacggaacatatcccgacatcatcccccttctacagatgaataaactgaggctccaaaagtcgagatagcttgcttcaagcttcgaagccagtatttgaacacaaatctgattccaaggccatgctcactatgttttgttgccttttcctgcatgcctacaaaaagaattttaaaaatgcatttctttacaacatttcccacctttcttatttgactcctggagacgttctcattgtgggtttgaccatcgtcagtgtgagtggagccgggagcaggcctgggagctgagtggccttgactggctcgtgacctgcgctgggctgcagctcctatgggtggcctaagtcctcactggtgggggactgcagctgggacttccgtgggatggaagcaaccctgcccgcctctgcctccccactcagggcagcacggggatcctctcctgccaggctgggcagcagtggatgaagcctccatgggctgggcggtggagatggtccgccctccaaggcctggtccaatcctggggcccaaaggaggaagtgtatgcccttccctggatgcttgatgcgaaccccacaaccctgtgagatagggctgccccactgcgtggctgaggctcagagagacccaaggttgcatggcaagaagaaatccagggctgctgcctttcaggctggggctcccctgcggggctgctgtctgggccaggcacccactctgtcttgctggacattaagagtcataaaggccacagagagaagtcagaagccggcctaagggatcgagatgagtttcatttttcccagcaaggctgctgccttcgaggccacacactgggctccagcaggctcaggtgctagagcagatcaggcaggtgtgagcgggtcctgggactgtgcagtggggtgaggggcacctgagatttgcagctgccgctggtagggtcttccttcctcccaccccaccttggcactgcctggatcgcaatgagaggttgtcaggaagactaaagaggggctgcaggaacctctgggttccctagggtgtcggggctccccaggtaggagcagaggctcctgtgggccccagctgcaagcagcctacacagctgctaaggccagtctcagcctccgccatacttgtcaccttaagacttgctcagtttaagtgacagaaacccctgctcatattggatgaaacaaacaagggacagcatggccccaattatctgggggtcctgaggagtgttggcttcaggcctggctgaatccaggggctcagagcatgctatccatttctcagccctgcctctcagtgttcatttcagaattgctctccacccctcaacccccggcccaccagcggctccaggcccaactcgttttccaaggaggcaacctttgagatggaaagccctcctctctgggtgacacctgtgagagttgggggagggattggaggcccatcttcaaacccatggctgtgatgcgggcctagcccaggtctcctgcccacctttgggactgagggggagggacagactcccaaactctggaatgaagaggggcctatcatacaagaagggaggagaattgtgcagggtggtgaacacggttgtggccacccttctcctggactccagaccccatgttgggcttagaagtcctcctgggctccaggcttgcctgctcggctgcctctggaacccccttccctggatgaccccatactcaagtcacgtggctctccccactctcctccagaccccacccttccaggatcgccctcccctagccagctccaattctagagctctctcagggcccggcttccctccacgcctggtgccaacccctgctttctgctcttgtaccccccactgccccatggtctctccccgacaacccttctccactctgcagccagagggatttttagaaaccatgcagcaactcatgtcacgccttcacttaagacctctcagtggttcttactgctcttaaaaacatccaaacccactggcctggcattcaaggcccccgtgacctggtcagggccctccagctccggcctgagtcgcctgctctgctggtctggaatgagactccgggagaaagggctgcaggaggcagaactccagcgttcccctcaggtgcccctgggagggtggggcaatgactccctcccctgctgccttacgtgagctgagggcccctacagagatgcctgagggatccagcagtgcagcgcagtccctctggaggcggcggccagcctcaggagggggtccggggagcagcatccacaccatctacctctgcctggggctttgaacccagtccctgcggttttcctgtgagccagccaccgtggccccatttcacaggtaggaaaccgaggctctaggagttacatatgcaggttctctgtgtgggctggcgtctctcctggaatcctttagggaggggcagagtggagccggctcccagcccctcatgaaggccggcatagtcagcactggtctcagccggagcccaccaaggccagctctccctgggagagctgcactccattgtgtggctgggtatgtttctggcactggtaaatgtgcgcggccatgtgctcattcaggtgtggcaggcttctcctgcccaatggctcgccgtggcttccctgtcccccatgtctccagtgcttagcgagtcatgcctgagtgaatgcaggccctcctgcagagtcagctgggaggtgaaggccaggtcctcacccaggcctgctgtgaggctcacaggggcctcacctgggtgagtgagtgaattcaggccctcgtgcagagtcagctgggaggtgaaggccaggtcctcacccaggcctgctgtgaggctcacaggggccacacctgggtgagtaagggaatcagccagggacatccgctcagcagcgaggctggctttgcctcgtggctgcctgagctatggtctgggcctgcccactgtggtatctgaagacccaaagaggcaagtgtgcatggcagccctcctgggaccctgggtctgtgctggcaggcagacatgtccttctttaccccacctgcctctctggcttgggcagccctgggggtccctgtgttgctgccggcacagcaggctggtggctgcatgtggacgtgtgcgtgtcctgggcctgtgcatggcgggagtgtgtgcatgtacgtgttgcctctgcatgtcttgcatgtaggagtacgtgcatgcagtgtgcgtgtgggggtgcatatgtttgtgcacgtctgaatgagtgtgtacacgtgtgtgcacatgagtgtgtctgcatgggagggtgtgcatttgagtgagcatgggccagcatgtgtttatgtatttctcgggaggggtttcctgcactctgtagaagaggggccttaagtggggttgaggtactcaggggagaggaggaccccagccccctcaatcttggcgccacgttagacacccccatcccctactggtggttaccccggaatgggaggatccaggtaggagctgcacactctgctgcgtatgtttcatattaaatatcagctgtccacagggtctgcggtgctgccattaatatggagaagttattaccgagcccggagctggctcctcgggcttgtccatgaatttcaattacactgcacgacgactccagggctgcagagtggggtgcacagcttccgctcagaggcacagggaaccctagtgtccaggaccaaggcctgggtgctgctgaagccaggcaggctctacgccatccccaccctgccttgtgcatttcacgggttaacccagggaaggcaggggcctattgtgggctggaggctgttgcgggtcacatggtccgctgtgctcctcgtgaccggcagggcggacaagcaccacgatcctgagaaccttagttcctccaatagcaaaagatgggttctgtccgcacgcacttcagtggcagtgaaagggtgggtgtgcagcaagcgcctaccccaggcccgggggtgagaaagcggtggccgtgtctgcatatcattagctctaaggtgccatcggttacaggacacaccattactttatacgccaccaagaaagaggagacactcccatttaaactgcaactctgtgccttgtggttccctggaggcgcgggccccactgccacagtgcttggtttctctgatgctgtctgcagcctaatgggtgggccatttctgctgcctggccgtcgcttgtcacggctcccgggaactgagttcggttggcttcgtccgcctccgggggtcttcctcttgtgaattacgaagtagcggtccttcctccagggataggtatttgcctcaccaatgcaaagctacatgcgcctttctgcgtgcaccctaactttttgacctcacagcgtgactcttcaaagacattttgagtgtccagggtgttgacagtgagggactgcgttggaagtgtcgtggcccaggaggcgggggccagggccggggcctgagacccgccgattgcatcctcagttcaggggttgggaaatggaaagatgcgtgttggagggaccagccctcaccagctctgtgcagaatgtccgggattcatctttaaacctgggtatttttcctttgaaagccctaatctgaaatttcaatgtattaaaagtatttccaagtgttaaagcctgtcatctttacacccgggtatttttcctttgaaaacccctaaacgacaaggtttggagagctttgggttggtgaacaggtgaggtgctgggagggtgagtgcccagagagggcgtggaggctctgcagcccttcccgttaccttgccctgcccatccctcccacgcggctgtttgaaagcagggattgggagcacatggaaagtagggtgtcttcacgtttcatgcaaggcttgtctaaggcttgctagtggccattctgattgggacagagcttctggacatatgatgaaaaggggcttgagagctgtgagcatattggtatgtatttacatctgtctattttatgggttatagtacaccatcgccagtcagttgcaaatgaaacctcaggttaagcagtaccgcagatacattctacttttccatctttctgttcttgtaccaatattaagctgtgtttattattagaactgtaaggctctaatagtcaaagtattaagtactttgaagctttgctgtccaatacagtagctataagccacacaaggctattgaagacttaaaatgtgtctggtctgaattgagaggtaccctgagtataaaatatacattggatttcagagacttcgtaccccccaaaaagaatgtggaatgtttaatagatcattttaaagtattgattacaggttgaaatggtaatattttgggcatactgggttaaataaaatatatttctgaaattaatttcacctgtgtcttttttttttaaaaacatggctacatataaagctcgagttctatttctgttggactgtgtggctttggaacatctggctggatacgtccccctttgctggtattctcttacaaaattttcttggctggtcacatatgtttattctttcaaatgaattttataattgttttgtcgggtagaaaaatccctcgtgaatttgattgatagtaaattaaacttagaaactaattaaaggaggaattgacataatttacagtattcatcaggaacatagtatattttttcagcttatttcattctgctttgatgttgtaccatgaagtattatatatacatatttttatacaggtcatccatttttaaaaatcaggattatttcaaggattttttttctttttgccattgctcattgaatactttccatctattggtacacaggaaggctactgatttttatagaactatcttttatcaagcagcttgattgaactcattaattctaatatatctttgtggagtcccttgggttttctaggtatacagttgcactctgtaaacactgataattttggatcctcatctccaatctgcaccgtctggaaccttcagagcgatgttaagtcacagccgtggctacacgcatcctcatctgtgcctggctttaacggcaacgcccccggtatttctctgcttaatacagcgcttgctgtggattaagatggatttcatgtgaaggcaatatcctctgaattctcgttttctaagatcccatttttatcagtaaaggagctgaaatcaagataaaatgtgtcttaactcttaacgctcccttctctcacctccaaaagccagaggtgttgcgattccggggtgtttgtgttctcagcctcggcctcagctgtccactttgctgggccaggaatgaaacccagtccccatttacgcaccatgggaagccctcgtagggaggggcagccttcctgcagaaggtgggggagccagcacctcccggccacgcgggtgacttctggaagaacaggaccctgttcttggaaagccctttgggccatgtgtgggggcatttccactttcatctgtgggttctttcttccctcccagtggcgtctccctccctctgtccagtttctctggagcaatccctccattctcctcctgtgtcttaacagcggactttgcccgctgctctgaggtggtggcactgtctgcagagtctcctgctcttccagtcccactgttatctgttatcccatgtgcttctagaaggtgtttttccaagcaaagacatttccctccttagaagaaatctgtaggcggggcacagtggctcacgcctgtgtaacttgaggaggctgaggcgggcagatcacttgaggtcaggtgtttgagaccagcctggccaatatggtgaaaccccatctccattaaaaatacaaaaattagctgggcatggtggcacacgcctgtagtcccagctacttgggaggctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgctgcttgcgctctgtcctccttgcgtcttcctccttcctgcttcctcctgccctcttcctccttcccgtcctctccctcccttccccctcctctccctccagcttctcctccccttccctcctctctcttcccccttcttttctcattcctctttttcccactcccctcccttctcttctccctcatctcccctttttcccttttctctccattctccctttatgtcctctcccctccctgccccttctgtcctctccctgttcccacctttctttcccagagtctttcatcagccaggactcctggggacccttcctggctgggggcccttcgtcgtcagctgcactctgcacctgtaccttcctggtacattctgggaaccaacaacgagccatcccaatgtgctgggaggaaatcagggcacagcgatggggatgacccaccccaggtcccacagagcccagagccagctcctttcactgcagctggagcaccagatgaaatctgtacctcctcagaggtacagataactccccacctgtacaagcagggtgaattgctgaaaaggggaattcatgtctcctctccttggcctgctactgagttcttggtgcattttctagcaaacaaggtcaaggctgagtccctgccctgccagagcatcctccacctcagatagggcggcttggcctttgggctgtctttcctgttggggtgcccaggctgtcacgggctgtgtcctcactggggagggtggcccgatgagcagggctgctgggaaggttgtgcaggtggtgtgctgggcaaggtggccaatgaggccagcctttgctccgtctgggagtgaatggagtggaggttggagggtgcccagcgctgggtggagatcacgggcactgggggaggggaaatgtgtgccaggtgtctgcctccacagtcaggttgccagagttgctgcgttcttctctttgcagagcttctgcattctcgggactagggacattaaaaaccaaagccggggcagttgcagggaggctgctggacattgcaggtggccctgattggggcagtctcagctgtggtgactacgctgtggcctttggggccagggatggctggtccaggactgggcatggtatggggtgggtagatgtaggccgtctctgtcttggtgtcagcctgtcctgatagactctgggggctcagagtcctcacagccttcccccaacctgcctgcaggtgcccacctggctccccaaggcctgcaggagtccgctggggctgggctggcctgggacccttggtgggagtcaggcaatcgtgttattgttgaaacttgtttcctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggcctgaaacttgtttctttaatggctggtggttacggcccccaactttcctcctctgaagctgattggttctccctggggctagtcattaaccctctgctagcttgggtgggtttatatttgcagagcttccttttttattctgccgggctggtgttttgtttcttcggtcagctctgtcagcctctctagttgctttcttctggttactcagcctgtagaaaagtatcagcctttcaaagaaatactccattatatgttttgcttttttcctgacttgatttttaaatatataactcctttaattcaagtgaaatgtgtttcttatactgtataaggtgttggttttaagtgttcatttttttctaaattgccatgctgttgtctcaacaccattcgtttgctaattcactctttcttcttgactttggaatgtatattccatcatctgtgaagttcatggaggatatggggtttatttctggcctttctgggttttgttttgtttttttttttttttttgagacggagtctcactctgttgcccaggctggagcgcagtggcactatctcggctcactgcaagctctgcctcctgggttcaagcgattctcctgcttcagcctcaagagtagctgggactacaggcgcccgccaccacacccggctaattttttgtatttttagtagagacggggtttcaccgtgttagccaggatggtctccatctcctgacctcgtgatccgccctccttggcctcccaaagtgctgggattgcaggcatgagccactgtgcctggccttttctgtttttcttttgcaccagtccaggggtctttaattgctgttggttgacaatatgttctgacatctgatagggcaagtatcaccatcgtgaggttttaaaaaaatgcctaaagtagtgtcccctttgcagaaggccctcagcaaatctttgctgaacaaatgaacgacatcttcatgatgtttaattttctcacggaaataagaagattgattcagatgtttaaaaacatagcccagtaggtttattactaagagacttagaatgttattgccattgtcaatagggtcttttccattatattttacaccagattgttatctgggaacacttttaatttataatacagtaggtgattatttactcagaatacctgggacctgcttctttcagactaatgatattctcagaatttagacatctttattcccagggagaaaacagagttaaaaatgacacattagtgcaaatcatacatgcatgtgcagagctgccacgaaccacttgatacccatggttgacctggcaagcccaagccccagcattgctgtcctcaaggcgcgcccttcctggcaacagcccctgcttcagatcctttgctcccaatgacctgcatcttcccatgtcttagcaaagcagtctctctgttactagaatggcacaaatatgaaccacagataatcacaaaaagtccttctgaaataaatctcttgccgggtgcggtggctcacgcctgcaatcccagcactttgggaggccgaggcgggtggatcacgaggtcaggaaatcgagaccatcctggctaacacggtgaaaccccgtctctactaaaaatacaaaaaattagccgggcgtggtggtgcgcgcctgtagtcccagctactcgggaggctgaggcaggagaatggcgtgaacccgggaggcggagcctgcagtgagctcagatcgcttgcaccactgcactccagcctgggcgacagagcgagactctgtctcaaaaaacaaaacaaaacaaacctaaatctctcgcttggatgtttcccatgtttgcgttcccagatatatgagtttctctatttattttgcatctagactttttatgaacttccttgttattatttggttcctttttttggatgtttttgggggtgaggattctctacgtgtgcagttactttctgcagttcataatattgtctcttctttttcaacatgttttcgttttatgtctttagtaattttgtgtgggagctacaaccatgccttcagagcatctagccccgcttctaagggaattgagaaccaggtgctgcttcttctgtgaatgctggtggtggtagacccaaagtggacaaaccttggcctgaatggatctcccaggcccatttccccacggtggcacggctttcctttccctgctctcttgcatcaagtagagcttcgaacgcaggatgtgcccatgttgtggttttatggggatgagtggcggcggttgaccttccctttcagtcaaggaggctctctcagtccctcgtggtctgttaggtgtcccctgtggttggggagcagtgcaccgggcatgcacagggttgtttgcaggctggcaggaaaactgcggtctttgaaagatgccctgagtttctacgggggatgtggttcagtgagacactttcaggagaaggctggcgagtagattcggtggtacaacctggagactctatgaatgtggactgaggagccctgttttgagtccctgccttacccttcacaatgagataattttctgcacttcagggttcccattgtgcagggcggagtttgcacactggtgggccacgggccatgtccacccacagatgagttttgtttggcttttccagtgtttgaaaatttctcacaaagctcaagatttccagtttctcttgagaaccaggaaatctgccgggcctatgtgctggagggctagagctgagcaaggatggaaccctctagaagggtcccacagttccaggtgccttgggagtctctgctgctccctatcattaccctggcgggcttcacgcgcattcactccctgtgtaggcacctgagagtttctcttattttgagatgagtgctgcatgggctttggaacggtcatttcttcctcccctctctctccctctccctctccctctccttcccatgacttcagtttttggccatcagcccctgcaaggtcccgtgcgctggagtcagacgcgatctcgctccaacacgtgggcttggttttctgctccctccctccctgggcgagcgagcctcctgtttctcatctgtgaaaggtaaaagctgatgacggtaactactctggtgggttatgatgaggattaaatgaagcgagggccagcactgagcagcgaagggcctgttactacaagatcatattttcctgatggcgctgctaggagggaccacagtgtgaaagcgcttggacacacggagccaggtgcagattttgtctcttttgagagctctgtgggcggggcttgggcgggcatgggagtggggggcggggccgggggcggggcacaggccggggtaggatgctctccctgccccaggcatcaccggcctgggatgtgttgccagtggaggccgttactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaagatgcggaaaagatttccagtctggaatgggagaagagtctcgtggcgggcaggccccaagaagggaaatggaggtcagtgtggcgaggggatgtgcaggacggagaggcagcctttgttgggggagcgctctgatcccttcctccgcacccctcagctgggaggacttggccgcctggccgttctcctttgggagtgaatccggagggtgtggcccagaggcggctggcctcgctcctgtcctcccatccacacctgtgcagctggtgcctgtgcccctgtccctcccacaggccatccccaggtccacactcctgtgactgcaagtgacagaaaaccggggcagaagcggctggggccaaagggggaatgcggggctcagggcggcagcccaggcctcccgcacggtttcagctcagccgccctccccgtgggtcctgcctgggcagtgcaccagccgcccggcagagagaggcccaggttccccgagggtttctgggagagcccagtggtgagttctcactggctcaggttgggtcacatgcttcaggcaaatcactatggccaggacagcggagcaggacttcggctggccaggcctcgtcacaggactgctgtggctccagggctggcgtctgtcctctgaccctctgggagtgggtcggggagaggatgggccccagaggaaagccaggctgatgtgtcaggaggagctatgggtccccattgccttctgtctccaggacatctgccctgtcttctccctgcccccgtttctcccactcccttccagctgcccatgataagcacgcggtctcccttccgtgccccacccgaaatgctccccatggctcctccactttgagggtaaagcacaggcccccagaaccagcattcaaggcccctcctgaccatcatcatttcctgcttgctctacccaccatgtccaccttcccgttcatcctgtgggcctgggacaggagctccgaaagatcacacacacccatcaactgtcaactctgcccacgttggaaacagtgcctgtggcaggtgcaggaggggaccatttgtcttggctgaagttgaatctgaaaatgacctaaggacttgaaggaaccagggcctagtgtgtgtcggggtgtgatcgggtggctgaagaagctgagactccttgggcctcatgggctttgcattagcagagcagacagtggggggtccctgaggacctctgggcttttgcctgaatgctgggaaccccataggcctggccaacttctcatcacccctcttccagcaaaccttcctgtcttctgtcctggtagttagcacagctgttccatgtcgtgaaccctcctgccagcctggtgaggcccatggacccctgatcaaaataatgtgtttagtgtacactacaaaatacaaaggaaataaatctgattgaaataaagctatcggccaggcatggtgcctcacgcctataatcccagcactttgggaggccaaggcaggaggatggcctgagctcaggagtttgagaccaccctgggcaacatggtgaaaccctgcctctactaaaatacaaggaactagccgggcgtggtggcgggcatctgtagttccaactattcaggaggctgaggcacgagaattgtttgaaccctggaggtggaggttgcagtgagctgagatcgcaccactgcactccagttggggctatagagtgagactctgtctcaaaaaaaaaaaaaaagagaaaaataaagctatcaacatacacatgcttttaaaatttttaatcattattataccttacacatttttgataataatgttattgagacataattcacatactatgtattttaccaacttataacgtaaaattcaatgaatggctttagtatgttcacagaatggtgcaaccatcaccacaattttagatcatgttcaagactctgaaaagaaaccccagaccctttagtaacccccaattaccccgtcctcccaggcctaggcaaccactgacctaccttctgcctgtatagatttgcctgttctgggcatttcattagtataaatgaatcacacaatatttgccctttgtgtctggcttctttcactcagcataatgttttcaaggttcatctaggttgcagcatgcatcagagcttcattactttggatggaaagatatgattccattgcatggatgtaccacagttttttaaatccactcatgggttgatggattgggttgtttccaccctttagctcttgtgaataatgctgccaggaacattcatgtaaaacttttttgtgtgcttttaattgatgcattaaataataagacctaggagtgcatcttacagcctctataatttaagttgtgctgagtgtaaacaccatttggtctggtctgcagcagcggtgctgacagttgccgaagcctgtgatttctgccctgatgggcgcaggtgctgttaagtctggggttgctgcctctctccagagttgaagggaatggcagctttcagttcccagttagtaaagatgaagttgaagtgttctcttttcccagtttatggagcccaggttaagaactctccagggagctcccacagggcagtgacaggacccaacggcccctggcaagtgctgtggcctgtggcaggaccaggtgtccagatcaagctggcggctgttctgcctgccctcagccatgctgacacctgccacgaagcctggtgtctgcttctttctcctccccgaagtattctctctgtccttagcttgggagtcctacagctggagggtggggggcccaggccctcctggactgctgcccctggggccccattgtctttccttctgccaggccatttcccttcgcagctatttagaagggaaggcagccaaaggcctgtcagaagggggaccacggatggattttccatcagatgtgcagacctgctccctgacactggctggctcggtgcctgcctctggagggcaccaggcctctgtcacttcctgtgcagcccctgccagccatgagacaggtgagggctccttggttttgtggagactgtcagtcttggctctggagtggcctcagtcctaggcagctcaagttctgcctcccgccagtcctgtctgcaggcaggatccagtcctcacgcacccatgctgggcacggccctgcttccacaccgtgctcaggaggagagcgtccactcccaggagaggccttgccaggcacctctccttagggacacctgcagttaggggtctggcgccagcttgtgtgtgagagatcaactccccctggtactgtcaggccccgagtgagggagccgcagcccagagaggcctctttctgtccagtttgcatcgccacatttgggtttctgtcccgcctggcctgggccccacctgcctgcggagctgccgaggccctcgtctagtgccctcccagaggggcctccagtcctggttcttatattacagaggcagccagaggcttccctgactctgtggctggcgcagccttgacaagtcatctggaattggctcacggcctcctcgcgtctcccggtgtctgatgtggcaatgaagctctatttcagggcctgcgggaggacccagcgtggctcagggtttgtcctcaagggagggcgtggatcagagcctgtagtgcggacctgggtgggggagggagaactggaccctgcactccctcctgtgtgaccatgggcgggttatttcacttctctgcactttcagagtctccaccttgagatggccccgtgaggactgattcaaagaaggcacgggccgtgggcgcatcctctgctcctctccccacctgcgctgggtcccatcagattttggcattcccagcaccggcagtcctggggtgactcacgatggctggcaactttttgtcctgtctttaagttaaaaactgtcgtatgtgccttcatataaaacagaatgcagaaataagccaaaaggagaaaatggaaatccctgcagtgccattagctttcaacatttttgtgtgtctcccacgtccatgcacatatgtgtaaacatacttaatgacaaaagggtcgtattgtaccttccctttgtgatctgcctctgcccatgccacacataatggaaatatttctggatcatccagtgttctgccggaacatctttcaatagaggcagcataatctactcaggaaacatggagaggccgggatctccaggcacttgggtctgtgggcctgggggctgagggagaggctgaggaaaagcactccccagcttttgacttgcacagatgggtggtagagaggaagggtagcttggagagagggtttgtcactggggctgtctcttggaaggagtctggcagctggaaatgcaggtcctaggtgcaggggcaaggtctgggtagaattcgggttgggagcgctctgtatggagggctgtggattccacatcctggggtgggtgggcgggcaccaaaggaagagggaggcagaaggggaaggaagtgctccttggccccccaccatgtgcagacaagtggaggaggcagtggggtcttaggagcggggctgcccacctgctaaaggatgagagaggttcaagaggagggggttcagggaattgggatggcagggggcatcaggcccagcagccaagagggggctttgcagggtcgctggggagttggtggaagctagactgaccaggtgaggggccagtgagaggcaagggagtggagggaagctggtgcgcatggcacacatgctgcggtggggcagacatcagctgcggagggtgtgcagtcttagatgtgagtgcagtgtttacgtgtgcgcttgtgtagatgtgtgtgtggccctgcctcgagcacagaggattttaggtggcttgagtttgctcagggaccgaggatgaggatccgggagatggagagtttgaagctatagaagagagagtgtattagtcaggtgttattcctcaagtgttggaaatccaagtaaaagtggcttcagaaaaaagaaaaaaaaacttattggttaatctgcaaaaagaaaaatatctagaactatctagcttcaggtgtggctggatccaggtgcccaaataaattttcagttgttttttttcccacatccccaacccttggctttgctctcctctatgtcgatttcactctcaggcctgctcttctctgaggcagaaaaatggatgcaggcagctgctgcattacctcctcacagggcaacaacccgggggaaacagcttttcctttccaacaattccagcaatagttcctggatttaacttcatggaataccttgtggcaagtcctcatccctgagctatgttcatgtagtcagatgacaacgtattctacctggcctaggctgggtcatgtgccctccttgcccactggtgacgcagggatgagagctggttcctgagtgacacaggggctgtgctatcagaaggagaagggtgggccaggaacagtggctcatgcctgtaatcccagcactttgggaggctgaggtggacggatcacaaggtcaggagattgagaccatcctggctaaaatggtgaaacctcgtctctactaaaaatacaaaaaaaaaaaaaaaaattagccaggcgtagtggtggacacctgtagtctcagctactcaggaggctgaggcaggaaaatggtgtgaacccaggaggtggagctcgcagtgagtcaagatcgtgccactgcactccagcctgagtgacagagcgagactccgtctcaaaaaaaacccaaaaaaatggaggagggtggactccaggcaggcttagggttcccaaggaagtggctggggccaggattgggagacctggaaggctggaggagggagctgctgcccaggagcacagcaggagagagaaggacacgaggcagacatggagcgggagggaatttcctccgtggcctcccttccctcaccaggcagggcagggacagtgaggctgctgaccagcctctacagctctcctgggagtcggctggctctgcaaggcaaacagaaggctggggaggttgactgatcaccggctgctccgggagccgtcaggctgggcagcaggagtggcctgaatgcagagaagcaagccttgagatcaggcagggcagtcttcctacattaggagtctgggaccaggcattctgtgggccaggccggagatgtggcaggctgggtgtgaacgtgctgaccagtggggacctgggtttgggtgctggggagccaggcgtaatgactgcgggggctggtgaaggctgagtccagtctgcacgcatgcttcctgtggtttctgggtgaaaagagggtcacagctttttgcctcaacagaggggagaggcttctattctactggttgagtgtggatggggagggctgggaggggtaggatgaggtggtagagacatacaataagcaaaaggccaaataaacaccttctcaggtagtggcaggaactgggaaagtaagcaagcaggcagtgaggctgggagcagcaggagggtgtgagtgagtgcatgtgtgtggctgatgtgtgagcacgtcagtgatgcatgtgtgcaaatgtgaggcatgtgtgagtgcatgagtgtcatgcatgtgtgcacatgtgcgggcgtgtgcatgtataatgcatgtgcttgatgcatgcatgtgtgcactgcatgcctgtacatatgatacctgcatatgatacacatgtatgaccgatgcacatgtgtatgtgtgggtaatgtctgccatgcacatgcatggggcatttttctggtgcatgtgtgtacttgtgtgtagtgcacatgtgtggacatgtgtatgtgatgcatgtgtcacaggagatgcacatatgagtgatgtgtgtgtgcatgcgtctgcatggtgcctgtgtgacgcctgcgtgtgagtgcacacgtggtgcatgtgatgcgtatggacatttgtatgtgggtgcatgcatgctgcatgtgggagtgcatgagtgcacatgcatgtgtgtgggggcctgtgtgttgagggaatagctgttgggaaccctcagtcataacagggctgtgtgaaatcttcagctggaggaagacaggagagaaatagcgtgcagctgtgttcctaatggcacacacgccccttgcccagagtgcatggtggaagagggctttctggcccagggaccagctctctttgtggcccaggcctgctgcttttgggctggggtctgaccttcctggaagacccttcggggccccgcctctcagaggccaggccccaacgtctcaacgctcaaacagcgacatcagtgtttcccccaggggagtcatcctggggaggctcagctccatcctgagccgagggggccttggcattgccccacctgccctggtctgagaaggagctgtcctctgcctctctgtggtctcatggggacaaatgccagccactggacagtggcccttgtcgtcttctaactgtcaagattccaaaaagacggaggcgaggggtgtgcgggagcaccctctgcgtgtgcttggcttcttccccaccagccttcttgtgagagggctagaagcagctgtcccactttgcagtgggccctgtccctcctggcagggcagctgtggccgtccctggctgtccccgccccgcccggcatctccttctctccccatcccctgtctagctggccccgcctctcctccctgtcttgctttagtctcatgcctttttaatgagggctcagcctcctgtgtgctgaggctcagcggcagcgcatttaattaatactctcgcatcgcagttcttcagagtaaatgctgccattttattcctcactaattggaaggggctagttaagctctgagataaatgaccctttctgctgggagtgtctcagctcagagtctccatgagagtggctggagccttggatgggaagggcaggagggctggcctgctgtgttcctcctggtccaaggggggcctctttgctaatggccagggtagagacgtggccagggtgaagcctgcctgacctttggggaggacgtgcaggtggaggctctgctgaccagcagggcttcagattcatcactgcccgttcctcatgtcccggctccaccccagccctggatgagccccagggaccccagggaaccttcagtctgggtttccagaacctttccctggcccagtctacacctgcctccctccctcactgtggaccagccccacctctaccctccatcctgtacgtctgctccactctccccaactggcgatgagtctggccagggagtctcagctggtgctggcacgctaacctcccctagacgcgtgctgaaatgtacacgtgtgtgtgtgggtgatgtatgcgatgcacatgtgggggcgtttgtgtggggcatgtgtccctcagcacacatatgctctgtgcccgctggccatccgggggacatagattacaccaacactgcagtgctgctggccacccatggtctgggcagcaggaagaggtgcaggagtccccacacagtgtcgctgggatggcctctgggtccgtgcttatagaagtctcatgagtgcaccctccgcccacctgctcgcatctctctccctccacgaggaactgtgctgtggcctcctgggtcttcaagctcctttcctgttgtgttggtgacaggaatcggggtcagaagggcagcgtccgagcaggcttggatgagatgtgtgatattgtgttaccatatcagcgactctgctagctgagtccatcttcagggacaaggatagctgtagccagacctacgcatggatttatgaggaactaccaagaaaccactgggaggaaagacgccaaagtgctgaggaaaaggatgctcagaggtggccctgctgccagctggcagagtgacaggagggctggaggctgtggggacccaggccacgtggggttggggctctgggctttgtccttgtgttcctgtaattgtctgttgctgagaattagctggaatttctttctttccttcttttgttctttccctatcctttccttcctttcctctcttctttccatcctttctcaccactgtgtattctttttaaaaaattaaatatatttcctttttttgagacagggtcttgctctctcccgggctagaaggcagtggtgcaatcgtagctccctgcaaccttgacctcctggttcatgggatcctcctgcctcagcctccaaagtagctgaaagtacaggtgtgcaccaccatgcctggctaattttttaaatttattttttgtagagatggggtctcactatgttgcccaggctgatcttgaacttctggacttaagcggttcttggcctcccaaagtgctggaattataggtgtacaccactgcgtcccgtccccacttcatgttcgacagcagttctccgtgcctgctctgccctgggccttgctggactggggttgaagaggcagccttctgttctcttggagctcacaggttcctggagggacacagcaggaaggtctcaaatgccatccctgggagtggggagggtgttctgtggggctggggagccctagggggcctaggcaggagcctgggatgcccacatgcaatgaccccctgagctgtggccgactccccagccctgctcctgagggccctgctgctctcagcatctcccagggtgtcacccttctgggttgctagatctctgctgctctggtgtggcctctgtccctgccgacccctctgagggacacagctgtcctctgctgcggtggctctggcctcggaatggggcagcctcttccctccaggcaagagcctttgaattctttgccagcaggacttcctgggctcttgtctcccgtctgctgcccggtgcccacgccccagtctgggacttggatgtctgcctgctgcctccctgtttacactgatctgatctgctctttccctctgggagcttttgaactttctctttgtctttgatgttcttaggtttcattatcgtgggtctagctatggagctttttcttatatatgtattgataaggcctctaggaacccatccatgctggaatctttcatgtaattttgttttttgaaatattccttctctcacctccccgactctcttctgggacttgcccacgtctcgcagcttttctccctgccctctgtctcttgctcctttcttagcacacagcgagagctctgtccagatcccccagttctgcggtggctgtggctgttcagttcctctgttctgctcttcggtgcagccaccaagccctctctccagtggcgtttgtgctcagcagctcctgggggcggccagttcctgtggccatctggggctgtgctttgtctctggaaggatcgttgtttcagttttcctctgcgtgccatgggcggtcctgggtacggcctctctagaacatagtacctgcgccactcagatcccagctcgtgtccccggaggtggagactgtggctggtggtgctaggagggctcatgccagcttctagctctggcttctcctcgtgagcgggacaagggagatgggaggaaagtccccagagatggcttccctcccacccaagctctgtttcctgacctgggatcctggctcccaatggtgggaaacaaaccccctttggggacacccccacttcactggcaggagtgcagtcagccctgggatcccgacatgaccttcccaaagcactgtggcctcagtgctttccagaagccaactgtggcctcagtgctttccagaagccaactgtggcctcagtgctttccagaagccaagggtatttaatcttgtccatggcgacgtggacgcgtgtcttgggaggagccctctggggtggggcagaggctgtgttaggtgggagggtctgaggcagggacccaggaggaacagaagagagagagtgagtgaggcctgctccatgcaggggcagggggaggaggaggccggggtggggccttggggattgtggggggggtgggtgtaggaatccagtaccacttccaggttccttccaggcttgaataactgggagaagggggcgtagctggctgtgattaggctctgggaggggagtcgcttaatgtcaggaaagagagttacttctaggtaggccctgggcttgaggctcccgggccatgctaagggacattcctatgtcccttgcagctcttggttgggcctggcacaaaaaagtgtgtgcccaagactcctgtctgtaggtggaggtctgctggagtagaggttgggggcactggcgggggacaggagccccacctgggtgcaggaaggctacaagggcttggtggaagagcgtggaagcccccagaatcaggggcttgtaattctggcccgtcaccctgtgggacaagcacatgggcctctgcatgctgtctcacctcatctgtaaaagggagacagtccagtgaggatgtgggcccgtgagagagagacacggcccggggggctgcagaggcaggagcgctgtgggtgggagggctgcttcctgggctctgagtacagcacggtgcatttactactcttgtctcaaaaagcagggaaaactgagtattccggccacgccacgccacgccacggggtggggaggagcctggccttgccgctccctgcactctcctctgcgctcacttagctcagagctggcggccgcccagctcccagtgagacgtggcagccaggaggctgaggcccagccaagccccagatggctggcgagaggtgcttcccccgagctgagcaagacaaggacagggccgacccggtgggaggggcaggatgggaccaggagcccgggaaatgccagtcctggccctggccctggccggtctgtgtgctcccaggctgcgcccaatccgaagcctccgtgtggatgcagagcctgaagctggaggtctgggcataggcaggggtgtggggtgtgtgaggaacccccccgccccaccatcaggttctgcctgggaactcctggtcctggagctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcatgagtgtgaatgcgtgtgcgtcccctctgctgacacccctgctctggccaggccctcctctgtctcggtgtgatgtgtgtgtgcatgagtgtgaatgcgtgtgcgtcccctctgctgacacccctgctctggccaggccctcctctgtctcggtgtgtgtgtgtgcatgagtgtgaatgcgtgtgcgtcccctcttcacaggccactcctgaggagggagccccggtaaggctttaggctgctggctggttctggggttgccatgaagtcctgaaatgctattctattgctgtttcttgatgtatcgggtttcgatgttgtccattgacttcctgccctggaagaggagggtttagctcactgacaacactgctgcccctcccagccccattcttctaccataattctctcaccacttttagtccatatcagagttccccattgtattggtttctgaggctgcctgcaaattactacaagcttgctggtttgaaacattagaattgtatcctctcacggttctggaggctgaaatcagtttcaacagggcaaaacgcaggtggcggcagggccgcgctccctccggagcctctaggggaggatgcgtcctgggctcttccaggtcctcgtggcagccagcagtgcttggcttgtggcctcttcgctctgggcttcagggccgacatcctccatctccctctgctctgcctgtacgtggccttctcctctgcctggctcatcttgctctgccttcctctgataaagagaagtgtgattgcatttagggcctgtcttagtccatgcaggctgctatagccaaataccataaacggagcggcttaaaagcatcggaagcttatttctcacggttctggaagctgtgcatatggttgtggtgagggtctgctccctggttcaagaaggcatcttgttgcatcctcacatgctgaaagggtgagggagctctctggggtccctctgatcggggcacaaatcccattcgtgtggatggaatctggtgacataatcacctcccaaaggccccacttcctaatatatcaccttgggggagtagctttcaacatcggaatttggggggaatataaacattctgtctatccctgggcccacccggaaaatccagcagtcactccatctcaggatccttggactcaccgcatctacaaagttcttttttgccatggaaggtaacatttatgggttccagggattgggacccggacgtgtcttcgggggccatttttcagctgaccactgccatggtcgtctgactgttatatttgcacctctgcagcttctaacattagcctggggcagagggtctagagtatgcccttagcggcacagggttcccatgccccttctccctcctccccactgctgtcatttctaccttcccttcagcaaggcagagtgttgttaaatgaaaaatgattcaatgatacttattaaagcgcggtaaggcggactttattcaggaccatggagatagacacaggaaccgctagagtgggctcttgcagtcggggagagagactgggctcaactccgaatacagcacgggcgagtggggggtgatagccaaggagcagggtaggggccaggggatggggaattactaagagcaacatcaggggtcggggattctagctaaactcacctaacatgattctagctgaagacaggctggggtgaccagacatcaccagaggggtgatggggaggacgagcctgaccagatatcaagggtgatcagatatggagagatggggcattcgtgacttagcagagttcttgataaactggatcttacaaggaagtgggcgaaggagaaggttcaggagctggactaaagtttggtcaagcaggagagtccctgtcagtgtccactgttcaggtcctttgttgtcattgaggctttgctggcaggtggatgtccctgtgattcttggcatgctgctcaccactgtctgaccctggcccattgctgtgcctctgagccaggcggcgcctgcccatgggctagagagagcagagtggaggggcatgaccctgcacaggacagagctggacgaggcccttccagagaagtggccagccagaggccagctccacctgggccaggagcgccaggccctgggggagagggatggggacgtggccttcctgttcagagggcgggggaggctcggcctcagagtgaacatctgctgaacatacgcatcctccccttatataatgctgtctggaaaaatggtttcctgttgttgttgagataggagtcaacgggccctgcactcggtgggttggggggtggggggctggggagtggagagggtggtctttggctccaacctggggtggaaaggggcggaggtccagaggacccagccggcaagtgggttggggcaggcaggggcaggtggggttgggcaccctgctgagctgctgtcctgggccatgcctccctgacccctgcagtttggccatggtctggggtggtggccctttcactgtccccaggaggactaaggccctgatgcctctgcgtccccagggcagggcagtagggcctctacacccacctttgagggaccctgggagggtctagagcagtgtgtcccagacttcaatgtcatcagaccacctgggaacttgccaaaatgcaggttttagttcagctggtctggatggggcctggattcagcatctctaacaagctcccgggggcccccaggctgctccaggccacattttgcatagccaggctctgcaccaccatccctcaccccagccgggattctagcaccggtgggtggcccagagacgccaatcagattcttctgtggacttgaacctctccttgttcctggaaatcctgagatatttaatgaccaggggagccctctggggctctctaggccatactgtaccctgcaaggcagcctatgggggggcttcggaaaggcttgtagatgcctcctgatcctccagcttggagctggggggctgagcccccaaagacaacaagaccagttctctgtctttcttcactgtgtttctgccttgtggtatgagcaaggcatgcctagatccctgcccgctgggagctgcagcctggtgggggaggagggccgtccacaggcccccacagcagacagcagagcatctcagcgcctgagcgctgtggggacatgggacgtgcagggagccctgggcaggcgtagtccggggtggtctctcctggagggtcctgggtgacaggaaggagcagtcaaggcatcaacctgggcagatccacaggacattcaggggcacccttgtctgtccccagggccgcaggctactcccaaggcctccctgacttgaaccccagaagccagagggcaggggtggggcagggaggacaggagggacatgcagtgggggcctgctgggtccagggtcctgccctgccctgaggcaaacccagggtgttttgccctcagagctcctcccctatgcattttaaatagaagaaactgaggcacggagaggtgacccacccggtcaagtggcagggccagagcctttttttttttttttttttttttttttggagactgagtcttgctgtgttgcccaggctggagtacaatggcatgatctcggctcactgcaactccgcctcccaggttcaagcgattctcctgccttagcctcctgagtagctggggttaccggtgcgtgccaccatgcgtggctattttttttgtatttttagtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttggggggacatcctgtgacctgggtcccgaagaggtggcctttctccagctctatccaccaatggccccaggcctgtggccactgaaggcagaagcagtgggactgggtctgccccagtgggtgcctggctgaagtctccctgcacaacccttgggaggcatgctggctcctaactggcctctacccggggaacacagagttttcaactgaattggtgtttgcgcctctctgctgagctggcccatctctccatgtagcttcctgtggatggcgcagctgcagaactccagtccacagtcaggaggcacggggctgccagggcagcggaagagacccaagggcaggaacgcccgcctcagccctcttcgtatctttccctggacccagggcctcaccatggcctggcctgtcctcctagaagaatggctgaatgaatgggcagctgagggggatgctaaaggcagggaacagtaccccgagggcttcagtggctgtctggctcccagctggcctagctgcatcccagggcccctggggtgggaaggaagaggaggcagaggggccaggaacctgcaggagggtggggttccatggcagcccgcgccctgcttccactcaggacgccagccagattcatctgctgggacaccaccttaggaaggaggcacttctctgagaggccttgggaatttcccccaatccacatacacatgggcatcatgttgggagaaactgttttgcaaatacaattaaaaaggatcctcccaaagttttgcctagaaaaaaaaaatgaggctgtctattatgggggcctgcaggcatggtcatcgcattgcaggagctcctgtgggctctggtgcccctgcacccttgctcgtgaacagtggcggctgcccgttcctgtcctcagcctgcccaggggctgcgcggctccccttccagctggcgtgcgtgacctttccagctggcatttcgagtgctctctctgggcaccgctgagctccacggatccccaaggcggtcatttgtcagatggtcctggtgactcccgacatcccatcagcgtctcctgctgctaagacaattgtgtcagacaactctcagcgcctgtcttcccacctccaccgagcagcctgaatgctttactaactggggagaaatcagagcaccggatcctccacttaaacccctgttttctccttgttgtcgctccagaaggcggcaaacttggcccactctgcaccacagggaccttggcaaggaaaccttacaccatcctgaagtaggggaagggagcctcgggagggccggcgacctcccgtactcaactccatgcctgtgagatgccaggcactggtctggtgacgtggacccagcaaggacaactttgctctcgtaagatccctggtcagggggcagagagtgacccaataaagaacccacgtgtcgatgattgggaaatggtgttacaaaaaaataggacaggatggcagtgtggagtgtgatggagaagggacacccttcaccaaggtccttgtgaggaggcatcggagctaggacctggacttctggaagaaggccattccaggtggaggcagcagcaggtgcaaaggccctgaggcaggtgctgagttgaagtgtgccaaggacacagaggagatctccacggctggcacttgagtgaaggagaaatcagcggggaccggggcagtcatgtggtgggaagccgctggagggctttgggcaggcagtgacaggtctgagtcgtgtttcagagattctgtggggcagccgtgaggagcatagagaatgaggtcacaggcttgggacgcccgggctcccagcctggcatacgtgatggtgctattagtggatggtgcagcatgacccgggaagcccctgcgtggtggtgccccccggaccgggctgttgaatgctcatgggcagagctgcttctgtgtcatggagctgtcctggagtgctgagcagtggccacccagggttggccgggtgctcgagccctgagagggccggtggacctcctgtgggccccaggtcttgccgtccctgaaggctgaggcttgcagggtgcgatgctctcacagcactgctggggcagatggcggagcacagcagggcaggggcgcgtgggccggggcagctctgcagtgcgggccccctgtgtctgtctcatgctagcagggcgagggtctgggccgggcttaggctggctggccactgacttccccgagagattcttcttactcggctgcccctctactacgtgctggcctcacctccaaggactcaggcccagggttgatcctgccagggccacaacagatgtgggactggccctggtggccaattccccacccagcagaagactgccctgccctctcatccctcaggctgtgctcctgtcaggcctggtcctggaataagagccatgtcctcagagcctgtgggagcacttggtgctatgagactcgatctcatggagttgcttccttcctgggtgtcctttccctggttgagttcatctgcctggctctctgctggcaccgggcttggcactggagatcaaagcttcatgaggctggagcaggagggcccccgcttcccctaggctttaggggccagtcacccttcctggacatccaccttccccaggaacacgggttttggggaagctctctggggccctttcctgccctggcctgagggtctgtgctgggtgctgggtgtgtacagaggtgctgtctaggactcaacccaaggttgagtaggagtcgtgaaaatgctccttattttaggggaaaacagtttctcaggatgcggtattgtgttagctttagtttttttgtagatattcttaccaggttgagcacgtttctttctctgttagttgagagtttttaatttttagtcatgaatgaatcatatcatatggttttctctatcacttgatataagcatattttttttccttcttcagtctgttaatatgctgggttacactgacttttggatattgtgccagactctgcaaatccaggacaaacatgacttgtctgttgtgcactctgctgtttatacatggctggactagacttgccagtgttttgctgaggatttttgtgtctatgttcattgagggatattggtttataggttcatgagggatattggtttgtagggtttttttttttattgaactgtctttgtctggttttaatatcagggtaatgttgacctcataaaatgaatgggagaattggtgccattttttcctgagaggttagtagaattttccagtaaaaccgtctagacctggaaatttcttttttgcaggattttaaactatgaattctttttctttaatagttacagaactttttatgctatctactttgtcttgggtaagttttggtagcttatagtttttgaggaaatcatgcatttcttcaacactgatggatttatatgcatagaattgtttatactattccattatcttttttatggctgtgatgtcattagtgatatcctttttaaaaatattctgatactggtaattcatatttttttctgtttctcttcttcagtctcactagagatttatcagttgactgatctttacaaagaaccaaatttggtttcattgatcttctctattattttcatattttcagtttcattgatttttactcttatcatttcctcccttctacttgctttgggcttattttgctttttctatttgagcatgttttggtattcaattttaatttacctattgtgtttggttgtatatctttgtatagtgtttactggttgctccagggattataataaacctatgtaactcttcagagtctttttcaaatcaatattttaccacttcaagttgaatgttgagaccctgccatcatataggtccctctgtcctcccctgaatgttgttgtcttttatacacctacatacatggaaaactacatcagacagcattatcattcctctttaaaatacgcaagagcctaatctgttatattttttcaggtatttctgttgctcttcctttattcctgatgttcaaaatttctttctagcatcattttccccctgtctgaagaacttccttcagcaaccatcttagggtagatctgctggccacacattctataagttttgcttcatctgagaatgtctttatttctccttaattcttgaagtgtatttttgctggagatagaattctgggttgacagttctttttttttttttttcagcattttaacaatgttttgcacttcctttggacttcacagttttgataagaaatctgcagttatctgaaccatttttcccctataagtaatgcactgtttttctttgactgctttcaagacttttttttgtctatagttttcagagtgtgtttataacgtgtgggattgtgtttccttggatttctctcatttgaggtttgccgatctgttgaattggtaggtttatgcatttcacagaatttgagaagttttcagccattatttatccaaatatttgtttagtaatacattctttctcttctccttctgggacatgactgttagttagatctttcggtattttcccacagtctctaaggctcttggcattataaaatatttttactcgctgcagtttgaattgggtaacttctattgctctatcctcaagttcactgactcattcctctgtcatatccattctgctcttgagcctatccagtgagttcttaaagtttctgttattgtatttttcagttctaaaatttccgtttggtcctttttaaaaatatgtcttccgtttcttgctgagactatctttccattagttgccagagtttttgcccttactttatggagtatttttataatagctgctttaagatcattgtcagttaattccaacatatgtgctatctcagtcttgttatctgttggttgtatttgcctggaggagttgagattttcctggttcttggtatgccaagtaattttggactgtatcctggacactttgatattaccctatgagactttggatcttgtttaaatgctatggagaaggtcattatttttgtttgatcaggtaattaacccttgggttaattgggttccggctgcaagttccaatgtgcctgtggattgcggttcaatgtcaggtccattttcaaagcctgtgcagtcctattctgatcaatcccatgtaaacacaacccagtggcacgtctgggacctgggcattggtccacctcctaagtcagtccccagaacctatggcgtgttgtttagggtcagacccactcgtgcacggctcaagcacgagcccaggagtttctaaccaactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacgaagaaaagaaaaaggaaataggaaagaaaaatgaggtgttggcttggctctgagcattcggaaatgctttttctatccttgagctacaacaacagggcttgtctcgagctctgtctgtctgtacccagtgcccgcttctggagtttgacctgccttgtatctaggctgaggaataccagagaatgaagagtaaactctgcgggtttgctgaacctcacattctagtcttcttccccaatctgcatgctgttatttattttgcagggtcctcagctagctgctcatgaatccagtgcatttgggtggctgcaggcagtgggggatgcaggtgaggcgtgctcacaccatcctactggaacctgaaccttctcctagggacctctctatgtgttgagcggtttataatcagggagggacttctaccagcagaaatacagccataggcagatccctgctgaacaggaatttcatagagagagggagggagatcctgcccccagcaattctcacaacatgcccagagcaactgacaggggaatcaggtctcttccaccctccaggggctgcccactgcacagaggagaaaatccaatctcctccccacagcagaggaagctctgtgcagtctgcccccgcccaccactctgacctcctgtaccccacccaggcccaccactctgccctcctgtaccccacccaggcccaccactctgccctcctgtccctcgcccccgcccaccctttgctctccacactccactcacattggccttcttccctttcctcaaacatggcaggtctgttctgacctcgggtcctctgcatgtgctgttctctgtgctggagcccacttccccagatctctccatcgctgcctctttccaatcatttaggcctcagctccagtgtcatctcttccaggaagtcccccgcccccctcaacaatactctgtgctgttgtcctcacggctgcgtcactctctgtcgacttcctctttgcttgcttactgccatttgcccccccgggagatagcacccagggtctgcattcagccacaggtcgcaaatgtgaatgcacctttgtggccacatctatcggtgctgctggcaaggtggaggttgggaagccggacccactgggccacaagtcctcagggctccttcctggtccagaggacccccaggaggaggcagctctgcctccgcagagaatcttgctgcagtttgggttgtccggggccttatcactcccccgcttttttttttttttttttttttttttttgagacggtcttgctctgtcgcccagagcagctgggactacaggcgccccccaccacgcccggctaatgttttatatttttttagtagagacggggtttcactgtgttagccaggatggtctccatctcctgacctcatgatccgcccacctcagcctcccaaaatgctgggattacaggcatgagccaccgcacccggccatcacccccgtctattttcatacatgcagtggggtgagaggcagaagtcccggcttctgctcctgtgtggcttcctactcactctacactccccttcctgacgctggccagaggctggcggaagggctgtgctgggccaggactggcttgcagttcctctgcagggagtcccggagcctggggcctgagggctgccttggaagggcacccaggggcgaggtgtgcaggctgactgttcccaagcagctgggggcctgccctcgctcctctcccgggcacagcacgctgtgagcggggcatcccgcacgccctgctgccaccggctctccggctgcactccttcttcacacactggatgagaggacactgctggggcagcagggcacatggtgcaggggtcctgccctcatttgtgtcttttcccagaggatgggttgtctccaagttctgcgtcaaaactgaagttcagcatacttaagcccagtggttcacaaaggagatgcttgaaacccacttctctcccccagttactcaggtgctgcccagtggagagagatctgtgcacacagccttgtctccctgcggcatctgggcgccacagggcagccctcaagagatgcccctgtcccagtgcggggctggggaggagcccagccctgtgcgagcagatccggatccaccactcattagctgtctaatcctgaaagagtcatgtcatctcttggagcctgtttcccaatctgtaaaatgggcataatgatactgagctcacttcctttgccttcattatcttattttcaatcccttgacaactctgtaaagtaggtaatattgtgccattttagacacggaaaagcagaggtcgaaagaggccaaatagccacaagtgacagagtggggatttaagtctaaagatctcaagtttcggctgggctcaattctttccttcagcccaggatgttcagggatgacagccaggctgggcccctgagcaatgccctctgctgtctttttttttttttttttcctgggggacaggagcgagcagagcctccagaacctttgcccagatcacagtaggcggttcttgcagctgggaccagttcctcccacttggacagagtgaggagtccaggcttcactgaggccaggagggggctggccgccggctccagactggggaagcctgtgtttggggcttgtgctcagtgtgtggggacatcctccggcctctgtcctgcgggacctctccgacttttaattggctttcttctggctccgcgtagatgaagagtttttgccagagccagagccataacggtttatctgtctgctggcttgcgtttctcagactgttactgaattaagttgtatgtatgaagactcttaaataaaataatatcatcgtgtttattcggagcttggccttaaagtgcacttttgagtgtgcacatcattcttcttaaaccagggcctcctttataaggggatttatcttcactttgagaaacgtctgctaaagcctgctgtgccaaagtcctcatgcttactgctagagccacagaagtgaaggggggtctggcttgtcctcaggcagctcaaagtcagggggacggggacaaaagaccagccaaaaagtgttgcaaagacatcaatgggtgctataagaggatgctattcttttgtttctttagttttccattgtttacaattaaacattattcacaacaactgacaaaacatgattcacaataatttacattattcacaattaaaaattacttttgaacatacaaaacatatggtcattatcattgaataatgtagaaaagtattaaggagaaagcaaaaaccatgaaatcctacccttttgagatagtctctgtgagagacagaataatccttctcccaaagttgtccatgtcccagtcccgagaacctgggaataaatcaggtgacatagcaggggcagtgaaggttacagatggaagtcaggttgctaattagttgacttttaagataaggagattatcctggatggcacagtgtaatggcaaggattcttctttttttttttttttttttttgagacggagtctcactctgtcgcccaggctggagtgcagtggcataatctcaggctcactgcaagctccacctcctgggtccaagtgattctcctgcctcagcctccagagtagctgggactacaggcgcctgccaccacgcctggctaattttttgtatttttagtagagacggggtttcactgtgttagccaggatggtctccatctcctgaccttgtgatccgcccgcctcagcctcccaaagtgctgggattacaggtgtgagctggccatgacaaggattcataaaagtagaagatggaggcagaagttcagagtcagagaggggtcagtagatgctccggtgctggctttgaagatggaggagggggccacaagccaaggaatgtgggtagcctctaaaagctggaaaaaaacaaggaaacattctccttagagcttccagaaggaatgcagccctccccacaccttgattttagcccagtgagacccattgtggacttcagatctctagaactgtcagataataaatgtgtgtgtgtgtgtgtgtgtgtgtgtgtgtgtgtgtgtgtttgagttggagtcttgatctgttgcccaggctggagtgctgtggtgtgatcttggctcactgcaagctccgcctcctgggttcacaccattctcctgcctcagcctcccaagtagctgggactacaggtgcccgccaccacgcctggctaattttttgtatttttagtagagatggggtttcaccgtgttggccaggatggtctccatctcctgacctcgtgattcacccaccttggcctcccaaagtgctgggattacaggcgtgagccaccgcgcctggacaaatttgtgtttttaagccactacatttgcagtaatttgttacagctatacaaactaaccgtttttccatcttgttacatatatgtcacactcagaagtgagatcttgtcactcatgctatttgtatcaacatctttaggtttatggttgctctctcttctgccctcttgactggagcactggcttcatttattttcactctggtctataattaagaaggttgtgaacttgcttctggtggtggctttggtctcatccacaggttctgatgtgctgaattctcactgtcatcattttaaaaagatttatgattttgattccagtaacttaagagctatttagaggaatgttgaaaaaacttccgagtggttggattttaggttattaagctttgcgttgattcctagtataatccaaatgttttcagaccttagcatctctgggtttaaattgggtcttgtcagcatttatatctgcatcttgccattccagtgacaccccacccctaaccagcgcagatctcagtttcctacaagggcttgtgaatgcctccccctcaacccctctagcatttctaggcatctcccagttccgtagagcccgtccacacccctcctgccacgtgtgtattctgagcatcccaggctctgcaggtgtccctccgttcaggctgccataacaaaatatcacagactgggtgtttagaaacaacagaaatttatttctcacagttttggagtctcacatgtgagatcggggcgccagtgggtttggtgtctggtgagggctgcttcctcgctcatagctggggccttcttgctgtgtttgcacacagtggagggtgcacaagctccctgggcctctctgataagggcactaatcccattaacggggtccccaccctcatgacctcatcaccttccaaaggcccgcttcacaccatcaccttgggacaggaagagctcatctccatggaggcttggcagggccaggcctgccacagagttaggagtgaaggggacagcctgggttccccgagcctcggggaatttctgaaattgcctctgtctcctggtgtttgctcagcttctatgaatgtcaggtgggcttctgaagggagcacggaatctgcgttgcagggtcactgtggcacgaggggaccctggcctctggtgctgtggaaaccggagcagctgggggcggccagagagaggctgagcaggagggtgtggaggtccccggggccctggggaggagggacagaggccatgggcattggtgcgtgggagggagcagcagaggccagcctgctgagaagggctgtgagggaagggaggtcctgtggctggaggggaagcagagtcttcttgttcaggattgaagagacccggttctgttgttgggctgagagaggactttagagaggaggaggccgaagacgcagcaggggaggcgagaagggacttgtggagagccctgagggagctggtggtgggcagtgggttgtctcggctcagagcaagagctctccgtcctctgggattatagtggagggcgttgggggcactctgccagtgacttcatcagtaggggtggggagttggcattatgccccatgatgcaagggcccaagtcaccctggagagggaagccggggtcttgagggagggtcctgggagacatggggcctcagcgtattggggaagggaacagtcaagagaaaggggcaggctgtggggagggccttctggctggacagtactagcagggagtggggcagaagggggtccccataccaacttcacctcttggttcttggtgccgagaagcagcaatctcaggtttctgcattgccaggcaggtggggtgggaggctacggctgacaggcttgggggattcaggccaggcaggcaggggaggccgggatcaatttttgtaaatgctcccccatgcttgtaaagaatactcatttgctttcggttgtaagtcgtcagatccatccagaaatcaatccggcccatttcccgagtcaatgagtctgtgcccctctgctgtggtctaggagacctgtcacccactgggagtggccgttcgcatttccctttgacagggctgttgagccacttgtgtttctaaccatggcagatgctgcggcccttggtttgtaaagcttggtgactgtgtgctttcaccaagccttgtcaatacaacaggagtttccagtcatttagtacttgctctgagttctattttgatgatactacagacaccctgctttctgggtttgcagttttctctgtctctcttttagcatgtttcaggcatgtgttacagacggcatgccttgtttgttccatctcagtctggttgatctctaactgcaatgttaaacccattgatggttgtgttagtgataccagtggcccgtccttttttcggcctgcacctttgcatctttatgcttgacttgtcccctgtccaccctgggagcaggcaggcagctggtcttcccaggcaccaccctcctgacccacagcacgcagcagcctctctctgcccgccgcctctccctcctgccctctgcccaggccgcccctggggaccttacccactgagcccatctccacctgccttgcggtccttccttatccgagtcggatgccactggtcctctttgctgtacttgctccctgcctgtaccactgtctcccgcctcctgctttccttgctgaattgctgggtccagccccatccctcctcccttactttcctgcctccgagcaggggccccagcctcgctgaaggatctacttcgacattcctgactgctggcctctgcaggcagcatccccccttgggaccttcccgctccctgctcacccacctccttgctcacccacctccccctcctccgagcacagacaggccccggcattgcccctgcccgtcccttgagctccggctgctcccgggtcccatcattgtcagcattctcagaagcacagcccctgccgccacctcctccatggctctctggcatcacccaaagcgtctgctgaggtcccacggaccacagaggtgtggatcctgtggtcattctcctgtccccacggctcaggcctcccccatcctcctgcttcaccatcactgcatcgtccgaggcaccgccagctcctcggtttgctcttcccctgggctctgcaccttggcacgtgctgtgtggctgagcaggaccctcagtctcctggaccacagccagaaaggcatttcctcctgcagtggggcgtcctgggttggaggagccttccctcctcatggcagcctccttccacagccccacctgtctccacgcctcccttgctcccagcacaggccccactagtggtttcagcggaatatggaagggcttttgaggacgtgtgtggaaggtggccttggtggctgctcctgaatcccttccagagcctccagctcctcccaccccgactctcacttgcgggactgccccagccgccatggacggggctcctctgccctgctcagaatgttctggaccagcctgggactttgtgtcctgagtctgtggtggttgcagggaactggctcacccgtgtgcttcagggtggaaattgggctggagtgtggaagtcccatcccaaaccctagagatgggaccagcacctggactatgagagtgagggctgcctggtcgggctacagggcatgtcggatcagtcaggggcctgggacacataagggatcaacagaaaggagttgacaaaggcacaactcacagagctgcgggcaggacgagggagcttgcagggcggggaggctgggggccaccacagcgggagaaataaaaccttctgtctctctccccagccctggcttcctgtcggtgccccccttcacccagggagagccaggaggagccagtccatcaggtctgcctactgggctgtaggacagggcagaaggtgaaggggtggggagcccaacagagacccgccagcccagaacatcagcctggaaggaagggacgcagggacctggttcttctctgtgtcttttcaaagccaggtttcctttctaatccagaatctatttattcagccaggcctggtgccagatgctctcaggctctgaggatgacagacaaacccagcagcctccagtagggtgctcaaggcctggttttgaagtggaaacaatgatccatgcggccagtgggaacccgccaagttccccacaggcccgttcgcctagaggcagtagttgagagcgacaggagggcctccatgccaggagtctgcacagtgactcttccttccttctttagactgcctcagaggctgtcagcatttggggtggaaaagagttgtcctgttgagtgtatacatgacctaagtctactggagactcaatgagggaattgaaggatttttcagggaaaatgttgacatttcctgctgaccctagaaagcaagcccctccgcttggccagcaggaagtttctctggcatcaggggcaggccaccttggaagctgggcacacggggcaggggccaccctgcggatgtgggtgcagccctgcggggaagctgcagtgggggcgggggcagggcttggggtggcccttccactccccaagtctgtgggtgcccaatctccagaccaccattccggacctccacaagctgcctccttgggccacgtgggtgggtcagacttgcatgggtgctcagcatccctgggtcgggttgatcctggcaccccctagggtgggtctgctgggcagccctcggagcctggacagagcttctagccatgcacccatcttccctgttcatgggattgagtcaccaaaggaagggcattcattaaaaataattggctggctggacgtgtttctgggctgtcagctctgactgtaggctgcgtgccttcatcaacatctttctcccggttcccagtcatattttttctttttgaaagtgtctttttctgttacccaggctggagtgcagtggcagcatcttagctcactgcagcttggaccttcagggtttaggtgattctcccacctcagcctcccaagtagctgggaccacaggcatgcaccaccacacccagctaatttttaaattatttgtagagatgaggcctcactatgctggtctggaactcctgggctcaagcagtcttcctgcctcggcctcccaaaagtgctgggattgcaggccccagttcccagtcattaagtggaatgtttgagatgcacaaataccttaaaacaaaaaaacaaaaaaacaaaaaaaccttggccaggtgcggtggctcacacctgtaatctcagcattttgggaagccagggcaggcggatcacagggtcaggagttcgagaccacctagccaatgtgatgaaaccccattctactaaaaaaatacaaaaaaaaaaaaaatttagctgggtgtggtggcgtgtgcctgtaatcacagctactcgggaggctgagacacgagaatcacttgaacccaggaggtggaggttgtggtgagcccagatcatgccactgcactccagcctaggcgacagagcaagattccatcttgagaaaaaaaacaaacaaacaaaaccctaccctggaatgccaactccggtgcttgtcttgggctgggatctatggggcactggcctgttctggcctagcaatgggaggctgatgtcccacgcttgtcctgggctgtggcccggaggcgttggcacactccagtccacatgggaaggccatgttccctatctgtctagctcagcgcacggctctgactcactgcagttagcagggaaaatactcttcacattgagatgtcagttttcacttcaagcctgatttctgatccataaacaaagcctgcaagaatcagaggctgctcatgtgggagtcagctaattaatctgactttcctcaaggaaggcacaggccgctgcctcttttgtgaagattagcactttttaaggacgtgtgagtctgtcaggacaaagcaacaccaataacgttccttattttcggggagcagaggaaagtggggtcagactgtcttccccgtggacaaggaggagcggcttcaggttagcacttacaccagtgctgtgagtgagaagctgtggctgtcaccaaggtgaggtcatggctgcaggaaagacgcttcccaccctctccccccaacaacagaggatgtcccaagcccaggggaccggccagcgtagctcctgacaacctctaggaaaacaggagggcttctctttggatggcaaaactgacctcaactcacttaagcagaagacaattcaaggcaggctattggggggctggggctggaggcctggaaatggggtaccttggagggccccagccaggacctcaggaagccgtctgggcagtggtctgcactccagggtggggtgggagcttggattggccctgcttacaatgggcttctctctcagatgtatcttgcaaggagagagagtcaccttgggcaagctgactcccacccacccaggccccttcctgacagtccttctaggctgttcccaaaggcatggctggctgtccctaggatacatggggccctgggcatatatttcctgcaggactcctgtctatatagacaatttgattaaaaaatttataacaagattcatgagcccacatggggaatagcaagatgtatcaaggaagatttaggggacggggaggagaagcacgaacacatttgctcactgtctgctcagtgcttgcagagaccctcgttactgctcaggctcaggagctatctcttcctgttctttatggtcgagtgtgctgtcccagctaatttcatatttatatctcccacagctggggggtaatagcaaagctgttaccgctcacaatgtgtggctctttggaacctgtttgtgtggagatgctgtatatcttcttgccccgcattccccagccccatgtatttagtgctggttgtggcatttctcctgactccgccgcttctctctgcccccgggaatgccggcttccgttgttcccttgaaggtggttaccgtgcttcattaatgatgaccaccaatgtggatcttgcccagagtgtgcaagaaaatgtgagccatacgtcctcatctggtcgtgttaaatttaatgtttgggccaggtgtggtggctcacatctgtaatcccagcattttgggagaccaaggcagtaggattacttgagcccaggagttcaacatcagccctggcaacatagcaagacctcatttctacaaatttttttttttcttttaattagctagctgttgtggcacacgtctgtggtcccagctacttgggaggctgagttgggaggatcacttgagcccagggggtccaggctgcagtgagctgtgtttgagccactgtactgcagtgggtgacacagtaagatcctgtctctaaataaataaataaataaataaatatcgtttggacctttatagcgaagggaagaaccacacatcttgcagcctcatcttccccatcagtcctgaggctgttacttctgcactcccagaattcaacctcgtttaatggtgggcacactcccgccttccacactctgccaccagcaggcagaatgacaagagaagagggatcccagttgtgacaggcattccatccctctgcagaccagcctgggaggagagcatgatgtccagcacggcttggaggcaagagaggacacgggaagggtcgtggcattgcagggcaacagcttccctctgaaagcactccaagcaggtggatgcagccagccctggaagactgcccggaaatgacacggaacctttgagggtgtgggccaccgccctgggcaccagtgacagaggcacagagtgaaggatgtctgctgccactgcccacccctgaacaccagagcccggaggtggccccacagccgatgcaggagcccacaagtgccactcaggcttgaggcttgggcagctgtatcccagagccccgcactcattctgtctgatgtgagtgggaatcctcaaaacccacgtgtcagcatcatgctggtggctcagtcccattcacacctgtgaaggaagtcccctcctggccagtgagggtggctcgctcatcaagccactcactgagacctgaagcaacctcatagtcaacagccctagagctcctggggcatccgtggccccatgcacagggcagagggttggagagtgccctgaagggaacggcagggcccacagggcggctcaggcataggccctctgcacaagagcattgctccggctacacggttctccctggtgttcctggaacacgccaggcttgcttccttctcagggcctctgtacttgctccccgatccctggaacctaccaccttctacaggacctgctccctggacactggggatgcagtgggcgcctccactccagggaaaggcagccaatgtgaagaatggaccggccagagagcactgagggaggctggggcccagttttatttttatgtgtttaaagttttaattttgaaataactttagatctatgctgtcttggaaaaattgcaagaaaagttgcaaaaatagcatagatttcctctgtgcccttcacccagcttcctccgtatgcaacgtagaacaaggactgaaaccaggaactttgtaggttgatactaagcgttggtacttagtgtcttagttttagtctattttgtgttgctataatggaatacctgagactgggtaatttataaagaaaagaagcttatttagctcatggttctgcaggctgggaagttcaagagcatggccctggcttctggtgaggcctttttgtgctgtgtcataacgtggtggagagggtcaaagggaaagcccatgtgtgcaaagaagggaaacccagggagtgtcctgcttttataacaacccaggctcgggaactaatcaagcctctccagagcaagaattcccttgctaccttgagaacagtatcaagccactcacgagggatcggcctccatgattcagatacctcaccccaggccccaccttccaacactgccacactggggaccaaatgtcaagatgagttttggtgggaacaaaccagtcacattctaaccgtagcactccagactgcactgaattttgtcagtcttccgactcatgtccgttgtctggttcaggctccccctcaggatcccacgtggcatttagttgttgtgtctctcccgtttcctcccatctgaggtttcatgacctggatgtttttgaagaggactggtcagctgttttgtagacggtgcatccccatgggtttttctggtgtgccttgtactggcttgagcttacgtgtttctggcaggactgtcacagaagcactgtgccctccgtagggcaccacgctgggactgtcacattgggatgtccagttgtctcctattgtcagtgatgcccttcttcatttggctaaggtgttacctactgggattccactggatgccccgggagctctagggctgtgactgtgaggttttttcaggtctcagatgagtggcttgatgagcaaaccactctttcactcttttttcccattgcgatgattaaatctcccgtgggtagctgctgtgacgtgatgtgagcattctgtttcttgttatccttttgctcactaattgtagcctccacggataagtcgtacctgccgcagtcctgactgtgctgttgccgatggggtttactaccatgattttctatctcatcatttcttttacatttttagttgaattaccctgtgagaaagagctgcccttcccctcccacttatttattattcagttatttgtttctaccaatactgatctgtggatatttattttattcaatgggttctaacctattactatcatttattattgtgttcaaattgccccagatttgaccaccgaaagcaccttccagctgcctcctccatcgttccgctgtgcttgggtgtgatttcacacggggcggtgggacaggccgtctctgagcagggagtgtgggtgtgagcagagccctgcaggaggggcgcagtcctgtggcagtcagaaccagctggggggctgcagcctgctctcggggaaggcctggtatgcacaaggtcagcacctggcctggagctgccacctgctcacctgtctggtttctggtgggggccctgagatcccgggcttggcactgccggagggcggggctgtgctgcggtatggatgccgtgccgtgctgtgctgtgcaggcagggttactggacataagcctggtgtggcctttcataccctggggtgccactgtctcccagtgtgacacctggtggccttgtcccttgtgaggaccaggatctgtggggcacttgatcccatgagttcagtctccccgaatctgtagtggcatccagggagggcaggtgcgcctgagcctgcctgcattctggatacggcgcctttggtcattgctggcctcgctgctccggctctccagtgggccaaccacccacagaggggcctagggccctggcggctgctgtcctggctctagaataaatacacatcccagagtcaccagtgtgggctcaccagtgctggggccctgcccccgcccctcccccggagccaccctgggtgggtggggacacgggctgggcagtgtctgaaggcctgcagagcagcctggccacagcccagacaacctggccctcagagccctggctcttcccataaataaaccagacaggatccttcgtcagatggtatggcctgatttttgttttgggaactctggacagaaggggaagcagacagcctcgggcctggcagggctgcccgcccgggagtggcagctgggcaggcgggcagaggacggtcggcggtcagcgtgccctggatagcacagtgggccccagagatcacagcaggaaaagaagcccaattcaaaggaagcaggagtgaggcagtgcacaggctctgtgtgtgcatgaggccggaggggtcctgagaggggcctgtggcccagggacccggggagatgacagcctgtgatggaaagtgaaagggggggtcctctggctgggaaaactgcctgatctgggcagctttgcacaagcagacatggaggacatgccccactgagtctcaccatcaactctcaactgcagccccctctgggggaaccgaggctttgagagaggaaaggctgatccttgttgcacagtggagtggggggactggcgttgggcgggctgcgtcccagcctgtgctctccccatgggagttcctgtctgcccctgcttctaagggggacgtccgtcgggtagtgtgtcttccccacactgctgggagccagccaggcagctgggcccttggtgggcactggtttccctctgagcacctggcccctcctggaggagcacccgctgtgggaaggagcagaccctgcctcctgggtcctcgagactggggacctgctctccgggctgagctgccacagaaagggtattggatgctgttcaaaacacgccacacatctagaattgcataccccgtcttccaacagctgcgtagactcagccttgggatcgcccagaaaattctggggtgcagtgggcatggggagtgcccccacacgggagccttagccagcctctctgcaggaatgtgagacaccagcctcagctggctccagtcgtgggctctggagcagggctcctgctggaccgtgagagagtggcctgctgctggcggaggggtcctgaggcccgtccaccacccaccggctgtgcagcattcttgtctccctgcgcctgcactcactgccccgtgtccccatgtgagaatgcccagtttagaaggaagggtgagatgggcatcccatgtggccagccctgggcgggctcctacttccctggagtggcagctttcctccatgctggatttctggcccctggggagtgatcctggcattgaccttccggcctgtccagagtggctccccaaggaacagcccgcccagctctggccaccggaccctgccagcagcctgctccgattctgtgtggacttggcgcctggaggctgttatgggctgagtgacgccctccctagatcccccagttcctttgttgaggtcctaaactcccgtagatcaggatattggctgtatttggaggcagggtctttaaagagataattaactgaaaatgaagtcactgattcaacatgaatgactggtgtcctaagaagaagcgattaggacagaagtacacacagggggacggccatgtgaggacaggggaaagatgctgtcgacaagccaaggagagaggcctcgagagaaaccgcctctgcccacaccttaattttagagctctagcctccaggactgtgagagaataggttctgctattcaagccccggcctgtgctgccctgtgatggctgcccgagcaacctagggaaggcgccggccccgaccttttgtgggagggggtgctggcagtctacctgggcagcatctcctggtggatgtgggtgagcctgctgtgaatgctgggggacggtcctgggtccccaggccctcagttcttggagtgcagccttgcagggtttggttgctctccagggtgggtcccctggggaatctggtaaggaagcatatgttggcaactcccagacatgtgcccctgccaccccagccccctgagcagacagacccaccgtgccggctctgtctctgggagtgctggtgctcaggcgtgctggtctcccgggctggttggaggaagggaggggcggtgtgtgcagacctccaaggaggcagggaggctggcagggaacagctgtgcaaaggtgttaggttccagctggtgtgggcaggtgccagcccagggaagggcctgtcgacagggtcttttttttttttttttttttttgagacaagagtctctcactctgtagcccaagctggagtgcagcggtgcgatcttagctcattgcaacctccgccttctgggctcaagcgattctcatgcctcagcctcccgagtagctgggactacagacgcccaccaccatgtcccgctaatttgttgtattttggtagagacagggtttcaccatgttgcccaggatggtctcaaactcctgacctcaggtgatccgcctgcctcggcctcccaaagtgctaggattataggcgtgagccaccgtgcccggcctgttggcaggatcttgaatggggaagttggaccttattccatgagctctcctccaccacacgtctcaaggccacaatctgctgtggtccagctggtgagacatggaagctcagaaagaaaaatcttgctttttgatagtttggcaaatgttcctgcagcacgagtcatttttcttctttagtagagagcgccctgttatttatgtgaatgttaatttgtgactggggacgttccccgacgtgggcttcatgctgaacgagacctgggaaatgtcagccagagaatctggccgggacgagtgtcagttctcgtcacaaataggcaggcctgttgcagtcccagagtctgggtctgacccactgacctctgtgtcctggctgggtctggctggccagctctgtttcctggaggctaccccggcattggtgtgtgcaggagccatggagatgggggagctggctgcagagggctgagtgtgggacattctggacaggccaggtcccgagggagccactcaagcgttgcttgatttagcagaaggccgcctggctggcccctgcgctggccccgtgaggcattcttgtcggcatcttgtttattccattttcccccttatctttctctctgtgctctccccctttccgtctctcctgtcttcacatgaattgtctgttttgctatatgccctttgtaaaaatgtaaaacaaaaaaaatacagaaaatattaataaaaagtgaaactcacccccgatcgtaacactgctgaccctttgttacgcgtttcctaacagctgtcatgccatgatcatcatgatggtgatggtgctgccagtcggctgatttatcacgtgctgtgcccagtgctagagacgcggtatctcgcttagccctcacatcagccatggaaaccctgttattatctccattcaaccctgcagacactgtccacagagaggccactcagtcagaggtgaagtaaacatttgaatcgaggcagagtgactcggaggccacatgcttaattattagactgtgctgacgtttggcacagagatatacatgattttacgtaaggaggtcatgctgcagctgggcttgccgccttcttcggtcaccaatatgtcatgggtgtgtctgttccttaagtggtcaaaaaatctgagaaactcttttagcctagcataaatctgtaaattttgtaaaattattttgcagggcatagagtgttattgaaataatctgactggctgggaacggtggttcacacctgtaatcccagcactttgggaggccgaggtgggcggatcacctgaggtcaggagttcgagaccagcctggccaacatggcgaaaccccgtctctactaaaaatgcaaaaattagccaggcatggtgttgtgcacctgtaatcccagctacttgggaggctgaggcaggagaattgcttgaacctgggaggcagaggtctcagtgaactgagctcaggccactgtactccactccagcctgggtgacagaacaagacactgtctccaaaataataataataataatctgaccatttattgtttttgttgtctgtttttgtttgtttgtttgtttttgagatggagtctcactctgttgcccagaatggagtgcagtgatgcaatctcggctcactgcaacctcagcctcctgggttcaagcaattctcctgcctcagcctcccaagcagctgggaccacaggcgcgtaccaccaagcccggctaatttttgggtttttagtagagacggggtttcaccatattggccaggctggtcttgaactcctggccttgtgatccattcgcctcgtcctcccaaagtgctgggattatggacgtgagccactgcgcccggttggattttgggtttttttgagacagggtatctctctgtctcccaggctggagtctccaaaataataataataataataatctgaccatttattgttttgttttgtttgtttagttttaggttttggtttttttgagtcagggtctgtctctgtctcccaggctggagtgcagtgacatgatctcggctcactgtaactctgcctcctgggttcaagtgattctcccgcctcagcctcctgagtagctgggattacaggtgtgcaccaccacgtctggctaattttgtatttttaggacagatggggtttcaccatgttggccagcctggtctcaaattcctaactgcctcagcctcccagagttctgggatcacatcatgcccagcctacatttattgttatatatttgttcttacttctgtcatctaatttatgttttctgtttttctggatttttttttttttttttttttttgctgtttttctagtctaccatattttctatatggtctgccttcagtcatttggaaggtatacattagttttactagttgtgacttttctaattttgagtagaattcttcagcttgtatctactgattttagaaacttaccagtaactgttgatgctaactgaagattctgaagattaggaaacgagtgcaattaaactgtaattccttttttcttcctctactctttgtctgattgttgtgggcttgtttggcaattttttgcctgcccccatttattaaagttaaattatgaatagtttatatattacatagctttttttttccagaatatatgctaaatgtcttctgatttgtaaccctcattatccctgtagcatagatgcagagggcaattccgctatttcgacctgtgatttccccacttgccaggtgtctcagttttaaagtcaagtccaggctgcgtaaagtggcaggtggggggtgctggggagggatgccaagcagaactgagacagacgctctcgagggcattctctagcagcagggttgaagccatccctctgtgcaccctctcccagggcccagagttgctcacagtggctcacctggttagttgatagacttagggctcccatctcaagatgacatggttttaccgtgttagccaggatggtctcaatctcctgacctcgtgatccgcctgcctcagcctcccaaagtgctgggattacagggtgtgagccaccatgcctgaccaagcccttggtttctaatgcagagtttctttgtaggccaatgtttcctaaacattggcctaggaggtgaactaatgggtaccaaacatgactccagaatgcatttaattctatcaaatcccagctagctttgtggcagaaattgacaagctgatcctaaaattcatacagaaatacaagggatccagactaaccaaaatgctattgaggagaagaacagaggaagggctcatgctttgtaattctaagacttactacaaagctgtagtaatcaagactgtgtggtgttggcagaaggatagacatatagattggtagaatagaactgagagtttggaaatacatcctcatattgattcttgacaaaggtccaagacaagtcagtgggggaaagaatggtcttttcaacaaatggtgttggcacacctggatatccacatatggaaaaatgaagttggaccccttcctcacaccatacacaaatattaactgtaaatggatggatcatagatctacatgtaagagctaaaactatagaactcttaaataatgtaggagtaaatctttgttactttggattaggcaaagtcttagatatgacaccagaagcacaagtggacaaaagaaaaaaataggtgaactggacttcaagaaagtccttcatgacttcagtggacactaataagaaagttgaaaagacagcccacagaacaagagaaaatattcataaattgtatatctaataagggatttgtgtctagaatatataaagagctcttacaggtcaataaaaagaaaatggtcttattaaaaatagggaaagtatctgaatggatgtttctccaaagttaaataaatgacctataagctcatgaaaagatgcttagcatcattagttgtcagggaaatgcaagccgaagcatgatgggacaccacttcacacctgctggatagctagagtcaaagagcctaagaataatgagtattggtggggatgaggggaaattgaaccctcacacactgctgggggcactgagaatggtccagcccctgtagaggacagtctggcacagttactgtatgacccagtaattccactttgagaggaatgaaaacacatgtccacacaaaaacttgtccacagatgttcatagcagcattatgcataggagccaaaaaccaacaacccacatgtccatcaactggcaaatggataaataaaatgtggtatatacatgtgatggggtattatttgacaataaaagaggaatgaaatactgctatatgctacaccatggatgaaccttgaaaacatactaagtgaaggaagccagtcacaaaaggccacatagcatgtgattccacgtatatgaaatgtccagaataggccaattcatagagacagaatgtagattagtggttgcccagggctgggttggggaggagaggttggggaaaacatggggagtgactgccaatgtgtacggggtttctttttggggtgatgaaaatgttctaaaatcaatagtggttatggttgaattgttcactttcagcatatagtttagatggctgagatgtatggaatggtaatcacagcaccataaagctgttatatattaaaaagcattgaactggccgggcgccatggcttatgcctgtaatcccagcactttgtgaggccgaggcaggtggatcacctgaggtcaggagtttgagaccagcctggccaacatggtgaaaccccatctctactagaaatacaaaaattagctggatgtggtggtgtgtaccagtaatcccagttacttgggaggctgaggcaggagaatcgcttaaaaatgggaggcagagtttgcagtgagctgaggttgtgccactgcactccagcctgggtgacagagcgagactctgtctcaaaaaaagaagaaaaaaagcattgaactttataatgaaaaatgattcccttttcagttgcattttaaactctctggttgagtcgaggggagtctcagtttggtgctgacagatctttaccagctctctgctacttactgacctctataacaagagagaagggcagtggtgtaggctttgaggtgcaaatagaagcccggagagagaggaagacactgggggtgcgcccagggacagagggctgctgggaccccatggaaggccttgcgtgccatgggacggccttggcctttattttacaggagtgggtttctggtttttggtttggttctttctccttggtcctagtagagttttagaaggatgatcggtacctgccaacgtgtgcggggtttctttttggggtgatgaataaacaggataagcagtaattcataggttacgtagtccagctcctcagtttgcagatgagggaactgggggcctgcaagggggcaggactggccatgaccgcattggaaaccagggcccctggctcagcgtccagtgcttactctccctgcctgcctcgccccccaccctgcccttcaaagtggagtctagctttccttagagcctcgctgggcatgtgactgtcggggctccttggtcctgttggaaattggctccggccagcttaggccaaaaaagagactttctggagtaaaggtctgtagggcctgaaaccaggtccagggaaggttagagtggccaagcaaagtcatcaggttctgtggagctcagaggcaactctgttgtggtcactgtgctcagcagaaccctggaaggcccagctccagccatagctccaagacagagccctagacaaggggtcgctctccaagaggaaggacgggagtggctggcacctggcgaggatcccatgagacagaggaggagctggtggagatgcgggtgaggacagctgtttcctaaccccatggacagctcctgcccgctggcgtcccttttggaaaagtggaaaagtcagtgtgtgaaatcctctgggatgctgaactgtaaaggagcccccagtggtgaggaccgagtggctcaaatcccactcgatacttcccactcctgggactgtccagtggtgaggacggagtggctcaaatcccactcaatgacacttcccactcctgggactgttcagtagtgaggggtccagcccccttccctgaaagctcccaaggttgttagagacctccctggggagctgggagaggcaagagagtgcccgagcaggctctgagaggaggcgccctgggaactgcaggcactgtgcagctctccctgtgagaccgtcattccaccaggcagctgtcacagcaggggaggctgcctggccattgccccgttgtccagcagatctcccaggttcattaccaaaaggaagatggggagaaagaatcttggagttagaatactttcaggaatgggaatcttagcagatgccagcatctgggggactcttggcaaggtgcgtgctgtgtgtgtatttcggagggaggtgagtttgagggcaacagggacttgcagccttgtcccttggcaaagtctgggtccctctgtgcatggacctgtgtgcttcctatgctttgtgccttctatgcttgattgttgccactgcaaccttggcacacacctgacagtgtttatgctggaggttgacagggttgagtgacagaccaggtcccagtcatacacaggtggggggctgctgatggctgcagctgtggcttccatgggaaggggcagtgggaaccagccagcctgggtgctctgcagaaggaaacaggatgcatgcttgtgtttcctgtgaacccctaacttccaggctgtctgtggttgaatacttaaaaattcagagtaatagaggagagctgttaagcctttggatctttataaatttttaacatctagttgccatttctagtaactactttaccatcaatccaactgcaaaggagcaggttctatagaaggaagaggcagggcaggcgttgtgtaactcaccaggatctgaatgccggcaacttgacttgatgacccgggtactaccaggctctgggcccctgcggtggcacctgaaggtcagggacagagccctccccatgatcctctctctgtcccccaggggagaacctggctgggtttgccagacatccacagacttcaagagcagagcgggactcacacttagagccaggtcggggtaccaacctttctgtaagaccccaggctggacagctgtggggttggacagacaggccaccagcaggctcccaactgagtgcttttcagcctagtgtgcttctggagtttctttaatatttattgagtggggagaggaaactgattctaattaataaaaattacatgtaaaaacagatacacttgacactggcagcaggaaaatcaaagtcccggaaaaaaatgcagcaaaacatagctcacattttgtgctttgctctcctgtcaattttcttctgtgtgttttagacagatcattcctgggatgcatatactgaagtgtttgaaaatcagggaataaaatgatctccacttcttccgtgaagtgccccccgccccgagcattattctggccagcggtcttggcaggacgtcagctgatggtcctgggggggtcagcctttggtctcgggggggtcagcctttggtctcgcggggggtcagcctttggtctcgggggcggtcagcctttggtctcgggggcggtcagcctttggtctcgggggggtcagcctttggtctcgggggggtcagcctttggtctcgggggggtgtcagcctttggtctcacgggggggtcagcctttggtctcagggggggtcagcctttggtctcggggggggttcagcctttggtctcggggggggtcagcctttggtctcgcgggggggtcagcctttggtctcgggggcggtcagcctttggtctcggggggtgtcagcctttggtctcgggggggttcagcctttggtctcgcgggggggtcagcctttggtctcgggggtgtcagcctttggtctctggggggtgtcagcctttggtctcgggggggtcagcctttggtctctggggggtgtcagcctttggtctcgggtggggggtcagcctttggtctcgcgggggggtcagcctttggtctcgggggggtcagcctttggtctctggggggtgtcagcctttggtctcgggtggggggtcagcctttggtctcgggggggggggtcagcctttggtctcgggggcggtcagcctttggtctcgcggggggtcagcctttggtctcggggggggggtcagcctttggtctcgggggggtcagccctttggtctcggggcaggtgccaccatgttcatcgtccagcatgcgttgtgcgcatcgcacggtggtcaacagagacgggcggggctgtgaggagcatgttgaacgtctgtgttggagaatgccaccgcttggaggcttctggctgtgtgaggaagcctgagcccaggccctgcttcagatggaccccagtgtgctcctgtgccctccgaggagtcgcctgcaggggtgcccttccaggaggcaaggcccagggcagcatcagatggagctagtgctgttggctcagcccagtgattgtcctcagggaggcagccagggaggggagcctgacccctgctggtcagggagaccccaaactgtcccccgggttactccggccagagagtactgcccttccccaggctgagcctggcctcattgtcacactaggtccctccagaataaccccagggcctcaggcctgtggcatcgatggctcccgacctgggctgcaagttcccccagaagatggagctgccataaggggtcctcatgccccagtgtcctgccctaattggctcaatcggcccagtctggcccagggacctgtctgggagatgccctttccgtgtaggtgtgagttctgatccctagaacctgtgtgtccccagcagcctgtctgcccatctaggcctcggtttcctcatttggaaagcaagctggctggatgaaatcacttgggtggaggcgtggcctggttctcagtgtctcccaggctgcatgtgctcctgtgtgagtgtgcacgggaaatgaccggcctcatgtacagacgagtcactggacgcttggggagcttgacaccttgcctgaggtcacctggccagatagaaagggtgccaggaagtcagaacttcacgctccaggacagcttgcccgctgccgccccccagggttaattcctgcacttcatccaatgagtttcagtcataagatggatttgaggcaccagccttctccacaccacgcaccgggaccatcagtgctggaccctcccaactcctgcactggtaaacacactgcccctgtgccagtggacaggcctggctgtgttcttcccgcctgcctgctcggtgcctcccttgggggacgtggcctgcagctttggggtcatcggttcgctcattccacaggcatctgctgagtcttcgccaggcctggttgagccctgagacccagggatgagtcagaagcgtggggcctgcagggttcccaccccctcttccgctctcctcccacagccctgctgacctccttctccgacctcggtcttgccctggtaactctggttaccactgcctcctaggcctcttccccagaagcccaggatgcctgagcccagagggtcctgcgccccttgcccttcttctcatgcccctcggagaatggcacccactttgccggccacccaccaggaccctgaattacttttctgcggctgctgtaaggaaccacttaaaacagcaggaattcgttctctcacagttctgaggccggacgtccgaagtcggtataacctgacccaaatccaggcatcggcagggctgcgctccctctggagactctgggggaggacactttctggcctctgccagctcctgggggctgccagcattccttggcttgaggccacatcgctccaatctccaaagctggcatctggcatcctccctgtctgcccatggcctcgtcctctgcgcatctgcctaatccccctccactccccggcataaggaagtgggcaaggactgcattcagggcccagccagccccagagctgacctgatcacacccgcagagtctctttccaccatgtccactaccctcacagctgccagggatgggggcctgggtaactttgggggccggttcttcagccacagacctggaagcccaccaggtgcttcctcctccctcccatctcagccggctctaccctaccacgtcctgtccatttcgctcctcacctccttcatacctgccactcgtccttgtctctcatgctcccgtctggaccattacccctctcccaggtgcctgtaacaccttctccccaggaccccagacccatttttgttccgcagcccattccccctgccgcagccaccatgcttctgaactggaatcagatcaaggctccccccagaagccctgggctgcctacaatctccctcaccagccccctgagtgatgggccaccgggcaccgtgcccttgatgctcctgtccacccacctggtcagctcttcccaccagctgtgctccgtccacctccccggccatggcatgtgcggtttcccccatatggagcactggtcctctctctgactctttgcctggccagcacaaagggattgggtgggtttgggtagatgtcacctcctgccggaggcatccttcattctggagccaggcctgatgctgggctctgtgttcctccaggccctgcacctccaccagcccctgcctggcacatcagcttcccgagggcccaggctgagtgcgccgggaggcatctccagcctccctcgctacacttgaggctaggggcagccgcccagcaggccctggggggcactgactgcatctcggtctgcagaggctcccagccagcaacaggatggggctcaccgagcacctggggtcagggagaaggaggggcagcccgtgcgccaccgtgcccccccacaaccaagatgatgatatggcagaggccatcatgaggttactttggggggggtgtggtttccgcacatccagatggcaggtgccgggggctgcccaccagagggcacactcctaactggacaggggaccccggccagcgccagctaagctggagtgtcgatgggtgctggaaatgccagcttttctgattttcaagagagtctggaaatctggtcgtttatgtgaactctcctgtttcttaagtttggcaacaaattcaagcttttaaaatcccctgcatgggtcataagcttgtgatctgaaggaaacactctgaaggctggacacagtgtgcacttccagtgtgagaccttggtttatggataatggaccagaagataaaagtgtaggagctggagttgtcatgggatgggtggacctgatggtgccagcaggctggatggcagggtatggcaggggagggcagggtatggcaggggagggcaggctggatggcaggggagggcaggagacgtgaggggggctgaatcaggccttgaagggggaacacaggtttaccagatggccgagctggggatggggtggtggggtgggagaatggggattcctgagttggcagcatggggttcaggggctgggtggctcggcagggtgcacccagcccagtgagaagcatggggtggtgcaagccgcggtctgggagggtggggcaggccaagagcctgaatgccagcatatagagcagcctgagtcccaacggaaatgaggacccagcgaggagtttgtagtcagggagggtgctggctggcctagggggtcaggggcagcagttcagctgcctgtagagtctgggctggtggctgacacagagagcaggagagacagttggggggcagtagggactggagccagttgcaggggcatgtgttccatccaagacccgctgtggtcagggcctgcgtttccaaggaaagctgggattccatgttcaagacatgaaatctcatcattctgagtgttagcttcagagctttaaaaatattgtttggcccagatggaacatgtgtgtgggcagattcaatccccggctggctgttttgacctttgtcttggactctgggctcctgggagtgggggcagcacttggcccatattgatgcactttggtggatgccctcctggggacacgcacaggcccacagctgcccttgaatgtctccctgcttctctggacggttttgactttataaacacagtaacttttctgaaagcagacagggttggtgtataggggtggagatgacccagacagaggcccctttcctagacagggtgggcggcggggggcggcctctgggaccacatgttcataccctccggccagcccagggttcaagctgagcaccagctggggtgctgggcagggtcttcaggtgggaggtactccctgagggggtctcctcgctgttccccttccttggtcttttgtgtgctggaaatctgatcctgttgtctttgtcccgcaggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggtgaggctactgcaggtgggcaggctgtgtggagagccctctgaggccctggtccccaggggagcatcccagagactcaggcagctctccacagaccagcttggctgctgaggctgagccccggtctcagtggctcagaaatgggccagctgcctggctgacggcagggcgtagcagggctgctggggctggggcctctgttctgggtgcatgtgggtgacaagcagcccagacacctctgccttcatgtctggggcctccatggtggactatgaaggctgtccaagggcccatcttctgttgcctaaaggcaagcaagtgtcgtggagcggggcgggggcccccggccaggcctgagtccagtgcctgcgtctctgagtctgtgcctgtgaagaggcctccagagccccagacagcgcctctcctgctctgtgctgccatggtccctgggagggtgcctgtggtaggtcccaaccctcacctggctgctcagggagaaaggccctgcatgctctttctggatccctggaggcatgtgccctacaaggactctggaggtgctcccagcagcctcagcagtctctgcacagactcatgggcgtctgtctttttcaactcagaacccacgtgtgccctgggcccagaaacgtgaaaggagctgccaggcggccatggtgacagtccatgactgtcgcctcagatctggcctcactgtgccagcccacacctcccagcatcccccagtctctggtcctggattgtggtgaagccagggttggtgtctgatgtggttctgcaggcccatagttctcagggtcccccgtgtggtcagggactcctggcctgtgcttggctcttgctgggagagtgggaagctgcgagctcagccctcagcctctggtcaggacccctgggtgaggagagtctggagtctggggcccaggatcgggcacacctgcacgttcacagcgagtgctccaggggcctgggctgggccagcccccgtgctgtgatttactaaggtactcccgtcactccatagcagccccgcctcatttactgtaggtctgtctgacttcctagcttgacagaaaaattgggtacagcctggcaggcatacttctaatttcatgaaacggcatcagatacctttgcaaaggaattgttccatcaggaagcccaatgtactctggagccaatcagtgcaaccggtggccccttgttccttggtgacaaatcagcgtctgctatgctgcagacagccgggccactgggtactgcctgcccagccttttccagctgtggtctcagcctcgacttatccccacccttggactattttgcagggaaggaaggaggagtaatctaggagggccagcgtggaaggggctgagcgagtgctccagacccgggggcagggccccagctttgctccttgctagctagctgctgtcgggcaagcccagtggcattagcaacccctgtgtccccgagagctcaggggctggtcacttgtgctgtgggcttggtgcttctggctggcctctcctggaagattcagggtggttctgggggcctctgctcaggcgaggtgagctggccacgtgcccttggccatgtctctgatcccagattccatatggtgcttgtcttcctgaacatggcagcccttcccccacagcctggccggccttgccttattttctgggcttctgctggtgtttggcatcttctgctgaatcctccctccacccccacccccaatccacatatctttaatgagaacttgaaattcagaacacaggaaaggaatttcaatctcagaataagcccagaaaccattggccttagaagacgctgggtgaggccagctgccaggtcaggggtgaggctgggctggaaggtgggggtttggtaatgggctgtcggggaggaggtgagcctgtccagccttagctccaggcctggggcccaggctgtggatgtgagcgtgggcctggggctataggtctggatcccagaacttggggctggggccaagtcccctttgcttgatgttcctgtctggtgtcagcagaccctgcatgaggggctcgggccttcagtgagctagctcccacgccatgcacctaatcgttcccacgtggccctgggctgagatcgacacactgactggaagggcaccaggcccagtgagtgccggagctgggtggagggcccacggtgacctcaggcgtccagctttccatctgcctgggccttttcagggcccagagtggcaactgggagatacataaaagctgtgtcctgtggccaggcatagtgaggggcacagcctgcctggcacacaactccaggacctgggtgcgggtgtgtgtgtatgtgtgtgtgtgtataggggaccctttcttccagtgaattctgagggaaccctgatatatcagtgtggccctggcagaagctggcaggaggtgctggctggcagtttcttcctgcctccccaaaagcaacgtctggaagtgggtgtgaagcaccctgctatttatgttctgccggggaaggtgacacacctgccctgggtgtcccagtggggggtgggcatctgtctgggtggcaggatatccctgcagcgtcaggggtgcctccttttcaggatgtcctgttttccccgagaagcccacgggctgctcagggtgatctcggggactcatggagcctcagggaatcattttcactaatagtctctgtcatccaagatcagttgctggattgcagattgcctgggggaaacggatagaaaatgacggttttaaagcatttcacagacaggccagggatgagtgtgtgcactgggcagcttaggcaacacccgggagaggatgttattaggaggggcaaggggtgagggagcggggagggtccttttctctcctccctggccatgctggccttggcagaagggtcctgctcagtgctgctggcctgggaacctggccaggaccggaggccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgtaagtccaataaacctctttcttttgtaagttgcccagtctcgggtatgtctttatcagcattgtgaaaacggactaatacaaatgcctctctcacagctctgtgggccagaagtctgaaatgaatctcactgagccaagatcaagggtggacagggctgtgctccctccagaggctccaggggagaatctgtttctggcccatccccgctcctgggggctgccagcctcccttggcttgtggctgcatcatgccaatctctgcccccgggtcatgtcgccccctcctcttctgacgtgtccctgtgcttccctcttgcaaggatgccttgattacatttaggactcacccgagtaatccaggacaggcttctcatctcaagagccttactgcaagcacatctgcaaagccctttcttcccatagaaggtacccgtctcaggttgcagggatcaggatccagcatctttgggggcaccatgcagccagctacaggatgtgaatggccctcacgtacaaggctggccatgcagtgcacagcacacccgggaggcgcccgtctgggtcacgcggaggagcagcactgtaggcttcacttaggcctccccagggcatatagcccagaggcacagcccaggcaggccctggtcctgctgcctccctcactggaccctccaccctgtcgtgtgggagctcttccctgcatgtctaagtgccagtctcagcctggcagtcctcccccaccgcccgcgttaagggacctggagcggctgactccaagaccacgtgcacagagaagccaaccctgtgctgacactgagggcctgtcttagcttcccagagactgaccttgggactctgtgaaggttgccacacagtgagaaagaccccgagtcacgtgttgagcatgtggtctctgtttcagacacacagtgccatttgcagaaagacaagagctgcaaactcagagcctgcagggcctggcaggcaatgccaacaaggacagcagtggaggaaaaaaagataattgcacccacccttggcctggctttcatttctctccttttgatggaaacgtggagaccaagaatacatctccactaaaaagaaacagcagtgggaatgcagccacacgtggtgtccagccctggccttgccatgggcacagggcgtctgggaggccctgcaaggagggacagaccctcctcaactcccttgacctcaatttggtagaagttgggtctggtgcagctgaacatcctatcaagaaaatccagacatcagactttttatgtgaactttcctgatgttaaaatgtggcttaaaatttctggaatgagaggatgaactgagaaggctccaggaatccagccacggcgctgagctcagtgagtcggcaacagctggcttggcagggcccaggccgacccgggtacgagagacagcccctatcaccatgcgaaaggaccaggcctcaggggtctggggagtcactcaggaagtgcctggttggagacacagagacaggtcctggcacaaggacgctggccaggtccagggctcagccagcaaatccagacaaagccctctttccacagaagcctccacatcagctctctgcctccagccctgggccctgcacacccagtgggagctgtcatgcctggggtcccctcccgtgctcactatatagaccaaacaaaacacggtcccccattggctacccatgctttctgtgatgcagaggtagaagcatcttctgccctcctctgtgggctgctctcctggggctcgccccggcctggccttgggacagaggaggggcaggtgcttcccatcctggggaactgctaccaggctgctgtgcacacaccctgctgggctgaaggaagagaagtcagacagcaacgtgccagtgaccttggctgcctccaccccagacaccgccggtgccaagcctctgcctgctgctgtcaggctgcagcatcctccctgacgggcagacgaggcacgccaccacgggagcctctcagcctcgctgcaccaaggaaggccctccaggagacagaggacaagcgccggcactgggcagctcctccatgtggctgagcgtggctgccacctgcagcccacagccagcccttccccaccaggccaggaagagcccctcctgacccacagtctccaccctgtgactttgccttgagttgggtaggagttttccaggccgcaggggatcctgggggaagagtgggcggcgggggtgggggcggacctcaggcatgacagttccccctgggtgtgcagagcccagggctggaggcagagagctgtggggcagcctccatggaagcagcagccttgaatgacccaaggtggggatggcgccctccagtctcacaaagagttgagtgtttcagcaagctcgtactggttgcagtgtgagggaggctggtgggggaggctggagcaatggcacaggagagagagaggagctctgttctgtcagaccacaggactggggagcaggcgagactcatccattcagtggcgagcagatagccagccccactgacacagcggatgtgaggcttggcccaggtgggggctggggggcccaggatggggcaggagggccgtgtgctttgttggggggtgccaatttgctgaatgccaggtcagagagcctttctgccctgtagctgtcgacgtccatctcagcttcctgtggctgctgtaccaggttacccacaccttaatggcttaaaacagcacacctgcattcctcacagttcgggagctcagaactctgaaataggattttaggggctaagatcaaggtgctggcagggctggttccttcgggaggccccagggcagaatccattcctggcccctcccagctcctgggggctgttggcgttccttggcttgtggcaacattgctgcagtctctgcctccctggtcacgtggcttctcctcttctatagccagctctccctcttagaaggacacttgtgataacatttagggcccgctgggaccatccaggttactttccccatctcaagacccctgatttaaacacatttgcaaagtctcttctgccatataaggtaatgctcacgagttttgggggattaggacatggacgtccgggggtcatgattcagctgacatgtctaagtgttgaaccttgggtcctaagggagaatggagagagggctttggctggatttgcagggtgagccctggacctggccagcgtcttgtgcccagacctgtctctgtgtctccaaccgggcacttcccaagtgactccccagacccctgaggccagggcctctggcgtggtgataggtgctctctctcataccctggtcagcctgggccctgccaagccactgttgccgactcactgagttcagcgcctcggcgctggatccctggagtcttctcagctcatcctctctttccaccctggagctgagcctgcagcccaggccccgggaaacccagggagaagcactgattgtgaaacccgaggcggctccgggaggcgtgcttcagggctgagcgcacccttggcagacgccgcggcgctcctgtcctcgtgcagaccgggcccttgggatggctgttggagatgccagcgcggtgatgtggcccacgcggaaggggtgggcgggggccggcgctgggaaagccgaggctgcacattctccgaggctggagttgcctggggtcagccggggagagcaggaggggccagctcccgggcctggctggctctctggctggagtctgctgctcagagcgctgccctgtgggtgcttcccaccccctgggctgtgaaggcagaagcgaggcttgcagccccagcgagggctgggccccccttattccacagtggagacgtgccagggtgtgctccccctccacggcgtctgggcctggcactccgcctgacagcccccacgtgcgcagcaactcccctgtgcctccgacataaatttagtccctgagtctcaggcttgcccttcccccgccacctctcccctcccgacatggtttctggttcaggggtggagccgaccaggtaaatgtggctggcaagggcctggatctttggtggagcaccgtgggcaggtgacaagcctgacccggaggatggtggccttggccctggcttggctgcagccccaactcgagtgcaggggacagttctggaagaccggccagtggttctgaggagctgcattagggctgctcccacagatgcttccagcactaggtgggtgagtggggtgggcagcgggcagtttggtgcagggttcagtgtgctcagccccacccggcatgctgctgttggtgcaggggtcagtgtgctcagccccgcccggcatgctgctgttggtgcaggggtcagcgctggtgcaggggtcagcgcgctcagctccgcccagcatgctgctgttggtgcaggggtcagtgtgctcagctccacccgacatgctgttgttctggctcactaaggggcccagagcagctcacccagcccctcaggatctcagaacctgggtgctgagatctccactgtacctgggtgcagtggcacaggggctgctggaattacgcagggcacagggcgcctgcccagtgctcactgcgacacttgctctccgtcccctttccctcctctgcctcgccatcttccacagacacagtgaattgatactttctttccttcccttggatctgtgttgggaatgtcctccaaagagcttttcgggttttgcacaaggtaacagtccctggcatgcagacagtacacggctcaggggtgaagctgtgatctgctcacgggggcatctggcgtttgatcagcaactgtgggctgggcatgccccctcttttcaggtccccagcatggcagaggcaggcttctgggagagaggcatgtgtccagggcatcttttcatgtctgtgacatctgtgccttggatgtaggagcctgctggctggggtgaagtttgggcaaggagcagtgggacctgcttgggacccaggtgaggcttccttcatgccctggctgccccatggatgacggtgaaagagacatgggcaccctgcataatggggacaaagggactgcatcccatagtgggtccctagacagaggcctcttggggatagagaggggtggggcgacaggtgagaggcgttgggtaccagcatcagggctgcagaggcagctgtagggacatctgaaggggacaggaagctcttccccagcagcagcgaggacaggcctggctcagaaactgcatttgggtccgaggtccaaactctgccagtttgtgccagccggaggcctctgaccacaggccccatctcctctcagaattctctgcaggttggcagacacttcagccagctccaagcctgaaatattttctataaaaatttccaattttctttgacccgtttctctttgaaattaatcctaggcagcgctgtgctctgggccctgaaggagctctgagcggggaaaggtcgcgcagtcagatgggcgtgctggcgtctgtcttctctctctcctgctctctggcttcatttttctctccttctgtctcaccttctttcgtgtgcctgtgcacacacacgtttgggacaagggctggattcttcggctgggatgtctctcagagctcttgacttggtccctttggctggggcttgccgtgaggtgtgggctgcgccacgagcacagctggtagagaacccggccaggagcgcagctcacgcctcccacgcctcccatcccaaactgtcggcacacccagagagagcctgcaggacaggacaggaggtgacctgggcactgggcctgtgtggagaggtggctggtgcgctggtctggttgggaaaaggccgggcacctgaatgccatgcgggttcattaatgctcaataataatgctgctccccaaatcatgggggaataatgctgctccccaaatcatgggggaataatgctgctccccaaatcatgggggaataatactgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatactgctccccaaatcatgggggaataatactgctccccaaatcatgggggaataatagcattagcagctctactgcttagggggagactgaggctcagagagggcaccttgcctgctgccacaagtgtattttcctgcattcactcgtcacgttcttgctatgtgtccaccatgtgtctgacaggactgggtgctggggctgtagcagcggaggaacccgatcgagtccctgttctctgggctcacagccccgcaggggagacctggtgagcagatgctcgcagacagtggagaatcctgtgaacaaagtaaaacggggtgaaagggcagcgtgagaaggcaggtaagggagggaggcgccccaggttggtgatgatgggaaagcccagccctgggaagggtgttccaggcagagggaacagcacatgcaggagccctgaggctggagttaccgcagcgtgaccaaggggcagaaggaagagctagtacctggaactgaggacgtaatgggggagtgggaggcgtgcagggccgggagggatgggtggcactcatcgctttgaagggacggtcacggtacggggtgagaattcattccctgtgcggtggaggcctttggagggttttcggtggacggtgtggaagcagggaggagtcccggtgacagatggcggtggaggcagtgggttcaggatgagtttgaggtggagcttccgggacgtggtgtgaaggaaggaatcaaggacacatcctgcccctgagaggtcacgtggctgggaggctggctggtggcctgaggctggccgggcaggtgtgctggtgggggtggccgggcaggtgtgctggtgggggtggcaggttaggtggtctgggccacgtgcaggagtcagaattggcacccatcactctgactccacagctgcccgcttccactgctctgcactgccctggcccagagggaggtgttttcccaggaaagaaggtgccaaggccaagacccatgtgttcccagactcacggggcgggggcaggagcccccaatgcagccccacaggcagccaggccctgggatgcactgccacctcctcttgctccgggaggcagaggctgtgctctgtggggcgggctgtcagggacagtgtgaggtttggggtcccatggacgtgtgtgcatccttgtttgtctagcaggaccggtccagcttccccttgcctgccactgtggggagggaccccagactggccgggatgaatggatgcaggaactgtggcctgcacgtacttaggagtgtgcagggcagggtgtgtggctgcctctaggcctttgcaggcagagccttcctgtccaccccaaggggccgcaggcagcgctaccagctgttccccacacaaaagctgcccgagacagctggaatgctccctgctcctggtgcaaactctcttgaaactcaggggtggggacatcctgggagctgacctcaggttctgttcctgcaaataggtatctgttgctgacccggcagatggcggcctgagccagcccagacgcgctcgagccctggccctgagcagccatcagggggcacctactgagtgactaaatgaattaggaaatcccagcgcttaacagactcaccactcggggcagagccagactggctcccacagcagctcctggtttctccaaatcctcaccagcacgggggctttagtgtttaatattttgctgctccggcagcaaagcggcgttgctttttgcgctaatttgcgcttctttggttactggcgaggatgagtgatcttccctgggtttgattactctgcatgtctcctattcctaagtcctttgcctgtttatctcctggggtcttatatattgggataagccctttatctctttttagatattgactttctgtcatgttcgatacaagcttttccccaggccatagttcctctttcctttccagttttgttagcgttagttgcacaaaagtctgtttttctgtagctgagtctgaatgatccttctcctgccccgttggagccaagtttgcgttcaaggacatgcccattcaccgagggcctgcgcgaaggtgggcactcttcatggtgtcatttaataggcacggtagtcctggaagcagagagaaaactaaggtgcagggctaccactgtccaagcagtagcgggaacagcagggagcaagaagaacgtgacgcgttcctggagcacttaccgttgaccgcgtctgccagcacgctgcaggtacatcatctcctaggattcttgtaatgagccccacggtgggttggtgcttttgctgtgcccacgttacagatgaggaaactgaggtgccgacggtcgcacagatagtaagctgtagaaacagtgggagccaggccttttgactcctgcatcaggagggaggagcaggcttagaacccagggctgctgacacccagtgcagtgccctcctgtccccgctcagagcctgggctggcaaaacccggtagcctgtgaccccatctgtttgttggacagagggccttccaagcaccaaggcctggaactccacttaacggctgcagaaactggggcccagcgagggtgagtgaggatgtgtctccaggtcacttagcacgttagcttcggggagaatcttttgcttacagtggaatttgcagcattttgaggaatgcctggcacacggttggtgcgtaaatatccgtgaaaagaaagaataagcatagtgcctaggaagcccggtcgcccaggagctcactccgggagcaacagttgctccctgcaggcattggagggcttggcactgacgcctcctgttgttgccacagtgtcagggctgcagactcaggttggcagctgtgggtggctactggtcccatgggcccatgggacattgggtggccctgggcctttgctagtcccacttcctcacacttgagcaggactgacttcgccggcttgtgacccatccggcagggccctatgcccactttaacactctgtcattcctgccttagaagtcgtaatcactttttgaacaagggactgtgcgtttccattttgcactgtgccctgcaaatcaagtggccagtgctgttcatcactctttcttctgtgactctgcttcctccctgtggtctcatggagctgtggtccaggccccgaggttgaggacacagggcactgcacagtggccaaaattgggggtgcccagtagacacgggctcccttccttccaggcccaagcaccagcactttctgacagttaactgtctgtcctttatttgggaatgtctgatgccagactgcagatggcgaggaagatggccctgtccatgctggaacgacagacccggtatcaggaatgtgcccctgtgactgccacaggcccgtttggtgcctgagggcagcaatgcgtgaatcccagcctctgccctggggatgccgtcgggctggagcactgctcccagcgtgccttggccactgttccctgcgcggttgtctctggacataaagcacctgtggaatcccagggctgctccccttcctctctcccttgattcatccaacagatctctacccggcacgcacagcaggaccgggcactgggccaggctctgggaccagacaggcacagccctgacctcatacagcccacagtgcactagtcagtccacaaatacctgcacaatgaaagacttgggaagtgccacagagtgagcccgcagtcactggacgttgggctgaggcctggagtgtgggttgcagttccccaggaggaaaaggggccagggcagcagatgcgaagtacctgaggggtgaggacggggcttgtttgggggtgtggcaggaggggcagggtgagggcctgaggggactggaggtcagatcacgatggcttctgtgggctccgtcgtggaggaggggctgtgccatgcagcaggtggcatggtctggtttccgaggagggtgagcacggaagaggcagggagccggcaggaggctgctgtcctgtgtgcagggagagactgcggcctggatcaggtggccatgggaatgagagcagcggccggatcagcccctcagcgccatcgtgcaggaagggtgttgggagtcctggtaggcagtccacaggttggtcagagggggatactccttgcctggcagaaccgtattcccattccaaatcaccgtgaggctgggaggacccagatcacagccccacccggctgcctgtgacagctccacccctgtctggacctcagacctgtcgaggtggcgctcgctagaatcatttcctctgtgggatccgggcctgggaaggtccctgtgtctggcccttttctcaaggacctttcccagatcattctggacacatatttgagtccagctgcagattcctagctgcgagcaatgctgcccaggcttgagccttttttggacgactgcagggactccgtggggtgtgccatgggggctgccttcagcctcctcatgctctgcctttgacaattcacgtggcaggagctggggccgaggctggggtggccaggcttggagggatggagtcaggagaacaaagggctgagatggctctgcaagtctggccaggcgacgtccagcagggcgaaaaggactaggtgctgcccaaaccacagcaggagcacctggtgggctgcggggaggagctcaggggtcaagttgacgaggagttcagtacacattgtctgggttggcggggggcggtctgggggtgtcaggctgggaataagaagcatgatggcctgctcaggtctgcccacccaaatcagagcccacagccatgggcagtcccagccccagcgtgtgcagagggctctggagggcagagctggataacactggccccaggaaggccagagcccccaggatgagagcatctgtcctctcaaccttgcctggagcctgggggtcaggcgttcgctgaggacagtggtctcgtatgggcacactgatgggggcctggcaggtgacgccagcagagatcactgggcccaggtagacacggggtcggccagcagcaggagggcctccaattttataagagaagctggaaattgattttacttacaatctcttcattttaaactgttggcagctaattcaaaatttgtgaaagccgtgtaagggttgagcagcccggggcagtggccgggatgggggtcaggaggcggcctcagtgctggggaccttcactggagcccacggcgctcaggaccgagcttcttggatgtggccagggctgcctcggagttgaaatgtacttcagaggaatttttattttcctttcgggaatgtcaagagaggcctttccagcggttccgtttctgtgaggcgaaacctgcggtcgtcctgttgttcttggaggcagcgatgaagcccatctgtagcgcatcagcgggagccagcagcggggagggtgcagggccccagcccaggcagacagagctgttggatgcggcactgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctgggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatccacatcttcatccatgtaggaaatgctggagtgaaccgagccgcacccaggagcttccctgagctgggcaccaggagcccagggtctgtcctgtctctggatgagtcctgctgccttggcctcagctgaggcctcaggcccaaagctccatggcaggcctgacactattttccttataataagcccccgtcctctttcctgttgggcacccgtgtccccaggggcgggtcacaagatgacaacttgggacctggcggcttactgttctgtgggctgagctggctgctgggccctgtgcgaaaggcacctgtgctcccacctgaaggagcctggggcctctgctctgagggcagaacaagaccctcccggtctccctgtgggaagaaggaccgtgtcagagacgctgtccacggtggaccaaggccaagctgcgggagaggctggggacagagaaggagactggtgggtacctgcccatgctcatgtgttgggggtgtaggcagaccccagggcctaccagagcagccagtggggagcagccagttcctaggcccagcagcatctgtgcaaaggggtccagtagggtcacagtgcccgaattgtgtcacacactccagggctgcccagccctgcctgctgctgcagagcccctgatccccgaggatgaagacaccaggaaggagcaagaagtggcccctgtgccatcagtgtctgtgccgtgccacccctgcttgggggcacattggttttccacatggtgtcctttgaatggaggtgaggcgggccccagccaggccataatcttgggagacggctctacctcagggctttgctgaccccattctgagtcaggccccagccaggtcttgggagatgggacagaaagtgaggggaccccaagattgaattgtaggaaggatctgaactcactggtggaggcagagagggaagatggggatgaggctgatggaaatgcagtctgctcacaggcacaaaggccacatcggcagccctagccctgagcccaccccacagttcctgacccccaatcctcaccctctagagatgacctgtggtcaagcatgaccgattctgccccaaaaatgtgtataaatggcaacagtgacaaatgacgctgctatggtcttgcctctgactttgttacccggttcacttgccatggatgtgaaggattcactttccagtatcagagtctttctgtctacccattcatccatctatccaatcattcatccatttatccatctgtcatccgtccatccattcatctatccaatcatttatccattcattcatccatcgtgtattcattcgtctacccactcattcatccatccatctatccatccatcattgatctccattcatctacttactcatccatctacccatcccccatctacccatccatccatccaattatttatccattcattcatccatcatccatccatccatccatcattcatcatccattcatctacacactcattcatccacccaatccatccatccattcatccagtcagtgtctgcaagcaccccaggccagcgccctgctgggcactgagtatgaacaatctggtctctgtccctgaagagtctggctgggggaaaaggcagactcccagatgaaccatgacaaatgctgctaataggctgcttggcagcccttcctcattgtgccctgttgtgtttctttcagccaaaatatatttctgtgcatctttgacgccatcaacagttgataggagagtcaggcagagggggctatgggcttcagggacagtgagagggagtgtgtgtgtgacctggtagcttagagaatattcttgtgggcttaatctgcacgcccccccgacttcacccatctgggcctcttctgacctcctacaagcatttgagttgcttcctctgaccttttaaaaatcaatggactataatacatatgagtatgaaagtgtgtaatccagtggtttttggcagtgttgtgcagccatcatcaccatctagttccaaaatgttttcatcaccccagtgggaaccctgcacccagagcagtcactccccattccccttcccagctcatagtgaccactaatctactccctgtgtctttggatttgcctattctgtatacttcatagaaacccaattgataatatgtggcctttggggtctggctggagtccttctaaggattgatctaaaagctccagggccccttgtcatgggagcatcatatgcccagcgacatgaatataaaataataatactgcataattccagaataggcagcagcgtgtgtgtatgaagctcgggactgtgagacaggagggagaagtggggactgtggttaaaacagtccagagtgcctcttcctaagggaggcccctcctagttcctgcagtgagatccgtgttgacactgaagtggccttgtgccctgctgccccgccctgggatggcatatattagagggggctccgatcacctctgaactgggaaatgtggagtagtgcaggacacagcagcaggaaccacagctcccagccccaccccagagagaaaggcccatgagcagctggtgcagggactggactggagccgatgatcagatttggagttggtgtggacatggcgtgtcacctctcaggagagggggcaggaagtgaggagcctgaggccaaagggtgagaagggtctgaactcactgctggaggggcatgtgtgtccccagggttgcagcctggctggggcagccagcacagtggtgacaggacaaattagagaaaaagggatgcctttttttttttttgagatggagtctcactttgttacccaggctggagtgcagtggctcgatctcggctcactgcagcctctgcctctcgggttccagtgattctcctgcctcagcctccctagcagctgggattacaggcatgtgccaccacaccccccgaatttttttgtattttttgtagagatggggtgtcaccctgttggtcaggctggtctcgaactcctggcctcaagggatccgcccaccttggcctcccaaagtgctgggattataggcctgagccactgcgcccggccgggatgtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaagtatggaaacagacctatcaggccgccaaaggcaagccgacattgctgtatcaatctcagactcaacagacctcaagacaggagacgctgctggggaaagacaggtcaccgtttaatgagaaaaggttcatttccccaagatgataaagcagttctaaaggtagagtcacttaataaaataacctcaacatatttgacgtgaactttgttagaaatagagaaattgacaaatttatcatcatttttgagagaatccaaccatttttttccaattggtgttggatcaagtagacaaaaaacccagcacagataaggaagttctaaataacacaaataataagcttgacattgatgaattttgcatctgacaagtagaggttatttctttttctcaagcacataggaaacacttgtaacaactggtcaattaagtgcaaatctcacagaaactaaaagaatagtgtcagcaggtcttgttccctgaccatcatgcctgtgagagagaaattaatagcccccaaagcaaaaatccccattatttggaaattaaaaaaaaatacttttaaataattcatgggtcaaagaagaaataatagtggaacttcaaaaatacaactcaatgataataaaagcactaaatatcaaaacgtggatggaaatttacattagaaaagaaaaaggtctaaaaattaaagagataaatttccagtgtgagtagttagaaaaaggcaacattgatccaaagaaaatagaaggaaaaagataatacaaaataagatcagaaatcagtgagacaaggccaggtgcagcaaagtgcctataatcccagcattttgggagtctgaggcggatggatcacctgagctcaggggttcgagaccagcccgggcaaaatggtgaaaccccatctctaccaaaaaaatctaaaaattagctacacgtggtggcatgcacctgtggaaccagctacttgggaggctgaggcaggagaattgcttgagcctgggaggtagaggttgcagtgagctgagagtgcaccactgcactccagcctgggtgacaaagtcagaccctatctcaaaaaaaaaaaaaaaagaaaagaaaaagaaaaaaaaatcagtgagacagaaaacctctgagttctgatcattgttgctgttaggaagattcggggtcagtgttgccagatcctcagtttttcaagataagtcaaaaataggtaattctgcagacaatctctgcattaaaaaaaaagtgtcagtaatctgaatttggcctgtgcacgtctttcctcccagagctgcttctgcacacagcacctcctctctgggccatcttctctgtggccagcttctcctcgatggccatttgtggacaagtctttgtgtgtacatatatgttcattactcttaggtatatgcctaggagaattgctggctcacatgataacacagtgtttcactttttgaggaaacaccaagactgttttccaaaatgtcctgcacgtagtgtccctcctggagggccggggctaggtcaccatacacagaacacgcagagacaccccagaaggccaattcttgtgtctagttagcagggacctgtctctgtggggtggggggctgctggtttctgactctcatctgcagacccctcaggcactggcctcgttgtttaattcataaattggggaggtgatggagggggtctgaggcctgcttttttggtggcagagtaatttctacattgggtccttgctgaagtaggtcaccatcaggcagaaatacgattcctgagactttttggagataacaagttcaaaccctgcctggctgggtttctagcagctctgcttccagtaccgtgtggatgtcattttcacttacgctgtctcacaagggcatgggtggaaagaactctgtttctaggtaagggatggaaggctcagagatggcacaattagaaagtggaggatctgggatttgaacccaggcccgcctgatgcagaattgggctctttctgctacactagcttcaggtgccggctgagccctgggagggaggagtgagcaaatgcatgaggctttgcctttgccgaggcaggacaagctgaagaggtctttctccttccctagagtgagcaggatctctggacttctctcctgtctagtgtttcagctggggctccactggcggaagcaatgtgcgggcaggatgcgtgatgcctgtgggtggacagtgccactgtcagaagacaagccgaggctgctatgggagggcgttagagggtgacattggcctcccatcagccaggtttcgaaagttaggagcagatgtacagggtttgtcacccaactacttgctccccttcttggttaccgcatgaccaacccagtggcctcccagggccttgcgctacacaacactggacagccagaaagcaggtaatgctgcgtcacccacagagggttgcctggggcctgggctgggctggaaatggctctgagaacagaggtaaggagtagatcattgtttaatctttcctttatggtgggtttattgagctgtaattcacatatgctgtagttcagcgtttcgggcgcataattccataatttttactatattcactcagctgtgcaaccatcaccacagtcaactttagatcattttcattgctcccaaaagaaaccctgtacccacgagccatcattccccattttccctcaagaagtgttacttcttcctttgcaatgtggatgccttttatttatttatttttttcttgctgaattgctctgactagaatgtccggtactatgttgaatacaggtggtgagagcaggcttccagtcttacagttgaccatgatgagtacttttggcttttcgtaaataccctttatcatgctgaggaatttcccttctagtccttgtttcttgagtattttttgatcacaaagggtgttgggttctgtctaatgctttctctgcatcaaccaagatgactgtgtggtttattttcctccattttatgaatgtagtgtattatatggattgatttttgtgtgttgaaccactcttgcattccacggataaatcccacttggtgattgtatataagccttttaatatgctgctgaatttggtttgctagaatatcattgaggatttttgcacctatatttataagagacattagtctgtagttttcttatgatgtttttgtctggtttcggtatcagggtaatgctggcctcatagaaagatggatattaattctttaagtgataggtagaattcccagtaaagccatctggtcctaggtttttctttattgggagtttttgatgactgattcaagctctttacttgttatagatctgtacaaattttccatttctccttgagtcaattttggtagtttctgtgttgctaggaatttgtccatttcttctaggttatttaatttgttcgtatacaattgtacataatattctcttataatcatttttatttctataaggtcggtagtaatgtccccacttttgtttgtgattttagtaattggagccttctctctttttatcttggtcagtttggctaaatgtttgtcagttttgttgatctttcaaagaaccagcttttggtttcattgagtcttcttattgtttttcaattctctattttgtctaccttcactataatcttgattatttccttttttctgctagctttgagtttctgttgcttttcttctggttccttcatgtgtaaagttaggttattgatttgagatctttattatttttaatgtaggaatttgaagctataaatattcttctgggcactgcttttgtatgtcctttaagttttgggtatgttgtgtttttattttcatttgtctcaagatttattatttattatatattctaatttatcttgtaacatattacctgacctaatggttctttaagagaatattgttaaatttctacatatttgtgaatttttaaagggtttcttctgtcattgatttctagttttattccactgtggttggagaagatgctttgtatggtttcagtctctttaaggttattgagacttgttttgtgacctaacatatgacctatcctggagaatgatcatcatacatgagaagaatacacattctgccgctgttgagtggggtgctctatgtatgtctgtcaggtctagttgatttacagtgttgttcatgtcctctattttcttactgatcatgtgccggttgttttatccatttttgaaagtggaatattgaagtcttcagctattattgtaaaatggtctatttccatcttcaattctgtcagtttttgcttcatagattttgggattctgttgttaggtgtgtttatgtttataattgttatatcttcttggtggattgactctttcatcaatatataatgctgttctttgttgtaaaatttttggacttgaagtctatcttgtctgatattagtatggccatcccaggtctcttctggtttctatttgcatagcatttctttatccatcttttcattttcaaactatttgtgtattttgaatctaaatttggtcccctgtggataagcatatagttggattatatcttgggattttttaatccattctcccattctctgaattttaattgcagcatttagtccatctgtatttaaataattactgataaggagggactgaattctgctatctgctatttgttttgtatatgtcatattctttattcctcaattcctcaaatatttccttcttttgtgtttaacacattgttttttagtgtactgttttgattcatgttttcatttattttgctgtatatttaaaagctatggtcttattggttatcctgggaattacagctattatcttaaacacataacaattttgtttgaattgatatcaacttagtgtcaatagtatacaaaatgctttgctcctatacagctctgtcttccccaccctttattataatattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtctaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccatcctttcttgttattttgcatgctttgtattttttgttggaaactggacattttgaatgtggagactctggaaatcagatgccccccacttcccggggcttgttgttttttatgtgttgttgcttgtttgtttagtgatttttctaaactatttttgtaaagtctgcattgttcattatatatggccaccaaagtctctgttttgttagcttagtggtcagctagtgatttgacagagactttcttaaaagccagggtaggaagaaatactctcctcgtctttgtagattggttctgtgtttgagcacacctttgatgcttagccagactgtttacaactctgtcttagccttcacttcctacttgtacagaccctaaatgtcagccagaggtgaaaacttttgagtcttcttagaccttttctgagcatgcatctcaccctagacatgtcagtggtagaatcctagattctctggtatgcacaagagctttccaaaaaccttatttcctcaaatatctccttccctaccctcttcctccccaagcctttagatatgtttattgtgcgtcttgccccaactattgtcctgtgccccaggtgtctgcagctaatacatttacctttaaatacttttgacaaacactgtctgggaaaccacttcagtcctggggaagctccgagacagttgaaacaaaggcaagccagcagatgggttaaaacccacaaccacaattctctggatataaggtccatatttctttcttttgagttttcaaactgggagtcattgagctccttggatgtgtaggttggtatcagcaacctacaccaggaatgtggtctgccatcttcatggccactgctgagttggagaataagataatggtaagcaagtaaattaaaacaccataacccactgtcaccaaaattcagtagctgctttcttcattaagcattccctggttgttgtaggtttctggttaaattctggagttccaaaaaagtcgattctgagatttactagcttatttcctgtttttgtggaggggcagaattttggagtcctctattctgtcactttggtgatgtcctctcccttgtcgtatgcatcttatcagaatctttagatttatattaacttaattcctgtgagctatagaaacattactcttatatagctctattcttccacccccatctttggttttttttgtttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcccacccccatctttgtactgttcttgctgtgcaacttgtgttggtttttgattgctgcggtaacaaattaccacaaatttagtggcttaaataatgcaatggtattattttgcagttttggaagtcagagtctgaaatgagtctcactgagtttaaatcagggttttggcagggttttgttccttctgggtcctcctccggggaggatctgtttccttgccctttccagtttctggaggccacctgcattccttggctcatgacttctgtccttcgtcttttatgccagcaacatcaggccaagtccttcccgtgcagccatccctccagtttctctcttctgcttcccccttccccctctatggacccttgtgattacactgggcccatctggctaatccaggataatttcaatattttaaagtcatctgatttacaatgttaattttcctttacatataaccttacagatagataggttctggggattagaatgtgaacatctttggagggccacagttctgcctaccacacagctatatatgctacaaacctaacaattgttgtaattattgctttatataatttcatgcttaaagaagctgaaaaaagagaggagagtacatatatatcaacagtttgccttcctgttgaccatttctggctctcttcatttgttgcggtggattcaagttcccatctggtgtcatttttttactccagtagctgtgtttctgttcacctgctttgtgctgttagtcaaatatattacatttatatattatatgggcccaataatacaattatatacatcttcttctatattattgctttttaagccagttaagggaagaaaagagaagaaatacccatttatattgtcttttaaagttgcgtgattacctttactggtactgtatgtgtgtgggtgtgaattcaagttaccaactgaggtcacttgctttcagcttgaagaacttcctttagtatgtctgataaaatgggtctactcataattctctgtttttacttatctgggactgtctatattgcaccttaattttgaaaaatagttctgctggagaaagattcttggttgacagcttttttacattggatatgccattctgctgccttctggcttccattattaggagaagtcggctggaaatcccactgggattcccacatatgtggcaagtcatttttcttttgctgctttcagaattttctctttgtctttggctttcggcatttttactatgatgtctctgggtgtggatctcttggcatttatcccgtttgaagtttgctgagtttctcggacacgtaggttaatgttttcaccaaatttagggagctttttgccactgtttcttccatcttttctgctcctttatactcacttgcctctttctgggactcccattgtgcatatgttcatgccctttatggtttccacatttttcttaagttccgtttacttttcttcattcttttttccctgtgtccttcaaattgcataatgtctattgatctgttttcaagattctttcttctgccagttccaatctactgttaagcctctcagttatggtgcttttcaactccagaatttccatttggttcttgtttataatttctctttattgatagtctttatttgatgagatattgtcatcatcactcctttacataagcatggtttccttttttcaaagacatatttccaatggctgctttgaaatctttgctgcaaaatctgacagctgttacatctgacatctgggctttcttaccagcagtgtctgttgccgcctttttttctgtgaatgagtcatttgtgtttctgttgtgtgaaactggacattttgggtcatgtggcagctctgcatactgattcccctcccccatctctgaggctgtttgcagttgtttgtgtatttatttgtttcctgatttggttagactgttttcacaaagtctgtattcttcacagtgggaagcctcagctgttggagggcacagccttgagcgtgtgcagggtcatcccgggatgacagtgatttcagcagggctccctatgactgtccctttctctgatctgtctgttacactctctgcttcatttggtatcacacccagctactaggcttcactaattgagggatgattgctctattattttcaacaatgtcctgagacataaattgtcacatagtttgatccaattaaatttgggtagggatgattttgaggccagtctttgaaattcattctccccctggaagagatcctcataacgatctgttctcctgattttttttttttttttccagtaaataagctggtctgtggttcaggttgttgttctcatagagctgtcagcctcctcttaaattcttgccgccagaatcttcactgaagccaccactccaggtattgggcaggaggtagcctctgatcttcttggtttgcctccccctagcatggaatatttttctagcaagcaggctggacttagggtgattaggagcccagcactctcgccctgctgcacctgagacggagctcctgccctgagttagggctgggtggaggaaggtgctccggcctttcggtcacactcagcagggagttaccctctgtcactgggagttggagatgatgagaaacgctggtggcccatctatcctggtgaaatactgtattccttgactgggatctgagggaagagggagccctgtgttcttggccacacacccccagagtggaactccccataagctgaactggaaggactagaagcggggaagagagagcaagtgatggctcaggtgccaccgattcttgctgttcttactgggatttttcttcccaagatttggttgattttcttgaatagatgatgttgcttagtttgttgtgtgctcttaggataatttctagagactttaaattgttgttgatggtgacttttcaatacttttcaccagttatggttgttctgaggggaatgtgtccatggggctcctctcaccaccattccagaagtggaattctcatggcagatgattcctaatctttttttaaagggccacagcaataaggaaggtagaagacactggatatgtcagggtcattcaaggtataattagagatccaaatccaattaagccaagaaaaggaaatttgctggcacacgcgagcaagacagcaggcaccgctggcccacacgaggctgccaaggctcagcgtctctcctcctcctaggacttggctctcttctgcagagacttccttctcagattggctcttcacatacgcagccccaggcctacgctgtgagcttactgagccaggaagggaatatttttttctcccaatgttcagatctcatggaagacccatgattagtctcactccagtcatgtgttcaccccctggaccaatcactgtgctgagggcattgagtaccaggtgtgggctatgtgcccccccaccacagccactggggagtagcatgggcatgaattacccatccaccagagacacattgggtggggcaaggcccttcccgctggcggaaaggggctactggtgtgaaaaatcaacaagatggtcccccacttgccccttttaaaaaatgcgtagagataggtacacacactattttgcctatagtttattttaatgcactgtaaatctcttcgacatactcagaacttaaaaagaaacttcatgtgcattatctcttttgactacacttttcctgcaaaaatggtcacttcctgaaaaagtgaaataaattcaaattgcacaagtaaaagaaagaggaaacttgaattctgcccaaaggaaacttcttcaagaaggctgtgctcttttgattttaatacactgaaattacagaatggcctttgacatggcaattttcatgtcgttttgaacgtcaaattgattttgactctgtttggaaggcagtgaggcccaaagccctgactcatgaaagagcagaataacaacccgaactcgcctcgttttgctggacgtggaagcccggctgggttgatctgctgtctcctcgttttccaccagcgtgaggtcatctctggcagtgtgtgcctcacagaggctggctggggcagcaggtactggccactggtgcagggtcccattgcctgcgatgagggacacagctaacgttcccgaggagcttccaggcaccttgcactctgtccctggcaacacagtgacaaggctttgttcctccacccgaaacaaggcagtggcatggcctccggttctcgaaggttcactcctatcttccgctcacacttcagtttctttgtagtcttgaatcattgttctccagcatattctacagagggccttggtctacctcacccatgcagctaaacccatctattagggaaaccaacactcaagctcactcctgccattaaactctcctgagatttgagtttcctcctctttcacaaaaccggaaatcccttgtaagttaagccaagctcattaacgttgtcttctgcggcatccatagagttctgccaggagagttgaaccctgttcctcttccctttaccggacaaaacctctgggagaggtgggctcaagctctgaatctggtgacgtttatggtttccgcagcagtgtgtctattggcatcgcgtatcagggtcgagggtggcaaggcatggggtctgcagagtttctgccctcccccaaacagcaagatccacacgcactgacacgcgtcacgggaactcatttgacacaggatcaagtttgcaaaatttcccatgaggtcgaccatgaccacagctgtcaaggtttccaaaaaggactccccactggatttggccttggtcataccttaaaccttcttttgccagcggcccctatacctgcataatccgttgcagtgttgcattctgatgaccttctattttcccggttcccttttgctccgacctgtgctccagcaaacctgcaggccattgatgctgccgccttgtcacggtctctcacaccactgatccttccctccaccccttacccagcctccttctcttaaactgcaggttccctcattggagtcactcttgctttgtaacatctactgaacaatgccctagtcctggtaaaatgaaactttctacctacttcatgctggcacgggtacccctgaacaaagctcagccctgcttctgctcttgcttacgatgatgttcaccagcaaggtgccgctagcagccagactgctcccctcagtctgtttgcctccttccagatgacttttcatatcttccgtcctctgaacacctccaacatctgctccctatccgcattcacacctgacggcttccctcgtctgtcacctactctcccagctttttgctctctcagcagcaccccctaggtggagacgccatcttcgattcctctcctctcactgtgtcttaaccccacttggaccaggcctctgtgtgtgccactctgccagaggcaccctccccgaggtcatcatgctgctgcatctccctgccaatcctcagtcgccatccctagcacgtggcaggctagtccctcctgctcccttggtgtggcttaccggacacccactttcttggtctaatcacagcactcacagttcatccccgtttcctttgctgatccttcctcttcccgcaccctctggggttgatgcgcccagggctctgtcctggacgctccttggtctccctctgcacccctctgtgggcgatctcattcctcttgttgctttatgtaccatgaaatggctcccagatttgcgtctccagcccagatctctctcctgcacccaagactcatattccaactgcccctccaccttccatgctctctgtattgcccacgctcctgactccagcagaatctgcacctcatctgtctctgcactcttcaaatccaagttccaaggcatttctctacttgccaacctcaatttggaagtaccacctcagcacgcccctcactgaactcgcgctcaccctctccgcactccaccctcggccttccccagctctgtgcacggctgatccttccttccatttgcacagccaaagctctgcagttagggttgacccctctcttcctctcacactgatgagaaacctgttgagaaatctttttaggttttctttcaaaatccaccccgaccctgatcacttctcaccatctccacggttgtcacttgcgtcaagcctttgtcctcttctgatgactttgggagcccccagcagacctccctgcctccccacccccatgtgtcctcaacacagcagcagggattcttttctctaacagctttattgagatataattcacatactatacaggtcacccatttaaagtgtacgattcaatggtttttattatattcacaacatcttctccctccccaaagaccccacaccccttagctgtcgtccttcctcccccaccaccttccaggcaaccattcatccacttcctgcctctctagatctgcctactggggcatttcctgtaagaggaatcctgcactatggtggaagggtcctggggcggtccgtggtcagggatcctttgatgccttctgctggatcatgtctgtcttctgctggaaatcccacagtggctcctgcttcgttcagctcagaagtcagcacccagcacccgggccacctaccagaccccacacgacccagcgcctcgccctgggaccccgtggcctccattttccttctcactcacttgattcctgccatcctgggcctccttgcccttcttttcaaaaccccacatggggtcctccttccgcctggatgccctttctagacaccctcagctcaccctcccacctcattcgagtctttgcttgcatgttcccttccagtgggacctaccctggcgctctaaggctttgtagacagctccccccgcaccacctgccctggcactcgcagaccctgtgccctccagccccttcccgcagcactcactgccctccggcatactcagagcactggcaccctctgttccttctgctagcgtggccgctccacagagcagggagctgcggtgactcccacggtctcccaggagcagtccctgaggggagctggcccctacacagtagctgggggtgaatccgtggacacccagcaggtgaaaaccgggactcagctccctggagagacgtctgcggttccacctgctgcatgttccagagaactagagcagctccaagttccgctgtggcttccttcaagctcaggaggaatatctgtgagcccagagtggatggaactgcttgtttcttccaagccacagaacagcttggctgtttccagagtgcacagcctccccaaagtctctccaagaacatggcttcggtgtgtgtttattgtaggatgttcaaggcctccgtggggcggggcagggggaccccaagttctggttaagtaactgtcctttaacaccgccgttctcaggagccacagctacactgcggcgtgcgtgtcgggagcgatggctgcctgggactcttcagcttgtgggtttgctcttcctttctcaagcaccttgcagtacaagaagcactgggtttttgtgtcctggtgaatccagggatcaaggaaaaccagaggacacagatgctccaagatgcctccttcctttcaccattttccagacaaagcagacagggacacagagaggcccagagcccctcatcaggccccgtctcctttaattccgtcctcattaaaccctgctagactttccaacatgctgaccttgagaatcacacatcgcctcatctcccccagcctcccagagctgggcagcaccgcttaactgacgcgactggatccaggtgacgaagcctttcttgagagtagctgaagtgacactgtcttagtcagtagaggctgctaccacaaaaagcacccccaacaccaggtggcttacatagtgtttatttctttctcatggttctggaggctgggaagtccaagatcaaagtgctggcagattttgtgtctgctgagggcctaccttctggttcacacatggcaccttcttgcactttgtcttcatgcattgcaaggggcaagagagctctctggggcctcttttatgttatttctacatttttaatttaaaaaaatgtttagagacagagtctcactcatcacctaggctggagtgcagtggcacgatcctagctcactgtgtccttgaactcctgggatcaagcgatcctcctgcctcagcctctcacgtagctggggctagagatgtgagccaccacatgcaacatatttttttttatttttagtttttgtagtgatgagggcttgctgtgttaaccaagctggtcttgtacttctgtgctcaagctatcctcccgtctcaaccccccaaagtgctgagattactggtgtaagccactgcacctggccatggggcttctttgataagggcactaatcccattcatgaggccccaccctcatgacctaattaccccccaaaggccccacctcctaaaatcatccctctggggattaggtttcaacatatgaattttgggggtacaaatattcagtccatagcatacatcgaagggggaaattcttttttctgaaaccaggtcttgctttgtcacccaggctgaagtgcagcagcatggactcggcttactgcagcctcaacctctcagggtcagtcagtcctcccacctcagcctcccgagtagctgggactgcaggtgcaccccattacgtttggctaattttttttatgtgtatggagacagggttttaccatattgcccaggctgctcttgaattcttgacctcaagtgatcctaccgcctcagacttccaaagggctgggattacaggcatgagccgcagcaaagaaagtctttttaaacgattctttatcagaggcctctgacagctcattcttgttccccaccttaagcacctctggctttcattgatattgcttgcttgggtcttagggcctcagtcagggcctggaggttgggatttcctggtgaatttgatggttagtctcctggttcacccttacgggagtggctggaacaattggcgtccctcttccccaagcacctgaagacaagtcctgccctttgtgtgctcagagaggagggagggaaagtgatttctgggcccaaagtccaagacttggagggagggaagaccccaaacacagcacagagggacgatgcccatcattgctcccaaggcagctcttccccctgcctgggagcggagctgacctcatggcagagggctaggcagagtgtggttaatatctcacaaggcacaggacatctggaagctgagatgtgccaagaggctttgaggctgagcatatttcagggctgggatgggagggagattctcatctgtttagtggcagctagaccaggagggcacctgggaccaggaccaggctaggtggacatgagtggtcacaggaggctgaggctgcagggtgtctgggaaggcacttggccagatgcagagggcaacccatgccctgagggtgggggcactgttggagcaatcccagtgcagggagacccccaggatctagcaggagctctgtgcagggctcacatggttcatgggggcccagcaacagagaggaccctattggcaaccatcagcactggattctgcctttggtctgagcagaggtggtccaccccgcttcccctctccttcctctctgcccttcctctccagggcaaggcctggcctaccagcactttcgttggccctgctcagatgcttgggactaggtgggaacaaggccctctcctatgagagttcctggcagcaccaacccctaggacctgagacaaaggggccaggtgagtttctttaagggcccctcgctcattcgatttggggtccctctgatttccatgcagcctgggacttggtaggacttggacacacataggctggcacctggctccattggtgtgaaggcgtcagttctgtcccacacaccctgagcatttcatgctattctgaggcatgaggatgagctcgtattcttgctccttgtctattccttcatcccattgtgccaaaccttcatgagcctcctctcagccaaggcaggtgacccagagatgaatctgatgcatgattttacccctggagctcatggtctggttaggggacttggaaactggtgagcttatacttctgcatgatcagtggtttaaaagaaggaagcacagggtgcttgagtctaggagagagagtaacttgctctctttgcgggcctaacgagctgggagctgggttttgaagactgaataggagtctgccagaaagggcagggcaggcattctgggcagagtgagcagtgttttctcggacccatggctgtaagggcgttgcgggaacatgagcaggtccctgggagggttggcaggcaggtcaggcccatcaggaggccctagccagtgtgctcgcactcccgcacgggtctgctaggcttgggaagagggaggtacagaggattttaatgggggcaagctcaggtgaggactcgagctacagggagtgaagggcagggagcagcagcggatggggccaggtctgggaggaggctgctgcatccaggtagagggaggggctgagctcatcatggacggggagatggggaaggtgccaggatgcggtgactccttggatgtggagatgagatgggcacagcagcaatggctgatgggttggggtagggaaaggtgacaggtttgtttgggacttgttggcatgaaggtgccttgtgacaccccaggggcagttgcaggcagcagggggcggggtctggagcctggggaggtgcaggctggaggtgggtcggggggcacctgtcagcaggtccatggtcatggaggtcaaagcagcaggtgtggagcaggcagagaggagagcgagggtgaagccctgcacacggaagcccagtcctagtggatgagcagcgtccagggcacggtggactgggccccacttcctgtgggggtgcagcctccacttctctctgagatgcatggtgaggccttctccatgcagagctggagaagtcacctgaggactgcccacctgggtgaattcaggcagagcagcaggaatcccccacagagcaggggttaagcctcgagggctggtgatatctctggcatctgatggggagggcgcctgtggcaggagagggtctcttctggcagagagcttgcatgaagtccagctgccctgagccaggaagagttactgggaggacattaggaaacctgcagagtccacggggagtcgggctgtggaagggcctggcagtcggggtcctggacacaggagggtcttaaccattgtgaccaggtgtttagtgacaccactaccttttcctcttctggctcctgcggctcaaatcccacactctgtgagggagaggatgtttggcttggggagggctgtgtgcatgcagggttccaggaattccaggaaataacactgggctgctgctctgagaaaggggagaatggatgctgggccacccccagaccttggtgcctggtccttggggacctggagatggctgctcagcggcttgagggcttcagtgtagtcagtgtagtgtgtgtttctgtttttttgtttttgtttgttttgtttgtttgttcattttgttttgttttgaaacggagtctcactctatcactcaggctggagtgcaatggtacaatctcctctcaccgcaacctctccctccgggttcaagcgattctcctgcctccagcctcccgagtagctgggattacaggtgcctgccaacacgcctggctaatttttgtattttttagaggagacagggttttgccatgttggccaggctggtcttgaactcctgacctcgtgatccaccctcccccaccctcagcctttcaaagtgctgggattacaggcgtgagccaccatgcccgggctgtttttgtttttaatgtgacacattttaacaagcatagcatttaacaaagcagataatatgatacaacacatacacacaagatacactgtcacagtcatgggagatggcactgatgatgttcagtcagtatttaggcaggattggaaagaaaaatgtctctgctgtgttttgcacacttgtacacagacacagaagttttttattccaaaatgtggagttatctgcaactctgcaaattatacttgatatttacttttcttgatatatttgctgaaaaacgattctcccagtaaacagtggtgatttctcagaacagtagttatttgtcagcagcctttaactacggcaaacctttttcacttgagtttgaagggtgaacgccttcccgcctcccgacacagatgctcatggtcgtgcataatttcatgtgcttccattctccagacttgttggaaatgccatattttatgcttgtaattagtcagatgagccaaaggatttgaaatttaaacatttgaaccctaagagaatcttgaaactttaaccaaagaaacagaagaagaatgtatacaaacatgggaattgcagttcaacagccctttattaaaaaaaaaaaggtattgtgctggcagtggaatcaaagacaaaaatatgatcatcacagtctacaaggcactttaccgatctactcatcctcatcctgatacagacacgcgtgggaatcgtctgagtggcaggacctgcagccattgtcacccgactttacagatgaagcagctaagaaatgactcaataaacttatagtgatttgcttgacatgtcagagttaaaatgtaacagccccagaaggagtggcctagcacagcgttcaagagcacagactcttggtagccatgccagggttcatatcctggttctgacacttccgagcagtgtgaaattgggatagcctttctcagtttccccatctgcagaatgaagataagcatcacagctaactcacacagctgctgcgaagaatcagtgggcaactatagacgaggtgcttggaacagtgcctgagccaccttaagagcagtatggatgtttctgtctgtcagggatcccgtgtggcttccatggcgccgcacttgggcatagtcggagatttgataaaacattggtgcaatgtaacagccgcacacaggtgcactggcttagcaaactggagtttggattaatttaatcaaaaccaagtgtcgagagggcaccaaagtccaggataaacgtggaatatcttcctggagcatcgattttactttaaaaagatgcactctatttcataatgtaaaattgacactttttaaaagacagaatgcggaggcaactgtggagttctcatttttggcaaaagctgatacgggttctgccttcactctctgggatattggctaatttcctctttttttttctttttcttttttctttttttttttcctagagacagggtctcgctctgtggccccagctggagtgcagtggcacaatcatggctcactgcagcctctaactctggtactcaagtgatcctaccccctcggcctcctaaagtgctgagactgcaggggtgagccactgcctctgctgacttcactattcactgcaccgagaagactctcatgtgtatttataacaatttggataaaaattttggacattgatccatgtcagctgcgagacagggaacgacttgttatatgcaccaatttgtcctttaattacttgttaagctttgatttgtcctattatcagaattctcatcctcttctctgcaagtttatgctcgccatggtaggcgactgtagaggtcaccggccccttacagttcagcaagtgtggatttgtgcagacaccgggacgccatcagcacatcgaggcggtagacactcgtcttctcccacggtttccttctgtcccttcatttctgttgctgttgttgtttgcttttgtggaaagaacacttaacgtgagctcagacctctcagagaatttcgaagtgcacagtgccacatggtcagctacaggcacaacgttgtacagcagacctctagtacttactcgtccagcatcactaaaactttacacccattgaacagcaactccccatttcccgctcccccagctctggcagcctctatggtgtcatctgctttcatgcgtttgattacagatcctcatgtgagtggacgagtgccgtatttgtccttctgggcctggcttatttcagaatgcgtgtgcatgcggggagggggtctgcgtaccattacactgtcactgatgtggatgtgcaatacaggcctgggtccctctcatcttttggtagcccccccggctttttttttttgagactgagtttcgctctgtcgcccaggctggagtgcagtggcacgatctcggctcactgcaacctccgcctcccgggttcaagccattctcctgcctcagcctcctgagtagctgcaattacaggcgcccaccaccatgcccggctaatttttgtatttttagtagaaatggggtttcaccatgttggccagcctggtctcgaactcctgacctcaggcaatccgcctgcctcggcctcccaaagtgctgggattagaagcatgagccactgcgcaggccttgataaccctattgttttacaaaatgaaagagtgcctgacagtacatgaatggtggtatgttttaggtacatgcgtgaaatggaggaagtctgtatagacgcagacacaccgcagtgcagtggtgccagccaaatccacgctcccagaagtgagacccaaggtgacagtaactggacccaagtatccccaagtctcaccgtctctgtgtgcctgtgtgcacagccctcccgggcataacgtcaagcgtatgtatttgatgtgtgtttgaggctgggtcttgccctggcatcagcagaagcaggccctggagcgcataagtgaccaccagacctgcacaccctctgcacagctgagcatctcggcatcaatgccctgtgagtgcccagggccaggtaggcactcaggaagcctgcaggccctgggatgtccagaccgcactttctggtaatcccacattgcccatcctctgcctctgcgcatcccctccccccttgcccccgagggcaccctgcctgcccacctcacgcccagccctgcccagcctgccctgccctcctcccgccgggaccacctctgctaaatcacttaatccggtgatatgtttcctctggcaggccaagcccatccctcctgactctcagggatttgattatagtgttttctaacaaagtcaaaaacagatttccatgagaggcttatagctcagtaattctatggtgctttggtgcagtgtgccaaggcgcagggatgtacggggtcaggatgtcgagagaaaaggtcacaaaattaaattagaaccaaggagggtaagccttggcaagagaggcctgtccggccagctgacaggggcatgcgccctggagaaccccgagaaaggggagttgtgaaaatgagccatttcacgcctaattacgatttcccataaggtacttaggagggatgatgtgcgctggacttggacaattaacgtaattaaacattcatgctgcctgcggcccatttcctgcctggggatatctttggaagctgaagcatttcttttttcttggaggtgatttcaagaatggctgcagaggaagggcttcctgcggggctgggccttgggggatgtacctctgcaccccagtggggcaggacccctacaaagagtgtttcttggtggcagctgggggcctgggggccggggaaggctggatgccactgacctggaattacctctccgtcgggaatgggcagcggggtctcatgtttgtggagtgggcagcggggtctcgtgtttgtggaattacctctccgtcgggagtgggcagcggggtctcgtgtttgtggaattacctctccgtcgggagtgggcagcggggtctcgtgtttgtggagtgggcagcagggtctcgtgtttgtggaattacctctccgtcgggagtgggcagcggggtctcgtgtttgtgactctgcctgtgttttgatcacggccaagtcacttaagcccagattctctggcgtcccctcctttcctccgattctctgacagaagcctgtaaggacttccttggcttctctgggcctcaggttttctatgtgtcttacttgtggacactgatcaggacactgagggtctgacggagagagggtggcctgaccgaggtgcacagctggaggtgcctgaccgaggtgcacagctggaggtagctttgctgggaccagaacccagggcacttgctcacgtgctggctgtcacctctcaagcacaggccgggggaggagctcaggatccagccagactgactgagctgttctcaggtgaccgcacaccacagacttcagtgcagactggcagagcttcggctccctcctctgggaaggagcaccgggcttcctagctccagagttgtggatgctggatgaggaggccgtggtgaaggcaccgccccgggtctggagccccacaggagccttccccagatgctccgcaggcagtggatgtccgctggctttggttagtgttctgcctgccttaagggcaggcacagtcggcccagccgcgcatggtgggttctggggctgggggcacctccaggtctcagggcacctgccttgctgccgagagactgcatcaggcaggaggcaaggcagtggccggcataagagctgggccttgctgcggagtctccttccgcttcacacccacactggttttgggctatggcaggtggagcagggaggagccagggccccggaggtcttcaggctggggcaagtccacccccaattctgccctgctggctggagaggagaagaaaacaggctggtgcccagactgggttctggtggagtgagctgagtcaggaacagccctgtccgtgcacctggcccgttcctgtcacctctgtgggcctcaggttttctatgtgtcttacttgtgggctgtggccagcatcgttatgcctacttttcagatcaggacactgatctgtgtgcgccactgcggtgctctgcagctgattcatcctggaggccgcccacacctggggcctccggcccaccctctctctgtgctccagaccactcctgcctgagtgtctcatgggtgtctgtccttgtgtccccacagaaatctcagcccaacacgccccacacggccttctcctcctcccacgcggctcctcccgagggtcccttgcagggaaggcttcccagggtgaccggttgcccaggtcagaaacccggaatcctccctggccccactttctgcacccaagctgtgactccccctctcagtctttgtccacacgctgcctcccctgccttccaccctccttcctggctccctctccagccccaagccagggctgccctgccccctctagtctctctgcacttctgccctcctcccggcctcggccatctctcctctcctggccctccctccttggcacagcaggggcttccctcactcccaggccctctgcactgctggtcctgtgggccgtggtcaggaacacccttccccctctgcctgcctctcagccctccccatgagcgtcaggttccctctctgtgtctgggccctgcagtcctagagggcatctggggttgaggggatgctggtcctgctcactctgtggtcccagcccagcaggctcatcatcactcaaagggccccagctgggggccctgcagcccaccagatactgccgtgccagcacccagagccaggccaagcagatcggtgccagaccagttccaccccagatcacagctgggccttgactgtcagggtggcccccttcagctgccaagtgtagagtcgtcagggagcaggccaggctgggggctccctctgcccctgacccctgggggagctgctgggagagtcctggcctctcctgcatgtgcgtggcttgctttttggctggactaaggattgcagccatatgaaatgctcattgctgtcctcatccccctcccattggctgtcctggaagtcagctcctttctgcagggcagccactgcacacctttcttctgtgtcctttcaggatgtcctgtgcacacacaagtatatatatatacacatatgtgtacacacacatatataaatcctaggattagaatctctggctcaagggattttgtgtcctgtagatactgtgttttcgtttttctgactttttcctgcacactgtagactacaccgtgtgctaccctgcatttgcgattatcagggaacatgtcttggacgtcgtccacagcagcccctccagacctgcccattcctcctgctcaggcattccatcctgtgaatcacttgcttaaccagaccttgactgatggggacgttacttcttttcaccgtttcttataatgcagccgtggatatccttacacttatttccttggctacttgtatgaggacatttgtaggattaaatttgataactagaattgtggattcaaaaggtttgtgcattttcaactttgataaggatgaccacaaccctaggatggttggctggatccgtttctctcagcatgtacccctgatccgtacatttttatttggacaatctgatgcaggttgtttctttaattaagggtgaggtcgagcgtcttctcatacactgaaaagctgctcggtggctcatacccgtaataccaacactgtgggaggccagggtggatggatcacctgaggtcaggagtttgaaaccagcctggctaacatggtgaaatcctgtctctactaaacatacaaaaaaaaaaaaaattaaccaggtatgatagcaggcacctgtaatcccagctgcttggaaggctgaggcaggaaaactgcttgaatccgggaggcggtggttgcagtgagctgagatcacgccactgtactccagcctgggtgacagagactctgtctcaaaaaaaaaaaagaaagaaggaaagaagaaagagaagaaagaaagaaaggaaggaaggaaggaaagaaggaagggaaagaaagaaagagataaagaagaaaagaaaagctgctgtcttttcttttctgacaattgtcccctcatattgaaatgagagaagttctcttgtcctcctcgcagggcgtgctatgggggtgtggcttccttcttcagtgtccctctgctcaaacctctgggggagaatacagacgggcaggctgtggggctccgaccccacagcagtgtctaggggtgaatgtttgcagcccctgaagccccagtgggcgtgtgctgcatgtgctcttttactttagctgtctgtaggcggcttgtgttaaccagctcagttagaccctctaccttgtcgcaaggacagagggctttctgtatctcgggttcttccttgatgtcctggaagaatcagatcacacgtgggcttggagaatgagtgcgaggttttattgagtggaagtagctctcagcagatgggggaagccagaaggaggatggggtgcaaagggctttccctggagtcgggccgctaagcagcctgggctctcctctgactgccccggccaaactccgtgtcgttctgcttctgccggtcggtggcctgcagcgtgctggtgctcgttggtgcgttcctctcgacgtccagccgcctgtgtgttcctcccctcatgcgctcctctcgacgtccagccgcctgtgtctgcctgttagggtctcgggtttttataggcacaggatggggacatggtggaccagggtggtcttgggaaatgtgacatttgggcacaaaggcaagagtgcctgtcctcacataggtccgtgagggtggagcccttagccagggaccatgcacttccctgcttccatatcatttaaagggagcatgcccttctctacccagcacttttgtatcaataccgtttgtccatttcccttttggattgctggattgtttcttgttgatttgtaagagcgctttatgtattaaggaaattagtcctttgtctgaagcgcacatgatgtgggtgagcccttggctgtgtggggctgaattgagagtccatgagagggaggaggagcctggtgcgtgctgagtgttagttgccgtgtggataaccagggagtgttcctcaggcccctgcgtgaggattccaccataaaacacatccatcaggagctgtccttcaaggtgggaaagggatgtggagaaacaagtggggcgtgaactgcggcccgggaagcttcagccactgtgaggcagaggcaggtggactcactctggttggccagaacctactgtgctcaaaacctctccaggccagacggaggaggatacagggaaacggttgctcagggcgtggagccgaggtggcagacagacctgaggacacagctttggtctgggcgtggagctgaggtggcagacagacctggggacccagctttggttcatttcacaagcagcacagcacctacattattcttaaattgctttttgccagtatttagagatcagagacttcacatgcaaatccagatttctcacttccttacaaaaataagacccagcaacatggacctgcaccctcctagtcaccactggccaccttgggctggaggcagtgtgccctctcatccccctgcccacatggcttttctcatgggagcaaaatatttctcagtgaagagggaataagcaaaagacaagccaagagggccgcatgctccaaggaaaattgggagagtatatttctttctggaaatgcggaccgtttctctctgttcaacatgtgaacaaaatatgtctaggtcagagagatggggcatcgggaaacacgcccagcctagcagggacccacaggtcgagggtcagggaggcccgagtgagaattgctgtggtgtgaggcctgcggccggcagcgtgttgtcaggatggcgcctacggatgtcaggatgtgccgggagccatggcgacagctcccaagaaaaagaggagaagacggtggtagcgtgcacccaccgcatggctgcagtaagcgcacagcatccacctgccccgctgacctcacgccgccctcatgctctccctgtaaatgacggccaggaaggaaaccgatgtagactccacggccaactgctcccaccaaggagatacagacaatccgcccgcatccacgctgcgcctcgtcctaccctgtcctgtctccacctgctcagaagtagcataaggataactaagttttccatttatccaataggcgtttttggcccgtttatttattcattttgccaagccccatgtgggtacctggggacttagagaggggtcaagggccacctcagtcttccaggagttcactgtagagcctgtgtgtgcatgtgcacgtttgtgtgtgtgcatgtgtgtgcctgagtgtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtgtgtgtgtgcattcatgtgagtgtgcatgtgagtatgcgagtgcattcacacgtgagtgcatgcgtgtgcgagtgcattcgcgtgtgtgagtgcattcgtgtgagtgtgagtgcattcgtgtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcgtgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagctggttgggagcacaggccagagggccacccacccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccctggttggggaggaaaggccctgtgaggctgccttggggattaaattttcaggactcagcactcactctgatttctgatttcctcccttctcgaaatagggctgatcaaattaagccttgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggtttccctgccccctcaggaggcgcaggggcatgggagcgtcctggaggatgggacatcagggcatgggagcatcaagaggccccaggcctcaccacccttccacccccagcatgggggagggctggggtggtccccggggttgtcctcggtcactcctgctccttgagcaggtcctggtcagacatggactgtgcttggtgccacgactgaaagtggggggtctttgtgcccaagggtcatggtgggtgatggcagcaaggtcctcagctgggccagggccctggtactttcagctccctcttggctgctggaccaggtgcaatcaccaccatgggccattggaagctcgggatgcgggggacagagccagatgctggggtcacgcaggggtgcctgttgcctgggcccagggcttgttccctcatttgcgtaagagaggtcccgtgcccactccaccggctaccatgaagaagaaacaggaggtgtgtgaagtccctggtgcctgggcatctgaggaactcttcctcctaggaaggcagcttggtggcacagtgtggcccaccgtgcagggctgccccaggtcccacaatcagctaggaagagcctgtgcttggctgcagcaccccagcactgctgtgtgcctggactcctgacctagaggggtcaggaaggaggagggagcagaggcaggtgctgagtccctgcacgtggctcatggccgggtaggagagggcctcatttgcacagggtcgggcagcatctgagacctcccgcttgtgttggctgcaagctcttcccaggggaccaggacctcacccctgcagggcccacgcccaccctgcatgaacgcagggctcaacatcaaaggacgtgaaggccacaacaagggaaactgaggttggcaggtaaagaaatgccttggaacttggatttgaagagtgcagagatgggggaggcgcagatgctgctggagtcaggagcgtgggcagtacagagggcatagagcgtggaggggtaggttccagagaccctgaggagtgaggagggagctgcctttgagggagggggagaggcaggttctgctcctggcatggacctggctgcatgcgggccccactccctaggtggacgatgcagctggcagtgcagccggaggtgcacgtgcgggcagaggaggcagcaggccctggaccttctgagtgtgaggtacctgaggccttccggggagcaatgccaggcttccagatgatgtccaaatcaggggctctggagcatgtaccagactggtgacagggattttccgcctgtcatctgctgagccactggccaagcctccggccacatgggtcccgtggcactggctgtcagcaccccacttgccggcccccacctcctctgcgttcagaacacaacccctgggaattctcccttcctttgggacccgtggggatcttcgttttgttctgaagttcacagtgaatattttcaataaaagacctgccggcctctccatcggcccccaccacttggctgccgcgtgctgcggtgcccccgtgacattacccaggccagctccccttccctgggccaactgcccagcagagggaaggcttggagccctgggggctgtggtgagtcctggggaccctccctggcttaagcagatgctaggcaggggcagggcttgctggctcttgtcacccgccccagcctctgaaggccccgagacccccgtgaatccttggaggtgagtgggctgcagaggccgctggagagtggcacggggcaggtgcagaggagcctcggtagttcggcgggtgctggggggacgaaggggaagttgtgtttgggaacctctgtgggggctgtagacaggaggccccagccctggggtgaagagggggaagttgtgtttgggaacctctgtgagggctgtagacaggaagccccagccctgctgcaggacacctcagaggggctcgcacagctgctggtcactcagcatggccctgctggcttgggctcaacctcagcagcctcacacctctgctgggcaccatttcccaaggacacgtatctgggagccggaccagagcctggccccttttctggtcatagaccttaaatactgcagaccttctcctcgccccacactgggaggtgcaggcacagggcagaagagagtggcctggtctgatgcctcaatcgttcaagagagctgtggctgcaaagccaaaccatggtgtctctctcaggccagcacatttggctgtgtctgtgtttgtaagggcacacaggactctcgtggttgcaagagacagagagctaaatgaattgacctgaagaattaggatgtccaggggtgcatcaccttcagccatagctggatttggggacctgaacagtgtcagcagcacacggggctgccctcatctctcgcctctgctgctcctgggggaaggaggtacttagcagtcccagagtcacattttcccagcagagaggaaagcacgggagtcttcctgtgcacaccaacacacagcatcaggttccagtggcctaacaggaccccttgggcactcctggagctggggtgcagtgggattggctccccatgagccatatggggtgcaaataggggagggtggtttactagcagaaaaggtgtaatggccagacagggcaggccaccgtgctgtgcaaccccaggtggctctgtgagggtgtgcaggtgctgggcaggccaggaccttctgtgtccaccactgaggggtgtcctttgtcctctgctgtgcgggggtatgttctgaggactggcccggagaggccttctctcctttagtgcttcctttttctccctgaagcacggctgaggctgagcaggcctgggctggagcgtccatctgtccgcggggcagcccatcccgtgggagtttagagaactgtcaggactgcccctgagattcggcacagcggttcctgatgcgctcctgatggccaggccggccccaggagcccctccccaccctccgatccacctcaggtcataaaaatggcattggatgagctgtgtctgttgaagttgcaaaaattaattcaaagtcagtaataaagttataaagggctgggatgtaataatcctaatgagcatcttttaataaagtacaccagtggggctctgtgctgatggcccccgtggggctgagcctgccttctgcttcccagagcctccaaagagcctgcctgcttccaagcagggctttctgctgtgtcctgattacacttccacataaacatatttcatcttaatgattatctttaggggaatacacagccacagagcgactctctcttggttagtaagaaatggaggggatgaccttgttcccgttgacctcccctgggtggggctcctcatgttggaggagaggctgctggtgctccaggctttggtcctcctgagcctggtggtggcccctgcaggccctggcagtgcttgtgtgcaggaactgggctggcattctggcctggccatttgccaacatcatggccttagtctaattccctgagcctccctctcctcttctgggcagtgtggcagttctggctctgcagggcggtcattaggacttacgttttggggactcctaagcactggaaaaaggatgacttgttcccatccacatggttggcaggttgaggcagtagcacagcacctctgtctgtgtgcaggtgcctcagtgagtgtgccgtctgccctcaggccatcccctacctagtgagtgtgccgtctgccctcaggccatcccctacctagtgagtgtgcctgtctgccctcaggccatcccctagtgagtgtgcccatcccccccttgcgccatcccctagtgagtgtgcccatcccccctcacaccatcccctagcaagtgtgccatctgcccttgcattcagccagcagagtccagcagagtgggaaactgctcacaggggatggggcagctaaggagagggctgggaaagagccctaggcttggaacccaaagcccgcccaacagcaagatgataaaaaggtgcctcgctacattttcttctagcacttccatgacttccttttgatcatctcatccacttggaatctgtttttgcttaaggcatgaggtcaaaatttgaccttttcctccctctaaccagttgtcctaacatcattaaaacaaagaaagaaacaaaagccatttatctccccagcctgctctcttccttctgattttctcctgcagtgagcaaccatttcaggtgatcaaaccgtatcctttccttagtgtacatttttgcaacatgagtgttgctgtcttgcgtctgtgtatccataatttatgtaagtcgctctgaattgtgtctcattctgtttcttaccttttgcacttggcactctgtttttaagatccatccatctatgtagatatcaaacttctaaccttggtagcactttgtgggatgcccccaccacatttgcttctcctctcacccactgatgacccccgtgttgtttccagctcccctcactccacccaagcaatgctgcaaggggcagctccccattgcctccttacagacctgtgcaagtttgcccatctgcaagccagtccatggggccgaacaatggcccatgggccaagggtcagtccaaggagggcactgggctatccgatagacatcctgtatctttaggatatgagccgcatggtgctcttcctcatgatcccctcagtagtgccagactgccaggttgtcccctcctgctccacctccgccgtttcctagcaccgtttgctacctgtatcatttactaattttattcactgtattgctacttgagcaactatttataattacatgcaaatgaatatcaaagacgattaatattaaagcggagagctggcacacgctggcagtgtaaggagagggcggcactgcccccgctggatggaggctcccggaggtgagcagatcagtctccaggtcgtggtctgacttctgcttctccgggaactgacaaggcccctcctggggaagtcgtgagcaaggtctcgaggaagtctgggctcagcacagtcaggcacctggtagggcccaggtggggaccacgcgctggacctgcagcggaaatacggtcagagggagggggctgacctgtacgtcctgcttctaagctcgccacggcctgcctccagctctcggtggggggaaagctggaaacttctgtgaatgttgtgcgtcctcagcagaggaggggagcgcccctcatcggcacatggccaagccaagtactgccaagaacctaggccaggctctcctgggcattttgtccccgggctacagatggcctgatggaggtggggtcttggtgaagacagttcaccccgtgggtcacgctgctcagtatggctcagtcgctctccacatctggtgcagagccatcacctcagggtcacttctcgccaccctccatgggcctcccaggccatgtcttctgtgttgggctcccgttttctctatctgtgttgggcttccgttttctatatctgtgtcttactctttctttgttgccttttttgtttttgatggtgcacacctttcagtagcttcttgagaggagtgcttgtcacataaatcttttgagaactgacatgtctagaaatgtccttattccactttcatacttgatggggaatgtgtctggatgcagaattccagttggacaatcattttccttcagaattctgaaggctttcctccactgttttcctgcatcgaatgctgcttttgagaactctgagtcattctgattccaattctttgtctatgacctctcctgtaacctgattttcccccttcttattctccgggagactttgtagaatgtggctgtcttcatggccagcctgggattcagctttcttgatgtaccaagtctgttaccacttgcccatctgtttccagcctcccacagttcccttgttgtttcttcccctcctgctctgcctatccttggaggcttgtgactttaaattttttttaaatttctttactgaacttttaatgggattctagaaaggagccaaatcagatatctgtgttcaatccgccattttaacctggaaaccccacatattcttggatctgtttttggaagtttttttgttttgttttgtgtttttgagacggagtttcactcttgttgctcaggctggagtgcaatggcgtgatctcagcttaccacagcctccgcctccccggttcaagcgattctcctgcctcagcctcccgagtagctgggattacaggcatgcaccaccatgcccagctaattttgtatttttagtagagatagggtttctccatattggtcaggctggtctcaaactcccaacctcaggtgatccacccgcctcggcctcccaaagtactggaattacaggcgtgagccactgcacccagcctgtttttggaagttttattcagctccattgatctgtttctttcatgacattgacacaactacgttttcattaatattattttataatacactgcattaatttgaaaaaaatatgcctcctcattgtcattctttttcattatttttctgtctggtgtggtcttccggatgaatgttggaatcactttgttgggttttaacaattatttgatggagattatttggcggagaataattttaacaattattttaacaattattcgacggagattatttgacagagaataattttaacaattattcgacggagattatttgacggagaataattttaacaattattttaacaattatttgatggagattatgccaaatttcttgattcatttggaggaggaccaacttccagtccaggattatgtccatgtagcttcatttactgaggtcttcttttgtgtttttggagaccttagactatattatactactttttgtgtagtcgttgaacattcattagtttttgtttgttcttagatacttgggagttttgctgttatagctgataagctcttttttccactctgctttcttgcgggttattcctatgttcaagaagtcttgatctttgcattattttatgtgagatgaggagtatctgttccttgtggatttggttaaactcttctatggaagcatttctttgactgctctttcaatttcttctgaggttattggtttcttcaggttttctacttgagccatgagtggaatgtatattttctatttagtctaggcctattagaatggtgcttttaatttcagatgtttagggtttagggttttattgttatctctgattttgtctcagtaatggtgattgtgggcacggcttttgagttgtgtcctaatgtgtctcagtaatggtgactgtgggcacgatttttgagttgtgtcctaatgtgtctcagtaatggtgactgtgagcacgatttttgagttgtgtcctaatgtgtctcagtaatggtgactgtgggcacggcttttgagttgtgtcctaatgtgtctcagtaatggtgactgtgggcacggcttttgagtttttgagttgtgtcctaatgtggtaaaatgtggaacttctcccgtgtgtgcttgacaaggtcacgtgttctggctgttgggtttgaacgttaggttttcctattaattcaaatagtttctatccctacctaatgctgtatcagacttgtctggaataaatgtattacagtgctcctatcactgtggccttgtctctccttccttgcaccaggttgaagctttaggagcataaagtttcgtatcttttgtatttttttccatgagttgtttgttttatcagtttatctccttaaatgccttggttggcaattacatggtacgtttctttgccccacttgttttaactcctcctggtcatttggacttggttatgccatatgcaagtaatttgtagctggattttgttccatctcatgcttctccaactgccaccacacttttgctcctgttctcggctccccacccccagtgtggcccctccggccctgctgcacctgcctctccttctatcccagttcccaactccccagaggcccccagctcgcctctgctgggccctctgttcccagagcacctctctgccatggctccaggcccctcacagccctgcggttacctgtggggcactggggacactgaggcacaccagaccccatggtctccatcccccagggttctctatctgagagggaaagtcagttaatgcccaggcaaattcacaaatgagacaagacctgcctgcagtggagtgtcacaggaaggaagagcacggggtgctgtcgggagaaatcaggggagggctgatttcaatttgggatgaaataaggaaagttctcccttaggagctgacatttcagcagacacctgaaggaagagagcaatgagggggcggccatcccatggagaggggacagcagtcggccgtgtcactgaacagtgtggtcctcaggttttaagcatccctgccccggcccctgtccctgtcgtcccctagtggcacgcagtgtggctgtgcaggaggcagatgggggcagaacatgctcctgtctttcaagagctctgagtcccatgggaggcagcgggctcccttccttctgggtctttcagggggcctaaatttggccagcacagcggcagcagcaaaaagggcatcgcaggtgaagaggccagcccagaaaaggcataggactgagcttcgcacaggggacagcgaacacccagccacccttagcactgcaaagcccctgcctgacctcagagcccacacctgcccactgcacttgccctcagcccacacctgcccactgcacccgccctcaggcccacacctgcccactgcacccgccctcagggcccacacctgcccactgcacccgccctcagggcccacacctgcccactgcacccgccctcagggcccacacctgcccactgcacccgccctcagggcccacacctgcccactgaacccaccctcagggcccacgcctgcccactgcacctgccctcaggacccacgcctgctcactgcacctgccttcggagcccacacctgcccacaaagcccgtgcctgcccactgcacccgccctcagggcccacacgtgcccactgaacccaccctcagggcccacgcctgcccactgcacctgccttcagagcccacacctgcccacagagcctgtgcctgcccactgcacctgcccacagagcccacacctgcccactgtacccaccctcagagcccgcaccatcccacgatgctcccgaggttgcagactcagtcccaggttttctcttctctagtctaatcatacttgtttctacaattctcattctcgcaaatcacccctcagtgctggtgaagtacagaagggctccgggcatgtggacaacgttggactcagaggcctgggcgcgtgcccactcctcctctctggtggtgtggcttgtccaagtcatgtaattttcctgctccttggtttgtttccctgatgctgaaataggacgatatgctgatggtgacacgcctccaccttggcgaggggattggatggctgctgggggtatggagctgccactgtgaagggctgtgcacacacccctgcctggagactcggggtgtgcctaggatgctggcagttgcagcccttgcccacgtgccctgtgcactgtggcactgtggatgagcccgtggctactgtgacccacccgttcccctgatggaattccctggacagaactgctgcctcccctcattccatcctctccctgtttattgattgactcttcgatagagtctttttgttccattctagagactctaaaacaggatggctctggagtgcttcccacagtgtcattatttggccacgatgtgagcaaagagatctccagctgccatccaaaaggggccctgagcacagggaatgccaggaactcgaaagctctgtgttacctatttaaaagatgggatcctgccacagacacctcccttcagggtagctgcagcccacctgggtatgacttctggggcttggtcaatcagcacccccagggggcccagtgccttcttgtggggaaggctgcacacagaggaaaggaaggccaagggcagtgtcatcctcctgcctctgcaggagatgggtgcgctgatcactcatccaggcggggtgagtgccgagggatacagcagaggctgtgtgagctcccagtcaccacagctcagcagggctgggctacacagggagctcccaggggaggaggggagagcagcaaatagccctcttctgccttggagggaccaagtggaacaggggctgttagaccaggtaggcaaccagtgcaggtgggcaggcccaaggccaaggttgacttcaaagggatcactaggaagacgactcaggaccacgccaggcccactggccagagctccctatagcaaggctctatttggggaacaggtctgcaagggccagcatgtggtcagagtctcttcatggcctgggttaagcccaatgtgggaaaaactgaggtggcactcgtgattgacagggtcagggtcaatcttattgtggggaaaactgaggtggcactcgtgattgacaagctggggcttcagcctgactgccgggtcttgttgggacagaggaggacaggaggggggctgggccagagctcctgttgccccaggtctgagggcattgcagatccccctgctcttagggcttctccccttgtcctgtccagcctgagcaccactgaggcttccaggggccagacgcagggcgtggctgtcacctgccaggtggcccaggcccctgtcttcctctcctcacccactttgcctttgggccttgggccgtctctctaggcactggtcctgggtggagggatgctctagaacataatttccaaatttcaccccaaaattatcacgattaaaataatgatggcaacaataataattccatttcaggtgaaattcagattctaaatctttagaaacctttgctgtttttaatgggcttgcaacacacagtttagttaaaaactctgcctgctcggcagaagcagcctcaagacgtgccccagcccagctctgtcccgatgcggcacccatgccctcctacggggaatgtctggaggggtccctgcatggggactctggggttagggccaggaggacatactgtgataccttctggtgccagaatgacattgacagtggcaggcaggtggcctggtgagccaagccctgtgtgttttgtctccaggtgtggcccctcaattcacagacccgggctacccctggggtggccccatctcttaattcctcaagagaagctggatgttctagatttttaaaacatgaaatctcccagttttcaaatactatcaaccagatggcaccacgtgacctcaacgagtgcctctgtggtctggttttgccgagggcaccgcccgtgtgtgacccctagtttgacaagggcagagggtaacgcccggcctgttccccagggaggaagagttttcctatggaaattgccatcactctccttcccaaggtgattctgaaggtgagctgtctctgttcgttggaaatgcaaagaaataaatgtacaaaaatagagtggcgattcctcaacccccctgtcaggcttgagttgctggcgcttcctctgggaacggcatggatggccctgagtcatccaggcagctaagtggactgctcggctccccacagccctgcccgcaggcctgccggccccacccctgtccctggagtggccctggaaagtccttgctgtgtacatgcatgtgtgtgtgcctgtgtgtgtacatgtgtgtgcatgtgtgtgcttgtgtgtgtgtacatgtgtgtgcatgtgtgtgtgtgtgcatgtgtgtgtgcgccgaggggacacagaactgtggagctgggggtggcacaaggacccccgaaggtactggaaccccagcagctgctcagccctggccccacttactcctcttctctttcccagccctcaccctccgcctcgcacctccactgtctgtcttggtcttgcccacagccgggctgcaggtttgtgcctgaaacttcatgttcagtctgtcttgtctgagccaggctgcagggtgcaaggagagagcttctggccgagagtcggccatgctgggatgccatgggtctccccatctgtaaaacggaaatggccatgtccaccgagtggcctgctgtcagcactgggtgaggaagcgtgtgccgggatgagggcctggtaccaggctgcctcactgtccgagtggccgtgccgcctgcaggggccttgttctgcctccagggcctgtcctgggccaccctcacagggagggagtgcctgtccctgcctggaagaggcagcaggagagaggcgttgggggtgaaaagtgttgttctggaagactctttgtagagaggtggtgcagcagggacgctggtctccctcagctgcaggggcctcggggcctggccaccgccctgtgggtcagtgatgtcacgatgacctgcagccctgggtctgtcccgggccaggagtctctgaggacctgcctggggaatgccatggagaccctggggctgggacctggcttagacacagagaccagtgcaagggaaagggggcttccaggacactggggcttggggggcggtgggcagtgtggtctggggctgccatcgatgctgcaggtcagcctggccagccttgctgtggccttcagacgggcagtggagggctgggaactgaagcctggtccagggtggtctccaggcccgcaggacacagaacacagcagagacagcactgcacagaaggcagggacgatatccggggcagactccccaggatggcagccccaagtggccaggggcacaccctgggggcaggaggtcagtgcctgcccagggccgactgcagcggagctgccacagaggggttcatcttggtctctgcacaattcaatcaggccagaggcggtaccgttcacctggggagggggcccgggacctggcccagagatgtggggcctcgcttcagtggaggacttagcagaaagttctgggaggggcccaaggagacactggggaacatgcacagcccaggatgggcctcggtttccccagtcataacagctggcgatgacacctgggacaccagtcctttggcacctggcagcccttcgggggagaagaggtggaagggctctacccactccagcgtcgggcagtgcgggcaagggtggctctgcccactccagcgtcaggcagtgcgggctgaggttcccgacctctccatggctgaatgccagccctgggctccataaggcagacggtgatgctgggctgggtctctcacagtctcagcaggtctgatccatcgtgtggaggccactgtggcccctgctgtggctggggttgccaccaggggctggggaacgagcggtcctggaagtcacagaggtgcctgtctgggccctgctgtgtctgagacagcttggcaagtctctgccatcttcctctgcacctcgctttcctctgtaaaatggaataataccctcggttcagggtgctatgagttttaaatgagaggatggccaagctggcgcctggtaggtttgtgtccgggtgggtttgccctgccgctgaagacggtgtcctctccttgcaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtgagtggggtggctgagggggcagggtggggcggggagggtcaaccaggggctgggcaggccagagaggcccagctgggccaggtcccctgaggctctgccgatttccttgttagccggaggtgagtgacacagtctcagggaggcttgctgggtccccaggtgagacaagttgaccatccctgacctcagttctctcgtctgcacatcgtgggtgatggtaacttggtgaggctcttcacaggctaaggcgggtttgtgcaaactccagtcgtttgaatgacaatgtcattcaatgtcccgtcatttgaaaaatatgttttcttgatgtttgccacttttaaaactaaaatcatttaaaaaggcaaccttattttacctgaaaagctaatataatagtaagacataaagtgacgttattcagccccagctggatagccctgccttcttctcgctccaaacagaagccccttttctgtttaaagtagagattcacgtgcattagagcgagggccagacaccaacccagggcccctccttaaagctcgcagtgggaggaattggggagggaattcctttctccctgtgagtctgggctattgaaaggggtgtctatgtgccaccttcgtcttctgggcacctgcccatggtctgcctaacactaagagattaaagaaccacctccccctcattccatacccccaacaacctaagcaggaggtgccaggatgctgaaccgtgtgtgggtggaggctgtgcagacctttcctctctctgcctcatgtggtcagagccactgtggggatgaggggcgtccagtcttcaaaatgcaggctcccaggggagcagactggcttggctgagtcctgcagggaaaagaagggggtgagaaggaggaccagggcacggcctggaatgtgagatgctgccagtggggccctaggggcaggggggtatttgtgggaggaagccggggcttagggagggctggaggtggtgtggaagccgggcaggtgggaagttctagaaccccgtgctgcgtgtccacacctgtggatgaatgaggtcctctggggccgggctagaggcaggcagcagggtgtgcaggtctgctcaggatctgctgcccagctctgcttttcggaccaggggtgagcccctccaggagccaagctgacacatgggtcagagtccccagggccctggtgaaaagatacctcaggggcaggaggggatgtgagtgagctgaacactggacagagacaccaccttcatgctcactttcctcttgaccggtcttgggtgagtcagctagccctctggagcccagccttatccgtacagggggccgaagtccgctgcatcggcagaattcgttttatttgggagagcgttgtcacacttaccctcatcttatttttgaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagcccctactatgtgactgtgccgggcccatgctgggcacttgccatgctaaattatcttgggaagtcctcatgctaggtctgtgagactggcaggtataaaatcttggctgccttcacaatatgagttcttcccctagcattatgtcgccttccaacccagcggggaaaggactgggcttggaattacagtccgatggcgactccaggcctcgccttttccaggcgcgtcgttgggaacgctgctcccgtcctctgagccttagttttctcatctgtaaaatgggccagtgttttcatcgtgggggttgatgtgattacatgagataatgtcagtgaatgtgcttttcagtctctcagtagggtgaacacgttttcagtttccacataaaatgtggttttgttatcatgacagtggcactgtttagtgacagtccaggaggggtcacttctgatagcccaccaagggcgctgaccaaatgtggggcccgtggtgagtccttcatgaggctggcagaggcagatcaacctttctcctggtgcccagggtctctctgtcacaacagctggttggaggatgtctagaacgttctctcacttttgccgtccaactttattcaaaccctagtgatccagccgtaccccctattttgaataatgggaaggttcgtttctagaaaagcatgagaaatttaaaaattcttaaattgagatgagttttatcacaacagagaaaccgttttaggagacaagtctcagaagttgagaaagtatttgggccgtgtctgttgtcccctgttgcacagaagtgagcactgattcattcagcaaacgtgttgacagtgtgcttgtcatgggcacagtgggggtgtcctgcagaggcggcggggcgtggcagagagtcccggggcgtgggagaccggcggcggagggtcagcggggggtctctgcctctgatctgagccccagctcccactgcaagagcgcagcgtgggcgagggagataaggcgcggccgtgcctggagcatggcattgccctgacgatgaatgccctgcgtcctcactgagagcctctgcatgcccggagagtcctgaggacagatctaagctatgtcggaccctttggtggtcttggggaggaggggcattgagcaagtgggagcttctgagaaagggtgaccttccagagccctgctgtgcgacagagcttcccgcggtgctggggagatgctcgtctcgccctttctggggcagtagccaccggggctctggagcacttgaagtgtggctggtgtccttgaagaactgaatttttaatttaacttcttatttgttccaagagaattttaatttaaaaaattttaattgcggtgaaatatacagaacataagtcaccgtcttcaccatttttaagcgtgcgattcggtggcgtaagcacattcatgtggctgggccaccatcgccaccaccgtccacagaactcttcatcttgtaaaattgaaactgtgcccattgagtttcagccctttcctcccctccccccgactcctggcacccaccactccactttctgtttctgagaatttgactactctgggtacctcgcataagtggatcaaacaataattgtccttttgtgtctggcttatttcacttagcatgacatcctcggggccatccacattgcagcatgtgtaagaatgtccttccttttcagggaggaccagtatcccgtgtgtgggtggatcggccacattttgtttatccagccatccatgggcactccggtggccccctcatgggctactgtgaatagtgctgccgtgaacgtgggtgttccagactctgttttccgttctcttgactatatgcccataagtagaattgcgggacacagggtaattctttctttaattttttgaggagtttccacgctgtttcccacagtggctgtgccattttgccccccaccaacagtgtacagggattctagtctctccaaattgtcaccaactcttgtcttttttttcttttttacggtagccaccccgaagagtactttgtttggattaattttcacctggatggaagccgcagtgtggctggcagctgctgtgctgaacagggcagggttgggcctgtgcacagaggatctgcctaccgtgccctgtctctgaacttgggtgctatgggggcctcgaaccacaaccccaagtggccctctaaggcctggccagtggcttgtcacactcctcttgtaagtcccagctggtcacagggctccccgtggctggagcgaaagcaaaagcatggaaggacagacgtggcagcagccggctgggactgggctcccagtgaggtgtttgtctggagctgtagagcaggtggggctgggcaacggcacatccagagcccggggtctgggggccagccctgggcaatgagctgcccactgaactggatgcagagaatggtggcacagcctgtgccctgggaaaggccgtcgagccctgggaggaggagctggtgggggccctgatggtggggacccagggaatgcaggctctgaggaggaggtgaggtggtggcaggctgagtgcaggcacagctccaccctggcagccctgcactgcctcagtttccctcatcatttggggtgacttctgcctgcagagctccctttgggatctctttgtggcagagcctgggctgggatatggggtccaggggtggcacaggcagttcagcctcatcgatcacccctgtgctcccctccccagtctcccttgtagctggtgtggagctgcatggccagttttgcctagtggcctgtgtgaaaggaagtgacctgggtcacctgtggaccaaggctggtaagagcttggagtcccctccatctctgtctcccctgccacggaaaccttggaagccatgtgtcccagtaggtacagctgcaacataggctcgggccctcccgacccaccccgcgccatggtgtgagtaaggaaacacggtgtgcggtgtattgtgttcagctgctgagatggggtggattctcggcatagccatcctcctctgtctggtgcccctggctgccgttcatacgggggccggtgtttatggggcgtctattatatgtcaggcaaggggtgcagctgtgagcatgacaggacgtaaccctgctaccttgcattctgggaagggaggcacagacgatactgaagtgaaaaacaaacaggatcatttcaaataatgacaaatgcaatgaaagaaataaaatagttaggagatggagaaggaagaagggtaggggaaggcaggccactttctacagctcaggggctggtgcactggagatatcacgggagcagaggctcacgacaacggaaggatgtgggaagaggtaggatagggatcgcctgttccaggtttgggggagggggcaggcggcgccaaggccctgaggcaggaatggggccggctggaagaatggaggcagcctggcctgtcaagcagggggcacaggtaggggaagtcggggccggcaaggccggccgccgcagtcttccagaggtggaggggagccgcctgtggctccgggagcagtggaaatcactggaggggctgcttcctgtctatgttaaagacaagacgtgatattcccttttctatgggaaagatgaagctgcccttttcatctcagacttgccagaagggaagcggcttggaaatggagcacttcatgaggccacctgggcacagaaaggggctctttggtttaggcaaccacccacctgcccactccagcagcccctgctgggtccagttttcttatcttcctccttacatctagaaaagcatgttttttggtttattgaaatagtccatatttaacacagatgatttattttatttatttatttattgtgagacagagtctcactctgtcgcccaggctggagtacagtggtgtgatcttggctcactgcaacctcttcctcccgagttcaaacgattctcctgcctcagcctcctgagtagctgggattacaggcatgcaccaccacggccgtctaatttttttttttttttttttttgtatttttagtaaagacagtggtttcaccatgttggccaggctggtcttgaactcctgacctcaggtgaccacccaccttggccttccaaagtgctgggattacaggcgtgagccaccgtgccgggacattttttttgctatgtaaaattagcataaattcctgtaggtatgtgaatgtcttctcccagcagttaattgtctactacgttgttttaatgattgcataacatcgcaccatatgactgtcacacactttttacctaacttattatttatatgacatattcacatagcaaaacttatttctccattagaggtcagacatgccactaactgtatcacgttcatagagttgaatctatcgctcgtgcttacttatttccttaagctgagttgctgaaagcgaagtctctggccaacagatatgcccattttttaagctttctacactggaatgttctctgttatggtttcatctattcccgcttcattgagcaaatgactgtctccccacctcctcacaccactgagtccttttgagcagtggtaatttaattacaacggagataagtttttttgttgtaagttgttatttccttgatgttaatgagcctgcatttaaaaatatacgtgtatttgtaaacagagattattttatttttttgcttggcctattcatgcccttgattctgctgggatttgggggtgttttattcatctgaagagtctgtgtacttaagtagataaactttttgtctgtcacatgtgtgggaaatatttcccccagtcctgttgttgaccttttgttttattccgcctgggatagtttttgatgtcctacatttttgtgtgtgtgaccacagggaaagatcctgcagtctttcccttcccaggggaaaagcttctcccttgggtgatgtgtttgatgcctcctgccctccccagaagttaatcttctgagtttctgccctacttggcagctgtacttcccaagctccagttcctcaccaaccgctgactgttcttgggtttagccatagcagccctccacctgaatttctcccaaagtaagaggaaagataggcttagtgcagtggctcacacctgtaatcctaggactttgggaggccaaggcgggcggatcacttgaggtcaagagttcgagacgagcctggccaacatgacaaaacctcatctctactaaaaatacaaaaataagccgagtgtggtggcacgtgcctgtaatcccagctactcgggaggctgaggcaggagaatggcttgaacctgggaggcggaggttgcggtgagctgaggtgacgccactgcactccagtctgggcgacagagtgagattctctctcaaaaaaaaaaaaaaaaaaaaaaggaaagaaaggtgtggcggggagatagagaattcaaaggagccaatgtattacatgcaatgcattcttatttcccctcaatatctggctgctgcaaaactcgtcaggatattaccagtggggaacactggcctaaaggcagagccagtagtaactcccaggccccaacgcacaatgaaaatgtgggatcgcttgttcaaagagcagaggaaggtgccatacaaagggactattaagccacttcctttcttccttagtctctgtctctctgtctctcaactcgctgttctttttatttgctttttaatattgttctaagtgaacaaaaattggaaccttgaattattagcatgaatttcttattcatctttaaattgtgcgatggctattttaaatgcaaatattagagcatttagcttctatgtggggtcactgaaattaaacaaatgtgtattttgtggctgatccctgatgggtgcctcaggctgaccagaagtttatgacaggcacagccagactcagggaggctgggaggaagaagagaggatttcacagagtggaatcctgccgaggggaggctcctcaggtacggggtcctagcagagtgagtgcacccccagcaggaagggcacacccactggggtctgagagcttcctgccacccctggaagaacacattggctgtgccctggccagggcgtctggggaagtagagccaggcacgcccccttcctactggtgcactgctccagcccagagcgtatggccacggccaatcccatctctatgcaggtgtcactcacgggaggctcacctctgccgaaacacgggctctggccagccatccaccagacatgcccctttcctgccagccgtgggcgggatggccaccaccacgcctgccctgagatgccgtggggaatacatgcctgatcctgcccctgctgggggcagctgaaagcctgtcctggggagatgggaccatgctgcattgccccaggagccttcacttacaaaacacacatgcaagggtgagatgacgaagaacttcaagacagagctgcagagggtcaagccccaaggtcggggccttctgaggataggccctggtcatctatgaagtcagcctgtccctagggcgagcccagaaacctgagccctgcgctcagaccccatagcctgagggaacacctgctgccctgcatgtgccccctggatgccacctcagactcccgttctctgtggcctttccccagcctctgcttgggcatgtccacacacctctgaggcccaggcgaagccagccgtgctaagagggcactgggtgtgtgctgagcctgtggcaggcagggggcgggcccttgtccacagaggctctctgcagtgagttttgtttttttttttttttccttgagatagagtcttgctctgtcgcccgggctggagtgcaatggcatgatctcggctcactgcaaccgccacctctcaggttcaagcaattctcctgcctcagcctcccaagtacctgggactactggcacgtgccgccatgcctggctaatttttatatttttagtagagacggggtttcaccatgttggccaggctggtctagaactcttgacctcaggtgatccacccgcctcagcctcccaaagtgctgggatcacaggcatgagccactgctcccggcctacactggagtttgagcacacgcagctgtagccctcctggctgctggcaaccctgggatgagtctggtctcctgaggctcagcggcccttagcctggtcagagatgctgaggccccttggggatgcccacattcccccgtctaagggcagaggggtctcccttccaagcactgtgaggctaggaggatggagtgagagccgtgggcagatgtgtggcccatccagctttgctggccccccagccccgtcactggcagagtgacttctattccctctgccttcattctgctcctgctcctcccagctttctactctggctcagcctgcagcctccaccttgcgttgctgcctcccctgggcccagccgggaggataaggggctctcctctgcccaggcccgccccccgcccccgagggcattgggagaccactgtcatgtttgacctttcctgcttgggaaacatactccctgaagtactgggtgctgccaggctgggacacaggtgacattgctgaacatgcctgatactgaccctggggctttggtatttctcacattttcaaaaacttgctctgccagcgcctgggctagtctctgctcacaaaccagatgctgtggccatgtgtgtgggcctgggcacccctaaagagtgggcttgggcctgacaggcgaggctgccatgctaggaggcagctcagatgtgtgtggcacctcaagtttcgtccccaggtacagacagggactcttctgcaggctcaggtaaatgggaggcagggatgaatgccttggaagatcagagccgttgtggaagtaatatgtttatatatgcatttttttcttttttgagacagggtctcactcagtcacccaggctggagcgtagtgctgcaatcatagctcactgcagcctcaaacttcagcctcccaagcagctgggactacaggcacacaccaccatgcctgactcattttttaaagatttgttttagagacaggttcatgctatgctgcatggtggactcaatcacctgggcttaagtgatcctgctgtctcagcttcctgagtagctgggatcacaggcacgagccaccacgcctggctacagatacatttttaaaagtaaaatctatctgtgccaagacttcaagaaatataaagcttgggcccaaggctgaagcttcctttgtggcttcaagcatttcactaaagcgctaatttcaatcctactcttcccgagaagcctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagccacgcctattgatttatgaattgcctgtggccatttttgtgctacaacagtgggttgggtagttgcaacagaaaccatatggcccacaaagctgagaacattcactatgaggtgctaaaggaatttttgctaccaggctgtgcagaaatgtacttgcttagtgcctgccttgagctgtgatggccccaggcctccaaagtgagcatgtgcctttcactacatcagtgcacgtgggtgtacgtattagggaagtactgagcacagtgggctgctcagaccccagcccacccccacactagccttatcagctcaaaggaccggtgaggctacttcggggattctttttaaaggatagaatgaactgctcttaaccgctgtagaacggcagagcaggaggagcaggtttccgggcatgcagaatagtctctcccagctgtgttaactgcttatgttctgggagaatgcctgagcccccaaagcatctcttctgctgagggcagacacgctcctaggcctatggagaacgtggaatccaaggatcttctgcgccttcagtcgcggctataacctttgacccctcccagcacgagaacattctctgtacagtatgttctacgaccgttttttttgaatgaatgatttctctctatgccaggattcagatatttttcctcttttcatttctaatttaatccagaaattggcctggacttaccagagccttgccagggtttgcaaacaatccgaaggcatatgggctcaatttctcaccaactttcacgagtgctgagaccgcatggtggcggtggggaaggcagtggtcggacaggagtgttttcagctggtcgtggtggaaatctcgtaaactggccgcagagatgcaaaccagccaggcggaaggcgtcgccccaagtcatagttcacgagtcgctggctctggttcctgggaaagagaagaacatctctgaaactggacacgaaacacgggtcccttaagtggggggaggcaagcggggttcagggtctgctagtggtgctgtggccctgggggtgttgctggcactgtttctgttcctcacgcttgtcccgctggccttacagcctggccctgtgtgccaccaggagacacagccatgagggccagtggtgtgtgcgaggctgcacgcaaggctcagaagagggcagtgccctcacgtgctcacagtagccaggcccgaggggcccaggtggctgaaggctgttgggagtggtggggactcgggcgaccggagaggccacgcccccctgcagagctcctcgtggttccactcgcttgtgtttctgtaggaataagcagaccactgctgccagctcgctcttccatgagaagctggaaatctactttttttgggaaatctaattatttttcaatgtgggccacagattgaaattaagaagccacactgcacaggtgaagcagaacacggctgcaggacaagtctggtgtgtgggtggcctgagtgttctttccagcctagaaggaaggaggcgactgcctgtcctgctgcgccctgtgctggtcagtgccaactcccggggctgttgggagcaccactcgagttgaacaccaggaaagtgctcagtagagcacgggtgtgggaggagcatgctgggattgggagctgtcctcagtcatgttcggcactccctggactcctggcctccgcatccctgcactgggggagctcagagcacaggagtatggggagcgggatcaggacacgtgattacaccttggttcatcagggaagggtgcctggggcggctggtcagggaaggctcctcggacaagggccaccgcagttgcctctaatgaggactcctggtggtggcacagcgcgcgcaaaggcctggccgcatcgtgaatcgcagtgcgcagattgggccctgctggagcttgtggggcttggagagcgggagcgaggttgatttgtggtctacaaagatagactcctctctcttaggaggtttggggcttatgctttctatccttggaaacacccctccccacctgaggaggggaactcacatttgctggttttgcacgtgctggccctgtgcaaggaggcacacctgtgacctcactaccttgccccagtggccctgtgaggttcccttgcctgcatcaggtcactgagactgagagagacatggccagagcacggcagatggagtcacatacctgtgggaaggtggcccctgtgctggtcctcccctactgtctggcctgaagatcgagagctcccaaatcccctagcatgctccgcgggttctcatctcaggcctcactgacctccccacagcatttggagtcccctggccacacccgcctctccccgcaggccatccgctctgcctcttgctttgccttggcttctgcatagatctactgtgtcctcctgttctgaggcccacccgcctgcccactcactcccttagtgcacccggatagagcagccctaggtgctggggatgtcgtggtgagcacgggatccagaccgcagggagcacatgttccagcagggctggggaggccgacagaccagtgatggtgagcaggtggggaacactcgaacaggggtcttgtgggtggatctcacctctgcttcctcctgaaatgtgcagcaccctccccaccagtggacatctccccacctcctccctcctccctcctccgcagacctcctgatagctgatgtggaagcctcccagcatcctgtccttggcctcccgcggggaactgatggttgtcagaatgggagttagagtccctgtggacgaggagggccagccatccacacacccggatgacagcttgaggcagcctcggagcttgtcttgtgcaggctccagcaaggaggtgacagctgaaccacaagaacagaggcgatgatgtgccacgccgggctgtcgggctgacctggcgtgggctctcactccctgaggcccctcccaggctgcccctggagctgagttgcagtcaagcaatcctgggtcttcctccccagtccaggggtctccttggtggtgtgtctcagcagggttagggactcccacaaaggtgactttgtatcggacccagagagggtctgcccacctgatttttcactgagtacctggaaaaggcctggcacgtagtaggtgctcagtaaatctcttttgaatgaataagtgactaaatgaattcccataaagcgactgtgatctcagagactcccataaaaatgaactctatctgtgggtgtggaactcctcgtggctgggtgtccttatgccttcgcttctatgacagaggctgtgtctccatcgtccatgctgacgtctgaatggccaggtcccgggatacagtttctagttgcagcaggtttgccaaattgctcctcagagcctctgtactgactcccatgcccacttatgtgagcctctcaatctctctgtgcctcggcttcctcactggcacagcggggataacactcactcgcagggtgtgggaagggaaagatatcgcacgcggggaagtactcggcgtaggcggagaagatcagagccgaccagcgaggcgagcagttgttcactcggcccatgatgtctgggaagagccccagccagctcccgtcctggacaagcttttttctcatgggggccacctgcttgccttggcacagcgaggacagggccttggcagccaaaggagacggtcagctgtctccacctggtagtggagatagtcacagtggggtgatccttgagctggttttggtcacagagttggtgtctcccaagtggaaagtgggagggcatcattccacacagaggagccccttgtgcaaaagaggtgccagccctcggccaccctgggagcccgctggggtgggagaaggcgcgtgcggctgagcttggccttggtcctgaagcctggggaaacacgggagtactgagcacccaggttgcatcagcaagaatgcagaacagtccctgcctagtggagacggacagacagctaacaaacgaaggcgactggagatcacgatggtgccaggaagttaccaggatgggacagcacccgaggcagcatagggtgccccgtgggaatgttcacagagtgaggaaacttcagagcaagggaaacttccctgcagccagacaggaggaaggaaacctggctgcagcctgcaagacctcccacccgcgcctggcagggagcctggcctgggggctgcccatgctggcccttctgatcctgagcagaagtgatcacggacccttgtgcttccaataattcggcccctcttcctttggttctgggtttcctgtgtagcggtgggcaggatttcatctatctttccatctgccagagtctggcaagggagctaagccacataaacagactctggtggtgcagggggattgtgacctgctgcacagaagggcaaagccgtttcccgccaagcccaagaggcgctggaacatctgctctgggtgttggaaagcaccctgcatgactgcgctttcagggagggatacgctggcagcagacgacccttgccgtgagcttgtaatgcaggacccttcttgcagccttcaccttactcttgccctgcgctctgagtgccttgggggcccctgcccaggtcgaggggcacagtgcaaggtgatggcctgcagccctctgtcatgccttctcagtctctgaggggttcatacctgctctgccagggcctctcccttcttcctcatcatgcatggatgcctggggagtagggaggctggcctgagtcctcctcagctttgctctgaggtggtcgggtctgacgcctgggccacttaggcatgctggacccctgcccagtccaagccctatgccttgatgggtgtccactctacagcctctgccagccagtgccagctacccacgccctggccctcaccagcaggagctgctgcatcccacacacccccttctggagcgaggggcatccatgtgctgcctgaggcccattcattaacatgagatccctctccattctaaccacctgcttggccaccatgtgggttggcctccaccctcagcagagggtctcatctcagtgggaagtggagcccagaaccccggggactatctgcatctcaccctaaggcgggggcagcggtagggatagggctccggctccaagcctggtgtgggctcagcagcccgccccccaccccggcagctgcttgctgccccctcccccacaccgttcctgtcccctgatgccacagctctctcctcccatagcggcattttccttccctctttccttaggtcacactggtgacagagcagcggcagaatatgatgtgtgggggaataaaaatgcattgttctcaaattacatggtggtgctcaaacggacccaggtgaccgagctcagtcacgggatgggccgggccacacagcctctgagacgggcgtgtggggggatgccagggccgggggtggcacgagccctggccacttagggcccctctttgaaaggaaactcctcactgagccccccagggctctgtggccagggacagccgacaagctcagcagagttccagggaggcagggccgtcctgcagccactgctagcaagaatcagaatccctgacttttctcggcctttccctgtcagtggctcgcagtggccgagaggcccctgggggacactgggctctggcctgaggcctcggccgtgtccttctgcgtcctgcagcctcagcagcactggtccttccccgttctgcagcatttccctttctgatgaggcatccggtcagcgggtgggaaggtcagtccctaagtggtggcatggctgttgtttccccaaaggcgacgcagccagcggggagagctccagggctgggtcacactcgcggacgtgcctgggcacagcagcccctccagctctggaaaacacaggggcatgtgcaagctgttcactcagacctctcccaatggtgatggccaggaggagagccagggtgggtgtaagggcgaagcccaggtggaccattctgtgcatggggtcccagggaaacagcttgggctgttggaccctcctgtaatttgatgacagtttcattcagcctgtactaggtgctggggatttcacttttgtcacgcatgtccgtgtgaagagaccaccaccaggctttgtgtgagcaataaagcttttgaatcacctaggtgttgtttttacctaaatcagtctggcctggtgtatgacaacataaactcaaggatagagcccaaaaactcgccaaccaagcaaataattatgctgaacccccttgggcactctctaattggatgtcctgggtcctcccaattcttagtcctttaatacctgtttttctccttttattcggacgctgtgtcttccgtttagtttctcaattcataccaaactgcatccaggccatcaccaatcattctatacgacaaatgctccttctaacaaccccataatatcacctgttaccccaaaatcttccttcagcttaatctctcccactctaggtttccatgctgcccctaatcctgctcgaagcagccctgagaagcatcacccattatctctccatatcacccccaaaaattttcaccaccccaacacttcaccactatttcattttgtttttcttattaatataagaagacaggaatgtcaggcctctgagcccaagctaagccatcatatcccctgtgacctgcacatatacatccagatggcctgaaacaactgaagatccacaaaagaagtgaaaatagatagttcctgccttaactgatggcattccaccattgtgatctgttcctgccccaccctagctgatcaatcaattgaatttgtgaacaatacaccctctccgcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcctctactaaaaaaaaaaaaaaaaaaaaaaaaaaaaaccaggcgcactggcgggcgcctgtagccccagctactcgggaggctgaggcaagagaatggcatgaacctgggaggtggagctggcagtgagctgagatcatgccactgcactccaacctgggcaacagagagagactccgtctcaaaaaaaaaaaaaaattgctcctaactccaccgtctatcccaaacctataccaacgaatggtagtcccaccaccctttgctgactctctttttggactcagcccacctgcacccaggtgattaaaaagctttattgctcacacaaagcctgtttggtgatctcttcacatggacgcacgtgataattttcattgttgcttcaacctgaaacaaccctgagacacagggactattattatctccattttatagataaagaaactgaggcccagacaggttaagtaactggccccaagtcacgcagcaggattgtggcagagcccatgctggcacccatgaaatctgacctcagagtgggaatatcccccccacactctgctaaccccccaaattcaggagagggggaggggcagcctcttgccgtcgttagtacaaacccgggaaggtttgtaatgcgacctgtcttctcaacgtgcctgctggagtgccacactgaggggtgcagcacatctcttgagaccctgctgggctctgtgcattgatgagctggcctggaagtggaggagccccgtccccaccctgaggcatctgcagaggtatcagcagagtgtggacaggcacaggagacgtcgcctgaggagtgagggggtggccttgggcagagtgttcctgcgctgggtattgaaggaggggactctgaccacctcactttttgatgtatgaactgagcctagtaattctgatcctggccatttccgtttcatggtagtttgatattttgagcaagagtcacgtttcttctagcattccctctgaagcatctgctgaggagccgagggtgaagaagatctgcaatgggaacgttgattctcatgataagcccaggctctggcagccccgtttaggcaccatgcaatgcctaaactcttcctccacggaggccagcagacctctgtcccctgctcctggctgcactctcttctctgcctccatcctggtggtccaagcctggcctccgaaggggcacagagagaacagccttctcctcacttatttcagggggtcccagagaagccacagagcagcaggcccccctcccccaggcctctgacagacttttcaggcctggcttgctcctggacatggttttgccaggtgggccacaggctgcctctggtggcccaaagctcagctgagcgaaggacatgggaactttcctgaaggttggggtggctgctgttccagggcccctgcctgtctcctctgtggctggcgggccagtaggcctccccagtagggagcctgcaccggttcccccctttctgcacccctcccccaccttggcagaggacaaagtcacctctgcccagcagccgcaggccacctcccagggctcaccatcccctgggtggaactctgccaccagtgaggcaaactttacattgccatgcagagccgctccttcctcattgtctattccagaacagaaacttggctgcatctttgcataagcaaaaggcgcattacaatgtgtttccccaaacaagagagcccttggcctctctccgcacagagatggctgcggctttgaacatttccccccaaggtttaaagattccaggatcaatttctcagacagtactcaaggacattgtccctgggcttcccctccccctgcaacctgggaaaggagagctgcttctccccagcacacgcaggccttgggtagggtggatgcggaggaggcccccagggctgctggggggaggggaggggaggcccttagctgggggcctcccccatgagaggggtcacaggcctacgctgggtcatacattttgcccatttcctgttattccatatcttcaaagtgattcactccattcattcagcaaatgtttactgagcacctactatgggctagacactgctgggagcagttgcacggcaagtccaaagttcctgaggtggagacaggctgcctgtgcaaggagcagccgggctagccgctggagcacagggagcagggccagggcagcccgagaagactcagcagggccagaccctcctggcctggaggtcacgccaggaactgcggtctcatgccttggggtaggaagggtttaagcaaggaggtcactgcctctttcctttgagatatattttttaggatgagtcttttttttcaaatgctcctgagatatctaaagaattgaggggctgcacagggagagtgaggattccaggcctgaaccaaagcacaggcagcaggagagggcagccggctctggggaaggctggctgggctgtcaggagcaagggtgccatgtggggaggtatctgaagtgacgcatggagaagccagccagggccagcgtggagagggctccgaatgccaggcgaggggctgggccctgcttccgaaggcactggagagccgttgagggttttagacagtggaaggggaaggtgagatctattccgcttggtgatcgtagtgaagaatggtgtgtgtgggtgggggggtggggaggacacgagggggaccgttggggagccctaccgcctgtctcctgtctggcagagaaagtgggtggggccgggggaggagggggatgtgcaggaggcaggcatgtggaggtcgccttctgtcttcagttgctctttttgccacatcagtcgactctctgctctgcagaaatgttgccgctgtgtccttactgaggacgccagtgttttgtcgggaattacactgattactcccagtggttcccatgcccaggtgggccctgcaggcctctggccagggctgggcaggaaattttggcaattttgcagcctcctgaaaagcaggtagagccctgggatggtagagggggcaggacggggctcactcctcaggcccacggaggacaaggacactgtggagcacccctgcctctcacatgccccacaaaccctgcctgccccccatgtctgttcctgatgtatcatattaacctacggggactgagaggctggacagcagaaggagcccggccccggactgtgggttggactttgccatagcacacgcaggggcaggagaaccacccaggccagtggtcagtggtctctgggccacagtgccccatggggttcctgactgctgggaggggctgctgagacctggcctgggagggggccaagttgagggctccggagcaggatcccaagcccagcagccacccagaggagccaggaggccatcgcaagccccaccacggccttgctcaggcctgcctcccagagagtgggcatgcctggggaactatgtgctgtgctggtgtggaagggaggaagggacagaggtttcctggggagaggatcagggagagcgcaccacagttgaaggctaccagggagggagggctgagggggccttggctgcggcctggcctccttctccctggctacctgctgggagcatttgcaggcatgccctctctagctcctcagcagccagggagccccagttaatctccgaaccatctgaggcttccagaggccagggtcagggcacccagcgcaggaggtgggagctggctgctggcggacagcccacagtggagctccccagccaggggcccacgcctagcagcctgacaccccagggctcagctgcctcgaccccacctccaagcagaatgtgaggctgacggtctatcccagggagttccatgcccagcgacggggcttttggagtggttggtcacctcctgtcccaaatcagggagcaggattagatctgctcaatgttcagaaggacacaagattccttcttgagatgagagctgccaccttcggccccaggggtagggctaggagagtgggaagatcttgcgtcctgaggggcagggcctggccaggagccaggagagggccagccccgcatctcctccctccgccctgtgggagctgccggaatgcccttccagagccccagcctctccctgctcaggcggggcagatgacccctattccaatccacatcatccctcacatccgtcccttctctgcactcatccccaaagctgaaccccacattcccacatcttgaccccttccatctactttccgtaaggcacctggagtaagcttcttaaatgccccgccatcatccttcctccatgtcctcccactgctcttagagaggatttggaatccttctcctgacttcgtggtctggcctcagtgctcccctcccacctcctctgctggggcatcccttccacatcccctctgtgcttggaaggtgcctcgctgcttccaaccctgggaggtttgcatgggctgcctcctctgccaggagcgccatccctgctttgctgagctaccctgttctgtttctcaggtctcatgacatgccacgtccttccaggccccagtgggcagattcccactaatatatcctctggttccctgcctttccctcgaggccggtgatcctggagctggtctcgtagcatctgagtgtccctctccgcctcctggcaggagggctggctctgatctactcagagccacaattcatggtgaggcagtggttctgctgggtctgctgggtgccagcctcagcccagtggggaaggagagaccaggtcaggctcgcccaggccattctgggtcccagggtgtggtgggctgcacaagaggccagggtcagtttagtttgagaagtcccattgagagcctgtgaggggcccgtggctgtgctgagggtctgtgtggacggtgaggtcaacatttacacgcttaggctcaaacgtggggaaaaatgcaactttctttcattcttttttttttttttttttttttagacagagtcttgctctgtctcccaggctggagtgcaatgacgcgatctcggctcactgcaacctccgcctcctgggttcaagtgattctcctgcctcagcctcctgagcagctgggattacaagcgctcgccaccatgcctggctaattttgtatttttagtagagagagggtttcaccgtgttggccaggctggtcttgaacttctgacttcaggtgatccaccgccttggcctcccaaagtgctgggattgcaggcgtgagccactgcgcctggccagggctttctttcgttcctatatctggtgctgccctcatctcgggcactcagccccaggatagaaggaaggctgcagtctggcctgtgggaggtggctcagtctcttccccataaagcctttgtctcattccgcttgggctggtataacaaaatgccatagacccaggggtttaaatcacaggaattcatttcccacagttctgaagactgggaatttcaagatcatgttgccagctgggtcattccccagtgaggattctcttcctggtttgcagacagccgccttcttgctgggtcctcccacggcagagagagaggatgcaggctctctggtgtctgttcctataggacactaaccctatcatgagggtcccacccccatgaactcatctacccctaattacctcccaaaagccccatttgcaggcagaggcctggtggggggcagtagggatgagtcccctctgcagtagccttgcaagcaggcctgccctcctctcctgtaggccagtgcccccctgggcttgccctgaagcctggtggtgccccctagagccaggtaaacctgcaagccagtccccaactatcttgcccatgtgtctctggggtgcaggggaccctggcatctgctacacacagctgggagctgggccaccctctcaggcctgagcaggctgggccaccagttgggccctggaagccactcctactgctaggaacctgtcccctctcaggtcccaggcagcagccaggatcaagctcttttgcatttccttccttctcagatgtcaggactgttctgtatgacctgtgaggttggggttgaggatgaggagaagcctggcccctcatccctggcctttctcctctctcctattctgctcccttcagctgcagtgggaccttccctcggtcagactccatgagccaagctggccaagctttgtcgtgatagagaaagcaatactgtggacaattacagaaaccccttctctcttaagaaaaactggcttttaaggctactgtgccagcgtggactaaacaatctagtctgaccctcaaagctgggcaaggacttctgtggtttaggggtgcataccctacccccaggacctcacagggagctgcagggcactatggtttaccagcaatgaaaaaccgtttcattgtttgcacaagcaccattccattgcacctgcatgacggtttcatccccacaacagctttgtgatggggggactgcaatcctcattttacagaggaaacggagggcgatgaccaaatggcaaggcttcctggggacctgggtgccctcctcggagctccatcttgtcagccacaggggcgagatgggtcactgggggtctagaggataaccctcagcgcctacaggggttgctgacccaccctccccagacgcctacagcccggagccacggtgaccagccacgctcccgtgggtctgatgagttgtcccttgcctataggaaagagaggtgggagttgtggggagcccatttacaatcagatgtagatttgctgggcagcagttgccaagaggagctgcgtttgggctggatggtaccctcagcagggtccacatgtcatgaactctgccccacgatcggtgccatctttgttcccagcaccgatgccagcgggcctcgggatccttgtcttgcacgccctgtatgcctgtccacccatccatcatgatgtcattctccttgtgaaccctcgggtttcctgaggtgccttcccactgttttgaggtagcaatcactgttgctcagatgcaggctctacagattggagtgcagggagtgtgtgctggcctgacgtggcagcaggctccgggaagtatgtcttggccatgtccggagctgtcagcagcccctgggctcggtctgcacacagccagtccctgtttctccacttcttgatggtgccaatggcttcagcctttcagcgggtatccctgagtgcctgccaggtgctgcttagcctggctctgggcgtgcaagcagggaggatgcaggtggctgcccagcccacaggggcacacagagggctccagaaataacacaccttgtgcttgatgaggggcggctcaggcctgcggggggccttccagggggaagtgactgctgagctggcctcgaggaggagtggggtttggttaaccaacaaaggaggtgacaggaagggggctgcgctagggagggccctgggtgtgtgcggtgggaagctggagggtgggggctcagtgcgaaggaagcccctgacagcctcgagcccgggataacctgacctatgtttctggagggtcttgctggctgtgttctgtagaaggggagttcacccccctgtttttgtgccacgggtccctttgatatctgctgaagcccattggcacctgctcagaataatggttttaaatgtgaagaatgaaacacgtgtaagaatatgattgtgataaatacagagacggcgactgcaggagctccagccatcaaaacagaacagggagagcacattggggatgcagtaatatgagctttttattaacacgttaaaacattatacctggtggtgggcctagaaccgcccccatttccaagtagcgatgcaggtaggtaatccccacacccaccagctatagcttggagtgacttctgccagggccggtcccagccctgcctgtgccgcgggggtccatcacccacgttcactgttgaagggaaggttgtgtttcagctggaggctacagcaagcgtagggctgctttccctgcccacgttccatgttcaggccccaggtgaggaaaccctgggctggtgggtggggttgctcaggaaggggctacagtgatcccagcaggtggtggtggcagcctggagaggcagagggcagggggcaatgagggaggggtcacaaggtggctcctagttgatggtgacgcctgggtggaaagcatgggaagaagaaggagcaggtgggggtcatcccattggcagagccagagccagtcctagggcctgtggttcccgctgatgcctccctgtttctttcaggtcaatgaaatctaccatgacgagtccttgggtgcccacatcaacgtggtcctggtgcggatcatcctcctgagctatggaaaggtgagtgcactgtggccagccgggcctgcctccaccccctcggagtgaggggcctgggagtgaggcatgggcctccttggagagtgtgtgcgtttgccagaaccaccctgcctctccctggctcccctgaggttcctataagaaacaagatccctgctccctttcaccccttgttttaaaatgtggccattactattgttcactgaaaagagtctgttactcccagatcccaagaggaagagacataccaggccacgggggccacacagggaggcaccaggggtggtcaggaggcagagggaattgggtaaacagcagcctgagtccatgttgtttctgcaggaaggaccgatggggacagggtgagctggcttaaggttggccagtttgaataattccagtgggctctggggagtggagcggtcctgagttagttttctgggtaatgagggcagggggatagtggctcagagtgtgaagtctgataaaggaggtggctggggacatgggcgctggattggttggtttgtatctgaaaaatgtgctcatggatgagttgtttcctgtctctaaagattggttaccacttagcggggcagtccctccagagtcagcaaggctcggatgtcaaagcatcagaaacacgtggttaacacgaccctcccttggacttctgcccccgtattaaatctgtggcctcctctcctctggcctcggctgctgtcccagctgggctctcttgcccgtcccacttcctcttgcagccaaacctgggacgtcctttcctggcggtgtgcatgggtgtgtagccgccagggacagtgacctgggatggcaacacgggatgctgtgcagacagaggaagagaggagccccacggtacggcccgtgtagactgcaaagtgcctgtaccagccgtgtgggaagcactttgtatggatgaatgcccttaatctacagggcagatggaggggtgcacactgtgactctgcccatttcacagataagaacaccgaggcttaatgtgacttagtgacatgcccaggtaagcagccagggccatccagcacccgaggagtcaggcttcttacccagacagcagaattcgagcctgtggtctggctgtgcatagaaaatcaaatcataataggatcaaatacatcagataattatataaaagttgaactctgttcaaagagaatctcagtctcaaaaaataaaatcaaactgcatacaacttataaggcacacgatgtaaaaatgatgacgaaggactccggtggcagaagggatcccaggaatactaagtagatttggggccacttccctacacccaccaagcacctcattccacagtgaccgaaggcacccacagggcggatgccagttgcaggccttcgtgtaccccaagagaacacaaaacatcccaaaacaaatccttggaacaaaggggaaattggcaaaaacctaactatgagagtctctaatacacttttaaaagcctttcacagattagatgctaataaggcatagaatttttgaatgacacaatgagtaaagctaaattagtagttatatcactgtttcccttgccctacagaaaaaaagaaagatgaaccttcttttcgaggaatcatagaacacttaaaaattacagaagtgttttgggtcataaagaaaatattgtgaattttatacagctaaaacgattttgtccatgttcgctgatgaaatgcctaaaagtaggggtgggggcagcagaatttataaacctaaaaaaatccaattcatttgaaaacattaaaaaaaaaaaaaacctactaggggccaggcatggtcgctcacacctgtaatcctagcactttgggaggccaaggtgggtagatcacttgaggtcaggagtttgagaccagcctagctaacgtggtgaaaccctgtctctaccaaaaaaatacaaaaattagccgggtgtggtggcatgtgcctgtagtcccaactacttgggaggctgaggtgggcgaattgcttgaacccgggaggcagaggttgcagtgagctgagatcacaccactgcgctccagcctgggtaacagagcaaggaaagagaatattaggactgcagtacagactatttggaacactaataaaaacaagagcactactgtcaaatcttttggaatgtggttaaagctgtattcagaggcaaattcacagatgttttccaaaagcttcttccttgggtgatatgttcgacacacattagccctgccttcaactcagtacatttgaatgaatttcaacagcaacaaaaccaaaaacttaaggaaagcaaaaataaggaaatagttcagaaaaagcagaaatcaataaattagaaaatggaagaaacacatagaatcaatgaagaagagagctttggaaaaagcaaccctctgacctatttaatctagaaaaaaagagagaaggcacaaactaaaagatcagaaagagtatatgtaatgtgactacaaaaagatacttctcctggcagaaaggaaagcatgcagggccatctgcccactaggaagctgttgggaggctctctgcagccggccacttcggaggtccagggatgatcagtggaggagggatgtgcagggcatcctctgccagtgaatgctggctaggagggcagagagaggctcgctgagccctctatcccaggtttgtggcagggggctttggacagatgcagagcctgggggtgggccccagcccagcaatccggttccagctctccattcacaggcggggaggtggggggggatctttggactatcccatgtggctggctgcctgcctccagtggagttccctgttccggccttccccaagccgggtctttccagcctgtcccttcctggccaggatcctctggtgttttaggaattctcaagcctttggcatgagagatggacagagttatatcctcttttggaagtttccaaaaatgggaaactcctggtcctggggctagaaaggggagaaaagattatcccattgattggtctgggtgccaggtggcggcttgcattttcccccaggttgctcctacattgtttaaaaagaagaattttgtaattgactagggttaattgcttaccagtgctggcaaagctttggatcttatttggcctgaaaagtgtctgctctttcccagtcttgagtacttgatggaataaagcctcctttattaattactccttagcaggctctatgctaaattatcccgaccctaagccttttctttttctttttctttttttttccttaactgcctcaggtaggtagaaggagtatgtgatcacagtcagaacatttgcagaagagagtcaaaccctgaaggtgagaatttgaggatctctatgccagggacacggagatcctggggaaattgaggatttcctgggatgtgaatatttcaaagctgactccaaaaaatggagaatatgccataagtcccataaccatggagggaactcaagttcttcaccttttccaaagttttgccagtgcattcatactcatttgcaagcatttatcaggcaagactaatacaataccctgtaaactcatgtattctgaaatctacccaatgtgtctttcgtagtcaatgggacccttatacccaaagatgccaaaggtagcccgtcaggacaaagtacagacctgtctcacttctaaaaatagaagtaaaaatcccaaggcattaagagtttaattgaataatgtataaagagaaacttctaccgtgatcatctagggcttatcctaggaatgtggagattgtttaatatcaggaaatctattcatacagttcatcacatcagtttccaaatgacaaaactcatcctctaacaaatactgtttgaagggcttctgtgtgggaagtgctgtgctgggaatattcactggcatagtctctgtcctcaggggaccgcttccagaaggcagatctagacaaggaaacaattgtaccagggctcagggctggatggaggagacgcgggtcaggcagtctttccttacaaggtcaggaaaagcaacgggaggaagtgaccgttccacccacacctgaagatggtccagtgaagtcaccagcatagagatgctctgagttcataggctgggaggggagggagggcagctgaacccagagggacgagcacagggacaggaacagcagacccaatgccaaagacgtcggaaggagccgatcgcaaggagcagagcagacctgcgtctcccgccaaggggtttggcttgcccatgagggcagctttaagcagtgacacgatcccatgtgcatttctaagaagatcactggctcctgtgtgcagaaggggcaggtgggagcagtggcttaggagacagtcactgccatcaaatgggggatgctggcagctggactgggaccaggcctgggtccagggatacagacaggaggacagaggaggccacttcgagaggatgtggcactaggtgggtgaaggcggagagactctcagctgggtagatgatggtatcaacccctgagattggggagcacaggagggaagctgaagaggtcagctgagatgtgcagttagaggtacctggtgccatcccagcggaggaggccaagaagatgtggatgtgggtctggagccctgcggggtctggagctgggggtagcagaagcaactgcaggcatgaggagcttgctgcctagggggagcctgggagagaggcctcagggctccagtgttgaagcctctggcagggcaagggcgtgacggccccgtagcccctcacagggcactcctccttttccagatccccagaaaactagtaacagagggcaacaggacaaccaagattgtatttaaaggcggaaaaagaagcacatttccctaaaagtgttctgcacagcgaattcttaggatatgagtagatgttacagaggactatagaggggtcccaaggtcaaagaagtctggaaaatgctggtcaaacaaaggaaaatgggcattcctgggggtgaaatttcccggagactttcctgtggagctgtgcatggtgtacctccgagagtccgagcagtacaggtggtctctgaaaactttctccacggaagcttcttgctcagcagatccgcagcctgctgaacctgctctggggagcactgccctggagatagtcttggaaacaaacaaacaaaaaagacccataaactagttactgtggttctgaaaatcctagatacttgtatgtgacatgaaactagtattggaaaagagcagagacaaattctcattgtttgctgttaatcatgtgtcgggaaaacctaaaagaatccacggtacaacttgtagagttaggagaggagtctggtgatgtggccaaatatcagaccattgtttaaaaaatcagtagcttctgtgtgaaccaaaaacaacagccttggtagtggggaaaacagggagagaaaatttccattatggtagtaaccaaaaatgtagaatacctggaatagtcctgacaagacaatggacccattggaaggaaattgtacctgattaatgataggaagaaagtgatcacaaatgaagacacaaatgctgtcctcatgggaagctgggtataatcgagaggttggcctttcccagattcatagttggaaatgttatgaagtgattctaagcaccatctaggaacacgaacggtcaagaatggctgagacagctgcggaacccaagcaaggaagagacatcctccaaaggaacatgaacggtcaagcatggctgagacagctgcggaacccaagcaaggaagagacttcctccaaagcaacatggacggtcaagaatggctgagacagctgcggaacccaagcaaggaagagacttcctccaaaggaacatgaacagtcaagaatggctgagacagctgcggaacccaagcaaggaagagacttcctccaaaggaacatgaacggtcaagaatggctgagacagctgcggaacccaagcaaggaagagacttcctccaaaggaacatgaacggtcaagaatggctgagacagctgcggagcccaagcaaggaagagacttcctccaaaggaacatgaatggtcaagaatggctgagacagctgcggaacccaagcaaggaagagacttcctccaaaggaacatgaacggtcaagaatggccgagacagctgtgggacccaagcaagtaagagacttcctccaaacatcttgtaaagtgaagataattaaaatagtgccatatgtgcataaactttcatagacagttcagttgaataaaatagttgaaaatacccctcttacaaataacctaccgtgataaacacagaatgcttattgtgttataaataaatatataacataaatttaataaataggaaattaaattatcatatgacaaatataagccaatacaacattcaactatttaaatcacacaaatcaagaagaaaatattggttgtcaagagctttctaagcataaatccaattgaaggaattgtaaaggggaatatggatatatttggataagtataataccaaacttctgtcaaaaaacacaatgaaaaggcaaatgacaagcaggaaaaacatttgcaatgtgataaatatatcttaatatataaaacctcctctaaatcataaggaaacaaaattgtcaatggaaggaaacaaagaaaaaaatccaagtggctaagagaaagcccatatggaaaaatatctaactctactgttaaagaaataaataatacaccatttataaagcatcaaccctgttaagatgaagagggatttatggctgggtgaatgaagcaggcacactttgagtatgagtacagatattctaaggaaatgtagcaatatttatcactgcccttaaaaatgttctttttttctttctttttttttttttttttgagatggagtcttgctctgttgcccaggctggagtgcagtggcgcgacctcagctcactgcaacctctgccacctgggttcaagtgattctcctgcctcagcctcccaagtagctgggattacaggcacctgccaccacacccagctaattttttgtatttttagtagagatggggtttcaccaggttggccaggctggtcttgaactcctgacctcaggtgatccgcctcggcctcccaaagtgctggggttatggggcgcgagccaccgcatttggcctttaaaatgttcttgatgtttgcccccagacattcatttctgtgaccccagacattcatttctacaactctgttccaaagcagtgatcccagctgtgggccaagttttaggaacaagacaagggtcatggcattatctctcatgtgaacaacagcaaacaacctatattgtccaataatagtggtctagttaagtaatgataaacctatgtggtagagtattaggctgccacaaaattgcattttcgaaacatgtttaatggcattgggaaatggttacagtctaaagctgtttgttgtttgaaaagcaggatctcagttttccgtatgatctcaatttggtgtacaaatatatttaccaaaaagactggaaggaacacatcaaatgtgaacaggatttctctgtgggcagtaggctaattaattttcattttcttctttgtactttactgaattttttaaattcaatatgatgagcatggtttttattattattattattattattattattattattaagagatggggtctagctctgttgcccagactagagtggagtggtgtgatcataactcactgcagcctccatctcttgggctcaagggatcctctcatctcggcctcccaagtagcttggactacaggcacgcaccaccacactcgactaatttttttttctttttttttttgtagagacagggtctcactctgttgcccaggctggtcttgaactcccaggctcaaatgattctcctgcctctgcctcccatagcactgggattacaggtgtgagcagctgagcctggaccagcatgtttcttttataaacaaaacactgcattttaaatttgtgaaatttaaattttttaaatgattttttaaaaaatcatttaaaaatggtaggatccaaatgatgccgtttgactgaattcagcactctggagaaaggtctccggtggcatgccacagggctctgtcacgctcagtcctttatttctgatttcaatgaagacatcaaagagaattcatgctttcccttggcacgtcatctctgcagtgggctggggaggagtaatgaggtttctgtgttccaccctatgggcgctagctcacgcttcctgtggctggggcagggggtccacctgcagcgggtccacctgaaggaaatgggaaatcttggagtgaggacgcaggctgccataggtacgtggtctcccctgcatgagaagcccacgcccctgggttagcaggcaccaccctcctggccagggcctccttggcccctgcccctcatgcgccttgcctgcagaagttctgctttgctgggacccccacccctcatgcacctgcagaagctctgcttcactggggccatgctggggccccacttccacttttggcagagttgggaatggggcagtgggcaggggaccggttgtcaggtgcagcctgctcttcccagggacaacatggggacatgtgcaggccctgggggtgctgagatccatagccagcaaaccagggcagctcatgcctgtggtgggcaccgggcaacttctgcgacccaggtacaaagagaacagagaggacataggtgaactgaggctggccttgcttccgcctcctgctgggaaggggcttgagaactgatggtggtgagggattggaagacagaaccggaagctggacgcacgcttccagagctaactccagatggaaccagcttacccccggccccgagggctcagtggacccgcagctgaggaggcaggggagaggcagtgctgggttgtgaggggtgtgggacccaggacaccccagtgcctgttcccaggcccctcagcctagcttggaggacaacacacagccggtccctctgtcagaccccgggaattcagggatgattggcctcctggaatgttctggaacattccagcattctgggcctttttttctgctcctaactcatgcctgcccagagtggggctcagcaaagctcaccccatactctgcccacctttttctgcctggccctaccccgccttcctcctagaagcctcccagatcaagcacaggaggcagtgatgggggtaggggacgccagtgcccatggggtccgctccatcccggggatctcctgagttgatcagctgagtgtagactgccagaagagccgggcctgcccgctgctgtgcccttctctggggggttctgggctgtgagaggggaagtgagccgaggctatgagtcctcgttgctttaggttggacctactgcaaaagtgcaggaaatagtagagcagaggaggtggcactgctaggggctgggctgaaggcttggggtagagggcacagcggctaggaaaatgggttctggtcatgggccctggctgacttagcgaatgtgctgtgggccacagggcttgggagcagcgtctgtgggaccggaggagccatctgccatccccaggtggccaggggagaggccatcctgggagcagcagtacacagtgcacctcaatgccaaagacctggctgttttctttttcctatttcaaacccatcacagaccaatacttccgtaccatacgttataaatgaattactgggaaaagcaaatgtgacaaaaaccgaggtatccaaaaactctaggtctggatttttattattaaattctgtggacataaactcaacccgtccaattgctataaaagtttctagtttctgtacttatctcactgtggactggaacagtttgtgtccaccaggcacagacttcactttgcatagcactgggggaggccctgttttcaggtctctgaggtgtctgatgaacgtgggaggagatgtatccttgtgcccccaaagcatccggccagcccagagcctctggcttcccgagcagctgctgtttaatcccagggaggtgcatgaacgaggaggggagaggagccctgtgtccaggcagtagcagcagacaagacagcgacagagtggtgagcaccggcaaggaatacagcagggtggcaggcaataggggaccatggatggagcagccaggatggggacttcccagccaagatctgggggcaaaaggcctagctcctgtgtccaagggaacagaccccttttgctcacagagaagcacagccagggattctcgatggggctctggggacaaagtttggcacatggtggggatgaattctgatgagctgctcttcaaggaaccacaggcttcccgtcaaggaatgaggcccccgtctctagaagaattttagcatggcaaaaccaaggcgatggcagtcaggagggggctgagctgtcccccccacggtggggacagactctgggggatgtgagaccatgacccagacttgggcagaaagtggcccagatactcggttcctgttattcatcccaaattgtgacagaaatagaccagctccccacctgccgctcccccattgcctgtcccccaggcctcaccaggctccagtggggataaaattggtagcacttgtttgagtgacatgtttgtcttctagcttatgagaagcctctgagttatctcaagtttttcctaaaacaacatttttctccatttcttaaaaaaaagcagaagaaaagagatgatcttattttatacaatataccaccagccagggagcagagcatcggcaacacttgaggttgcatagcaactggcttttcaattgattttttgagaaggtaccaaagctactcaactgttctcattttaaatatttcctaggatgatgaaaatcaaagcaaatggaaatcagagacttggggagcatcagagaaggacataaagtgtcttgttataaaaaaccaggtcaagacaaagtgtggaatgcttgctggaatttttcagcattggaggtgaaaggtctgagaaattctgcatgtgagtctcttagtggaaagcacgagaagagaggtgctgggggtgggggcttggtgtgcccacccacccacctatagggtagaggatttagagtggcccagccatggtgcaggaaggccaggaagtgaaggtctggggaggatatatcaagggccctggggatctgggacaggggatgaggtgggaaacacaccccatgcctcaccccagggacagccccctgtcctcctgagcatctgggtcccaacccccaacctgataggggtgcaaggcatgatggcccacccacatcatcctccatccacctcctcacccagacctacctgggtccagagaactaggaggcactaaggctggacactgcccttgggaggtgccttagtctgtttgggctgcaataacagaaataccttagactgagtaatttataaccaatggaattgtgttactcactgttctgggggctgggaagtccaagagcaggacgccagcagaactgatgtgtcgtaaggacccattcctcctagagggcaccttctagctgtgccctcgcatgatggaagggtgaacaggctccctcaggcttcttttgtaagggtgctaatctcatttatggagactccaccctcatgacctaatgacctctcaaagaccacacttcctaataccataacattggttctcagctttcaacctttcaaatgtgggggacacaacattcagattctagcaggaggcccctcttctgcctccccacaggcctgcactggctcatgcctgggaaggctcaagttgagaatcctgttctggcagcttggctctctctgggaatagcttcccaggctttggggaagatggctggaaacaaaatgctggaacgatatgggagttctggcagagaaatgaggtgcacgcctcctgccccagctctcgtggttctctgtcgtgatgagatttgatctgtaagccctgcctggaacaagagacctccagccttgggggagcccactttgcactcagctggggggcacggtagaacatgtgctcacagagcagggatggtgggaccttgtccctgccattcattctggctttgtccatactcgtgggacctttggtgagcaatttaacatcatggggccttagtttcccccataagaggaggtctgtgaaaccccagcacacaacaggaatgacgacaatcataaaggcgttcgtgcaagtgactgtttgtagagcttcttctgggacaggcaccgtctgaagccctttatgtgactttatgccctcacccccatagcaaccctgtggagtagacgctgtgatcatccccatttgacagtgaggaccctggctccagggggcgagcggcctgcccggggccacacgctggtggagccactctgctctgggaggaggggctggactctgtgatcccggctggtcaggagcaccagcttcaggctccttgtcctggtcccctgagggtcagttgctcccaaccaagagtgactttgccacccctccccccacccgggggacatttggcagtgtctggagagacttttggttgtcacgactagggggagggttccactgggttctggcaaggagtgcccaggggtgtgctcaacatcctgccatgaacagggtgcccgcctcacccaacaggaattatctggccccaaatatctggagtgctgaggttgagaaatgtggtctgctcaccagaacccaacctccctgctgtcctatcctgcacctgtttaggaggctggtctgaggcaggagggcccctctgggatggggacggttgagaagctttgctgaagccgcatccccttgggggcatgagccagccccagcgggtaggccagtccccagggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggcccagaggctgtcttggggccgctggggccccgggagcccgggtgcggccgcggagtctgggcgccgggtgcgtccccggcccgggccgctgttctcgcggcagcagcgccacctggtggccgctcgggcccggcccttcctctgcccgccccgcgcggggggcagcaccccgacctctttccggctgtgggactcaggcgagtcctttcagttgtctgagacgcagttcgtcatccggaaggtaggaaaatgaagtggaagcgaggtgtcgtgtgccaagcctgagcctagcggggcgctccttgcggacggtgacttcctgctggggtcagcatctgccggggcggccctttgggctcacttccccaggcctcccgagaacgtccccgcagccggcgcctccctccctgcccagcctggctcctgagggtgctcgtgttcattccttcatcactgagcgcccagcagccggggtcctctggccgcgttcgctgcctcatcctggcatggagagcagaagccgggattgctccgtgaagggaggagtggggctactgagggcaggcgtgggccagggctggggcacagactcgggcccagcaaccacccggccctcaaggagcttaggctttagtgactcagaggccagcgacagcaacaggcacatccccagtaggtgccccatctggcaggtgaccgatcgcacgcaggaggagggacccggcgggcagctcagagccagggtcccgcggccaggatggggctgggacttggagctggacgcagcctactcgtccacccaaggcccacgggccccctaagctcctggctgttccctgaggcccgtggggttacccagacccctgcaggctgggcctgaggttcaggggcccgcagtgtttcctcacccttgccctggccaagcctcctgacagccctggggagcattcagcaaagtgaccttctgacccaaggtgagggccatcaagctcttgcctccctaaggccctcagatctgccctctccacctcatggtgggatccctgggtctttcaggcatgtcctcagaccctttccagcccgggccaggggagccaaacaggctgaacccggaggaaacaccatccttcttgggaccaggctcccggtgctgctgtgggagggccccaggggcctggacgagtgtctgcctcctgcatctgggcagctctgtgaaccagcatagcaaggagggtctccatgtggacataggtgggcactcatgatggccaaggaggaccctgcactctggaagagccagcctggtccagggccccagagcactcgggcagtggagcccagttgggagcccatgtctgcagtggtcgatgtcacctccaaacaggggtggcagagccctccatgaggggtgacgactgtcctggggcccctgtagaggatccgatcagcctcttggaagctcatctgttcccgtgctctgagctagggtcagcccactcaggactcctcctgcatcctgggctggatgggcccctggacttcatccacagccctactgcaggcttctcccgcctggctcttctggggccctaggctggacctgggagttctgggagctgctgccgctgtgaagagtctgccctcagaggccctgcctcactcaggaggtggaccctgcagctaccatgcagccccagggcctcgaaatgtccatccccggtcatacagcaccatctaccgccccctgctctggaggctgggtgcccgcggctgcccctgggagggactggctgccctgtaaagtccctggctggtcctgcagccaccccctttgcagagcccagggtgctacggctcactcctggtccccccctcagcacagctaggaacaggtggagtcacacagacagactttcctagaggagccgtgcagagccgagcaggcagctggaagtcaggtgcattcaggactgggagggacgtagatgaccagggcgagctggtgaaagactcctcagtggaaacaagcagtgcagcctccctcacttctggaggagatccatatatgagaaatgtgtcttcttctcgctcaggggaagcacagttcccaggcttgatacatagcaagggcacaggatggtgggggctggggtgccccaggcagcagggacccatctggcctcctgcatgcaggccaggtggcagaggagcaaaggaggtcgcatcccagcaggtggtcccgctggagcccaagtgacccacaggggagttcactgcatgtcaggacagtatccttggctggaggtctcagcggagagacctgagcttggctcttcccttgggttccgactgcctccagtagcgagggccttgccctgtccacggccagcccagacttccctcctgggccgcagacctgtccagctgccccgatgtctctgcctggacatcagtttctttctgtgaggagtccttagaggcatgcagaacccaaggctgcctgtagctctcatggagtgggaggagtgggtggaggaaagggggctctggggtgcatgagcctgagtttgcggatggttgttttgggtgctgccaccaggcaaacccacttcagccagttttcagtcctttcgaacctgtgctccatgggcctaacatgggtcccagctacggcttgggactgatcacccacaagggctgcacccccagaagtgggagagctcccaaagcaaaacagcccagctcttcccaacgagcaagctggccaggaaagacattgccgtgaccatgtttcctgcactgcggaccccacgctcttcctctggcacttgccgtccccttcccgcgccgcctcttctgccttgctaccaatccccaaagccagacactggtgccgtctctgcctcattgctcccgccctgcagccctgatgcctctcagctcctgccaccaggtcctgaccctcctgacgtggcaccagccacacctgcatgcatctcagtgccacactgtccccttctatccccactccttcctcactgacccaaagggctgttttaagaatgcacacagaccttgccctggcctctgggcacaaggtcaatgtctgggcctcatgggtaccccatagcccttgaatgctccagacccagcaaggacaagatctctgcccctgggctcctctgtgcccgtcagagataggctgggaccttggagatgttgggacgttggcagagagagagaggaagcacaagcagctctgtggcttgtcagttaagctcccagtggcaggttgagtcctggggtgcccggacactgaggtaaccctctcctctacttcttggggtaccccctgctgggacccaggctcccagggtctagcacactctcatgtctcctgaagtcctgcctcccagggctcccctggccccagtgcagcttcccctccctgtgcccatgcaccccagccctcccctctgccccctcctcagggagtctcctcagaaccccaaagccagaagggggtcatagacccctttagctctggaccctgcagcacaacctccttggggttggagaacgaaagtggcaggctgccttcttggactgggccgagaacaaagcgaggcaagaacaaaaacacaaatcaatatttcaataaattgtcttgccgcagcagcaagatcactttggctgctaagacgggctgggaacccaggctgaaccacagaagccagcatctgggaggagagaggtgatcggccagagtggatccagtctgcaggacgtggagaaggggctgcccactgcagggctcttattccagggttctggaataaagtggtgacggggaggatgcgttgttttgtctgcataactgatttcaatttgagccagtgtttactattaggtaggtgtctgtagaatccagatttcacgattgacctgagaaatctgatccagcagctctgggcctctgttcctgccagcactgggcggatgttgctcccttcagctgtgcctgggcacctgggtttgccacagtcctcgccactccttatcaccgacccccactctattctaatagggaaatattcctctgtaccctttctccttcaaaactgggaaaacacaagatggacttacttttcgtgcaaccagcctgcctcattgacttgtcacctgccttgctcctgtaggcgcttgggtttctagcatcctcccggtactccccacaagcccacacactaggatagcggacctccctgcacacccccagcctgcctcagcctggctcctcccgcagctctgtcctacacactagcctcattcctgcctctggtcctgatattggggcatgtctttctggctggactcttgactcctcctcaaagacttggccagggcccttctcccactgagaagcatataaactgcccccagaacatatcagctgcccccagatcagacgccatctttcatgggccagcgagtgtcctgactggggtccctgtggtcccccaaaggaggaagcacgtggctcagattctcttcgctgcaagtgacaagagcacaactcagaattggctttcacaaggagaggaacttcttcaggcataaatgacacccgtcagtggcaggcagccttcgtgatggccgccagtgacccagtctcttaatgtccatgccctgcggtaggcgggactgagattctatcaaaagcagactgtggcttctgtaggggaggtgccttctcttgttgtctcttgggtccctcgagcaggggcgaccgtgtggggtaaagctgacatgggtgacggccccaggaggggcccatacggtatggtgtgcaacagctcagctggggcccgccgtgaccacctgaatgagcctgggagctgacccgcctccggtacagccttcagatgagactgcagccccagtcttagctcgacagtggtctcatcctcctttaatccttggtggggggtctcctgtagtgcaggggggctccagccgctgcaggccccccacctcacaccttgcctactccttggcccgctttggttgtatgttcaccctgatccttcatggtggccaggaaggcgtggtgctgggattggccaggcctgcctgcccctgaagcctggggtctgactcagattaaaggaggggaagtttcacgaaagggaaacaagggcaggcagaagtcaccgcaacccaccagggcatcggaagggaccgtcccactacatggggcttaggaccctgagggcaggtgagttcatcttggacaggactcccttgacactgatgctgggagacgtgccctggaggaagcaaggcccctttccctggagcccagcaaggctaccgagctgtgctgggtgtcctggatggagacactcacactgcagcaggggccctgccaccaccctagcaaaagcgcttattagtgacctttgtgctgaccctctgatttggatttggactggcaatttttaaaaaatgtatgttaaaaagtcattcttgtttggtttttgattttgctcttactgttatttttaattggcatgtaataattgtacatatttctggggtagggtgtgatatttagacacgtgtatgcaatgtgtaatgattacatcagggtaattagcatatctgtcacctcaaacattatcatttctttgtgttgggaacattcaaagtccactcttctagctatttgaaaatgcacaatacattcttacggattccaggcgctttccggcactatagggcactaacgcttattcccccatcttgccgcacttttggatatgttaaccagccttggcaatccccagcccgctgccccccactctccaggaactactctctatttctgtgacatcaactgttttagcttccacgtatgagtgagagcgtgcagtatttgtctttctgagcctggcttatttcatttagcataaggtcccccaggctcatccatatctgggctgccaatcttaagttcagcgagtacaaccaaccacaaggcccacgctctagcaccgaatcacatccaccccgagtttcccttccttcttgtgccatcccaagctcaccccctagctggagacagtgagaagggacattctttcgcccgattcctccttcagaactgtgacctctcaaggctacccagaggcggatactacctggcagggactcgagatgagctgcaggggtcaggcttggatgtgatgcagatacccactcccttcctcctgtatcaattatagtaggtgaggttatgctacagaaacaaacacactttgcatcccagtggcttaaaacgaccaagatttcctgctcacgctgtatgttcaatgtgggttggcggaggattcgggtctcatcgtcactcaggtcctaggtgacagagcagccactgtctttatgttgccagatctcgtgccagaaaggagagctctctgaagggtctcaatgggaaattagatgctccaaccgaaaagagacatgccccacttttgctcacagctcattggccagagctagtcacatgctcttcctggtcatgatgggaacaggaagtgcacctccccttgccctcctccagcttcctctggtctgtccacttctatgccaatgtcccacaagtcttagtcacaggacatcacactctgatttatgacttatttcatcgggactcatggaaaccttgttagaatgagttatcttatctcccaggagcaggaaataaagtctttacaattaactctgtgcttgggacttgggaattggtctgccatcttgtcagtcattgactgggacccctgggaacgacttgtcttacctagccttgaattgtgctcccttcttctggaactaactggcttgctaacaataccctttgttgtttgttttgttttgttttgagacggagtctcactctgtcgcctaggctggagtgcagtggcgtgatctcagctcactgcaacctccacctcccgggttcaagcgattctccttcctcagcctcccaggttgctgggattacgccaccaagccagactaagttttgcatttttaatagagacagggtttcaccatgttggccaggctggtctcaaactcctgacctcaggtgatccacctgcctcagcctcccaaagtgctgggattacaggtgtgagccaccgcgcacggccaactttttgttatttatagacacaaagagaaatacgtggctctactttgtggatacatttatgcaagagaaaaaacacctgcatacgtagcttccaaggaatgcacatctctattttatggccagataaatccttaaaggggaaaagaacatgcccaggactcagaggggctctcggttctcttggagggaactacttcggtgtttggagtctatggtgagaacagaaaccaaaatgcctgctgtgaggattgtggaggaaaaaaggaagggtgccgctcacagaagccttgcttttgaaatgatattgtgtatgtcttatttaaggaggaagtttagggcagtgagttgaatctagattttggtttcagccttcttgggatccgatctcaattctcctacttcctagtttcatgacctgggcaagcttcttaacttctctgagtctcagtttcctgtccaagacaggcttcttagtcctgaagtctaaatgggagtgcctgctgatgtcatggtgcagagagagtgtgcaagacgagcggtcccgaggccaccctagctgtcaggtgtgcgtcatgatacaaaatggaatgggatggttcccgggggcttcccatgcatagttcctgtgggaatcatctgtgtatgcccttgttcttgatatggctgtttttctattaggttgatgccaaagtctttgccattacttttcatggcaatactgcgattacttttgcacccaccaaatatgtcagttgctgtttcttttcctccattgtgttggtttctgcaagtaccttcacacggggggaacgtataaggtgatctgcttcctctggccttgcacaccacactggaatttccgcctcccctgccacggaccctcccaaaactgtgagctctttggggtgaggtccacatgacatttgccttctgtggaggccttgcacggaacaggtgcctcatagaacaaacacagggacttctggaaatggggtagacggtgggactatgcgaggccttagatgacgtagagcttggcttctgcatctcacctgaaaactgcggtgactttgtgtggaaactcacgcaggtgagtgtgactggggaaacttttcttccctgtcaaagactggagcccagtgggagcaggtcctgagagtgaccgggcagggcctttgtaccacctggaacagattcccagtggatggggtctgtcaacactacagcctgctcggccccccactgggccaccaggcgccaacctctctcttccatttctctccatccccctgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggtgagcctcacccatgcagggccacagaggcgtgaagctggaaatgagcccctggccatgcaaggggccccgggagccttggcccagcccagggaagagtgtcagggcagggaaggccgtggccaccttagctgggtgagggtgtggggcagtgcactgatggacaaatacatcattagaagagaatccagtgtcctgaattggacctatgtgtatagggacgctaatgtgtcacaaaagtgacatttcagagaagaggaggaaaacagcctaacaaatggtgtggggccaatttggaaagaaaggaggcctgtcacctccactcactctatagacagagagcatctcacatggattttaggtctaaataagaaacgcaaaataatgaaagaagataacgtaggtggatggctccatgttcttggagtaagagatgttttctttaaaaagagacaaaaggccgggcgcggtggttcacacctgtaatcccagcactttgggagtcggaggcaggtagatcacgaggtcaggagatcgagaccatcttggctaacatggtgaaaccccgtctctaataaaaatacaaaaaaattagcagggcatggtggcgggcgcctgtagtcccagctacccgggaggctgaggcaggagaatggtgtgaacccgggaggcggagtttgcaatgagtcgagatcgcaccactttgctccagcctgggagacagtgcgagactctgtctcaaaaaaaaaagagacaaaaaaaaccaaacaaaccatgaactcaatggaaaaaactgataaatagtagcacatttcaaaagtttgtgcattaaaggcacgctaatccactgggggaaatatttataaaaaaggatttatatctgaagtatgtgaagaacgcctacaaatcataataaggataataaagacaatccagtcagataatgggcaggagactcttatcaggctcttgacaaaatatgaatgagcaataaacatatgaaaaggcactcaacctcactagacattggaaaaatgcaattaaaacaatgaggctgggcatggtggtggatgcctgtagtcccagccactcgggaacctgaggtgggaggattgtttgagcccaggaagtgagctatgatcacaccactgcactccagcctgggtgacagagcgaggccttgtcttacaaaaaaaaaaaaaaaggaaaatttaaaaacacaatgaaatatcaagacgcacctaatagcatagctaggttaaaaagactgaaactaccatgtctgggtgaggagtggatagctcccctcaaacacagcgcagccaggtgttgccctgaccatgtgatgagagtgctgttggctgttttgtcttggggagggcactaatggggagcagagctatcccctaggaggggaaaccgacacagcttttatattaagtgacctgatccctcatttaaaaatgtgaaattggctgggtgtggtggctcactcctgtaatcccagcactttgggaggccaaggcgggcggatcacttgaggtcaggagttcgtgaccagcctggccaacatctctactaaaaacacaaaaattagccagtgtagtggcaggtgcctgtaatcccagctactcaggaggctgaggcaggaaaatcactagaaccccggaggcagaggttgcagtgagccgagattgtgccactgcactccagcctgggcaacagagcaagactctgtctcaaaaaaaaaaaaaaaaaaaagaaaaaatgaaaggacagccaagggttaccagatattttaaaaaaaccaaaacacaagaaatccttacagcatgaaaaagatggaccaagatgtaaaacaaaacaaaaagtttgaaaactggctctaagagaaaatagagataatttagagacaagaaaagcatgtttttaaaagtagtattcccagaatgtttgagaaaatacatccataaaccctaagagttttctatgaaaaattagagaacaacaaaccatttgtataaaattatggataggatgggggaagtaaaaaattcgaaaggtagacggggcgcggtggctcacgcctgtaatcccagcactgtgggaggccgaggcgggcaggtcacgaggtcaggagatggagaccatcctggctaacatggtgaaatcccgtctctagtaaaaatacaaaaattagctgagcatggtggcgggtgcctgtagtcccagctactcaggaggctgaggcagtagaatggactgaacccaggaggcggaggttgcagtgagccgagatcacaccactgcactccagcctggacggcagagtgagactccatctcaaaaaaaaaaaaaaaaaatcgaaagctgaaataaaaagtcaaggccatctcccaatgggagcaaaagacaaaaagattaacatgagagaaaagttaggagacagaccctccatcgaggaggcacactctatctaataagattccggagagagaaaacagccacaaagtaaaataagagggaagaaaacaaagaaaaacataaagatgcgctttcagatctcgcaggctcctgtaatgctgagtaggatgaatggaaagcctcccacggaggcagatgcatctgcaagcctggcatacaaagggcaaagaggagatggcaacgttccactcaggcacacagactccacgctcgtctcaaaatctgcagagcaaaaaatgcagattttcctgtttattacaacgggaaaagacaagggttagatcacgatgcttctatttttaggcgcgtacaccgccagctcacccggggtcccagtggccctccttcccttctctgtggaacgcgtggcctcagggtctctcagtggggcatggcaggagtgagggcaggttggggttctgaaagtcagggctccatgcttggcaggcctctaggaagactcccaggggtacaagcagagacctcgtgtggcacccatagccctgtaggcacttccctatctttccaagccgcctccctctgctgagacaggagctggggaagtgaataggtctcattatccatcttcctcagtttgacgtggggtctctgcgtcatgaacttctgccaccctccccctggccctgggctgtcgtaggccactggcctcatcttctacggcggctctgacctcccagtccgcaccagccagccccctgctgggatattctgcagggtagtgtggcccatcggctgaacagctttgcagccttctgcggcattatggaaacaggtctagctagggtctcaaggaccccagagaaacacggggagacccaagaaacgccccccagaggaggtgggcttggagggtgtgataccaggcagacgaggggcaggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggctgtggatggtcagccgcgctgaaggctgctcgcggcaccgtgtgtcccccacagctcctatgactgcctgctggatgaccccttcgcccacgactggccggcgctgccccagctcccgggactgcactactccatgaacgagcaatgccgctttgacttcggcctgggctacatgatgtgcacggcggtgagtgtgcagccctgcagccgggaccctcccaggtctggggggaggcgtgctggtgtaggggcagctcccgggacagtgtgaggaccggcccagtgtggggagggcagagcggccctccagagtggcagcctgtccctctgcacccaccactccccaccccctaggcaccctgagcccacctggcaggcccagacgtggtcctaggcaggaagcacacgggggacaggactgtgaccagggtgtcagccaggggcagtgagagcctgcagaggtcaggagggctcccaaggaagaagggaggcctgcaggctaagcggaaggagagggcattcaggaagggagggccacggacgcagaggccacggacgcagaggcctggaggagagcgcggcaggcacaggagcactcgctgctctccagggccaagtgccagggctgagccgtcagaggaaccggccatcggcatggaggccacactgtgggagcttcagtgtctatgagcgtcttaatgctcgcctctgctgcatgaaggaaagaagcaaagtagtcccattttacagatgaggaaacagagacccggagaggctaggtaacctgcctgagcccacaaagcgagcaagtggtagagtcgagtaccaacgcaggagggccacctccttccaagactccctaaggagcacagtggactcgattctcatggcgatgggggctctggaaaggcttgagtaggggaggctcagggccacgtctgagtttcagctgatccctcagggacgtcctgcaggaagtgctatcaggacaggaagcagaaaggccagggaacaggactgtgaagtccaggggaggccgaggctgcagagagggcaggcctgtgggggtgggggtagggcttcgccagggtttaggagggaaatccacggcaaagggtcagcaggtgcccacctagcctcaggctggcacttagggcccagctgcccgccaggctccctgaggtgtgcagcctccaaagactggaggcagagaggcccagccgcgtccagggatgctgcagcctccacaccgtatgggcaaggtcttcaccaccccagaatcacaacacccaccagcctcacgggcccatcatgggccagtcccactggggcatctcaggttccagaacccgggggtgggtggcatccctgggaggtccctgaggtgggagggacctggcaagctatggtgctgtcttccagttccggacctttgacccctgcaagcagctgtggtgcagccatcctgacaacccctacttttgcaagaccaagaaggggccccccttggacgggactatgtgtgcacctggcaaggtgaggcagcatcaagggctcttggagggcagcagggcagaggacaggaatcttaggtgcccgggtcaccagggacaggccctgaagtgggggtgggggccctctcaggggacctctgctgccctctcctttcccccttctaattacccctcacacgctgtacgccggagctgcctccaccctgtgcttctgatgctggagcacacctggcatctgagagttcctcatggtgcttcatgccccccactcaggaatccccctttaaggagcaatttctggggtcctggcagccttcggtcacccctgggcactgtgggtcacctcacctggaggccagcattggagtcctcgggcccagcatgaggcttaacctttccatccccaggacctcagtgtttgtcccttgttgggcacactgtccttcgaggtcccttgatggctgccccaggcccacttcccaccctctggtgactcttgaaagaaggacttcttccctgttgtcctcccagaactccagacctgattctcatttgttcagatgaaatcacacacccactcctcagccagttacttgctagggggctggcatatgcagatgagctaagcctggatccccacccaggaaggctcagccccactgagaccaccttggccctgcagtgggggcagggagtagggagtggacaccggtgcacatcccagccaggcctaggacgcccccaaactgtatggacctgtggctccttgatggaagtctttggctcgggactgggccagctgcctaattttagtctctggcggagcttctgaaagaaacaaattcccaggcccatccttgaagacttttgtttggggtaggatccaataattgtttttggtgttcttttttaaactatggtaaaaattctcacaaaattcactatctgaaccactttacacagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttcccgcaaggaccctgagtggtcatgcccagcttccatttccaggttaggcaccgtcttgcccagttgggacaggaggaccactgcgtggctccttccatcctcctggctcctggttcctgcggccaccagtgacttagagtctgccccggccgcagccttccacggtgccaggacagctcacactccatcttcctcagcttcggctgctctaacagaaataccgcagactgggtggcttacacaacagagccttgttcttcgcagtcctggaggctgggaagcccaaggtcagggtgccagcaaggttggcttctgggaggaccctcttcctggcttgccatcttcctgtggtctcctcacatggcagggagagagggcatctctctcaggtctcttctcatgaggacatcagtcccactcatgagggccatcacctaacgcttcccgaaggcccccacactgggggttagggcttcaccatatgaatttgaggggacacacgca

SEQ ID NO: 739 - DNA, 29266 bp, Human
  misc_feature (1)...(29266): n = A,T,C or G
gactgatgagagctgagcacccagacctccctctgccctggcaaatgacacacagctgctgtgaggtgactctgcgagagccagtctcagccctgtcagagggaaggagcttgagggtggcccatgtgctccaagggacttctctccagagctagcagcagggcccctgctggacacagaacagaatccaaggggcttttctgcaccttcagagaacgctttgttatgtggggccagacaaagcccactgaggagttaatgtccccccaggagccacgtggtccgagcctgtgactggtggactctgctttgctgaagtctggtgtaggtacagccgtgcatctttttttttttttttttcaaatcaaggaaggaacctcattttattctgaatgtgttagttttgaccgtcttcaccctgaaattttctctttgtttaattttatttatttattttttattagtatactttaagttctagggtacatgtgcacaacgtgcaggtttgttacatatgtacacatgtgccatgttggtgtgctgcacccattaactcgtcatttacattaggtgtatctcctaatgctatccctcccctctccccccaccccacgacaggccccggtgtgtgatgtgcatcttaatgactgggacacattctgaaaaacgagttcaggtgatttcgctgttgtgcaaacatcagagagtgtgcttacacaaagaaatctggatcgtatagcctgccgcacacctaggctgtacggtacagtctattgctcttaggctccatacctgtgcagcatggtactgtactgaatgctgtagccaattttaacacgacagcaagtattgatgtatctaaacatatctaaatacagacaagatacaataaaattcccatgtaaaagataaaaaaggagcctgtaatcccagcactttgggaggccaatgcaggaggatcacttgaggcaggagttcaagaccagcttgggcgatatagtcaaacccctccaccccaactatctcttcaaaaaaatttaaaaattagccagatgtgctggcacatacctccttgtggggctgaggtgggaggattgcttgagcccaggagtttgaggctgcagtgagccgcattcacaccacactccagcctgggcgacagagggagactcaatctcaaaaaaataaaaaagtaaaaaataaaaataaaaataaaaaaataaaaaatggtacacctctctatggtacataccatgagtggagcttccaggactagtaattggtctgggtgagtcagggagtgagtggtgagtggcctaggacgtcactgtatcctactgtagacttaataaacaccgtacacttagcttcactaaatttacttaaaaatatttttctttcgtcaataagaaattagtttactattagggtagtgcaaaagtaattgctgttgttgccgtctaaaaaaaaaaaaagccaccggctacggtggctcatgcctgcaatcccagcactttgggaggctgacgcggcggatcgcctgaggtcaggagtttgagaccaacctggccaacaaggtgaaaccccatctctactaaaaatacaaaaaaaaattggccgggcgtggtgtcacgcgcctgtaatcccagctacttgggaggctgagccaggagaatgacttgaacctgggaggcggaggttgcagtgagctgagatcacaccgctgcactccagaacaaaactctgtctcaaaggaaaaaataataaataaataaataaataaaacacaattacttttgcaccaacctaatataacattttttataaagttggtctacactaccatcaccccaaacacacgagtaatggcttgtgctgtgacgtcacaatggctgcaatgttactagggcagaggaatttttagctccattaaaaccttaggggaccacattcatatgtgcagtccattgttgaccaaacagtcattttgcagcacatgactctatttatccatctgaccgctggctgcggtcagccctagggatcactaacccatcccaataggccccaggaaagagaaaaccacattcccgctcactgtattagagatggggttcccagcaggaaacagagcgaaccctgggaggccaattgaagagattttatgaagggactgcttcagagaggtgggctcctttaaggaaaccaaccactgcctgcacagaggtgggctcggatgttgaggtacccagagaccagcaacggcacttctgcctggaattcccttccctctcctgtcagtcctgtggctggcactcagatgtgggctgaaacgtccgctctcccagaggccttcctggcctcacaggctcagccagctgccccctcactctctgcagcacctcccattgtaattccctgaacatctctgatcgccagctgatacgtttcctcattgacttatttattttcctgttgttcccattactgcagactccccaagggagtgtgtcttacttactgcggcacccccattgcctagcatggagcccatcatgcagtaggcacccagcacctatctatcagctcagagcctgggcgctcaccctgttctgcccagagccctgagaactctccctctccctgtttctcgttttcacttctgtccattttactttgtcatctttgagtcacttctcacttgaggcaggaagaaagaatcaagacttgcactttctttctggacaaagaaggaaatgagccacagggtctgggtccagtgaggctggggcaggggtcatgcctgccgcctcccctgagtcagggaccagcttcctggccaggactcccaacctgcctcctttcttctccaagcctttcctcaccgccttcctcctgcctagagcatcccttcaagggcctcaagtctcttccaggttgaccccctcatttatggctgaggaaactgaggcccagaggggtcagggcctctcccaggcatatggcacttgcattctggggcctatccccaccctgggagtccacttcctccagggccagaggcaggaaccagaaggcaggggccgtcgatactaaaatcagtgggcccagaggtcagctggcccagcacagacaccctcagccctccctgaggtcagcctggcgccagcaaatcaggggaaatgttactagagtttacaaacctcttgtgatgtacagagtccagcctctccctctggccagacaggggacagtcaagggaggaggccatcccatccagcaccttgtagatccttgtctgtctccatatgtgagtcctggttccctctcccacccacctgttcttcctctacatcatcccaggagttgcaggtcagtaacacagggaccccagagggtggagagatagagtcagggctgagagaacatgctaatggccaaggtcacagcctgcactcctcgtggggctgtagagaaaacccctgttcctggaattcagaatgaagccaggccttgatctctgggtgatccacatccctaccccacagacctgccttcaagagtgtgcaacctgtgcaactgtacagggcttgcacttcaaagggcatcatccttggtttaatgttctgtcgccttcttaaaattcttttgcactgggccacacaaattatgaagccattcctatgaacccagaccctcaactcaccaccccacccacccctgctcttctgacagcaaagctgaccactcactgtaagatctggagtgaagggctggccctcagggttaagacagttggattttcctaagagccttctgaagacagaatcaaggcaaaattgtcaaaggggctttcaggcaggaggatgtttgccgagagaaggctttaaatcttaccccatagcagctgctgggacaagggaagtcaggaggaaaggatttgaacttccgggccagacaaccttggttcaaatcctggctgtgctccttacagtttgggtgatttcaggaatgttctgaaacctctctgttcctcttctgcaaaatgagggttataattacaccaacctggaagatgatggggaagattaaatagataagatatataaagtgcttgaaacagtgccaggcaaaaaataaatgcttgataaagattagctatcagacacttgggttcctgtctgagtcccaccacttactccaatgtgaacttaacatctgtgtgcctcagtttcctcatttgaacaatgaggataacctgagcacccaatgcctggggacttaggagctgccattggcatcagcctcacaccctcttcctggagaccttccccacaggccctcctctgggctcccatatcccctgcacttgcttccgtcctagcacatgtgactcgcaagtagaaatggtttccacgtctattttcaccctccccagttcggagttcatcaaggcatgaagggggtctggttctgctggtgtcagcagacagtgaaggatgaaggagtgaacagataaagggagttaggttccctatggaagctgctcacacccttaggcagtggccaccatatatgggcgatcggtcagagtggtggaagaaattttagggaaaggacgcaaaccttcttgaaaggtcagaaggttttgcatagcttcggggaagaataagcagaaggcagctgttctaccctgaggcagagggtgaggagtaggtacaaggaagtgtagggaaatttatcttaaatgcgcttgtttactcatgttgtcctaaaaccgacctttcatccagtgcatgactgctccctgaaagggggaacaataatgttaattacccgcagattgtgtttgccccaggcttttggcattatatctagctgctcttatgtgaaatacctgtgtctaagtactcctttcatcgtcactggccagaatctgaatgtgtctcctctttccccagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaaggtaaggctcaagccccaggacaggagaagccatcagcagctggcccatagtgacaagtggtggtggtgatggcgatggtggcaaaggtggtaatagatattgtggtggttgtaggagtggagatgataagggtgaaggtggtagcaatagtggtagaggtcgtggtggtagaagtagtggtggtaatggtagcaatggtggtggtagtgatagtgatggtggtgaggatgggaaaggccaaggtggtggtgggagtggtgagaatggtggtggtggtagtgatgataaaggggtaggtggtggttgtgatggtggtgatggtggtggtggctgtgatggtggtgatcacggtgatggtggtgatgataaaggggtaggtgttggtggtgatcacggtgatggtggtgatgataaaggggtaggtggtggtggtgatcatggtgatggtggtgatgataaaggggtaggtggtggtggtgatcatggtgatggtggtgatgataaaggggtaggtggtggtggtgatcacggtgatgcgtggtgatgataaaggggtaggtggtggttgtgataatggtgatgacagtgatgataaaggggtaggtggtgattgtgatggtgggtgatggtggtgatgataaaggggtaggcggtggtactgacgatggtgatgatggtggtgctgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccaggagtttgacaacagcctggacaacatagtgagacctcatctctacaaaaaaatacaaaaattagccgagcttggtggtgcacacttgtagtcccagctactccggagtacctgtctcaaaaaaaaaaaaaaaaaaaaaagaggctgggcgtggtggctcacacctgtaatcacagcactttgggaggccaaggcaggcagatcacttgaggtcaggagtttgagaccagcctggccaacatggtgaaaccctgtctctactaaaaatagaaaaattagccaggcacggtggcacatgcctataatcccagctactcaggaggctgaggcagaataatcgcttgaacccaggaggcggaagttgcagtgagccaagatcgtgccactgcactccagcctgggcaacagagctaaactcaaaaaacaaacaaacaaacaaaaaagcaatgttgcacttcctcagcatgccagcctctgaggctgcaaacctagatcctgagagccacaatgggatctgtaccctctgtactcctagtgggggcctggcacctcccaggcaccaagttatattttttaattgaatagaattctattttggggacatactaaccttctatgagagtatcattgtatatgcatagaatactattctataggaactataccgttcctaatattttctgtttctatgattctttaaatggagatcctctaacctgtggctctattattgataattattagctagcatttatagaaccctgtttggtgtaagatgctttacatatattattttccaaatcttactccttgggacatgaacagtacatgttacacagaaaaatggttctgtggtctaagaagtatggaaaatcctgagttacacaaagctcactggagttcttttctgcagagctgtacattgtaaatctccaagaagagaatattttatgcaccattttctgtactgggcccaggggtgtgctgatatatgtttgacaactggctgtccaggggaaaagttctgatgcgtagcacttgccaatttccatggtgtaaatattctcaccatgtctcatttcaagctatcaatgtgatgtcatcgaaggccaagacaagacaggagaagatcctcatgagcacatcattatgtagcatttccatcatacagataccataaacacagataacctcaaaacacagtcaaaggtagcaaaacaattcggaagcgatgaattctgagaattcgttgtttttcatgatttatttaattgtaagttcatataatttaatttgtaatagtggctgtatttaacaatcagctcacaaatattcctgaaaatttaagctggttcttgaaagccaagctgatacaatccagcgccagcacaccactggctaggaccccatctttgcgtggaacagcagaagagttcagtgtttcccagaactcatcttcaaaagtgctgttctactcctcagagcaaagcaacatcagaagcaatatttccattttacaaatgaggcaactaaaacttagagaggttaagtgacttctacggggcaaaaatatcctttgccttccaatggcaccaggtatattttttccactcaaaaaatgttttctaagcacctactctgttcaggcaccattctaggcatgctggggctctgccaggcaactcacaccatgagaacaactcattggtgactagtcagaggttcttttttttttttggctttttaaaaattttattttcaggggtacatgtccatgtttgttacatgtatattgcatattcgtggggattgggcttctagcatacccattacccaaatagtgaacattatggccaataggttatttgtctaccctcgccctcatcccaacctcccctcttttggagtctccagtgtctattatttccatttttatggccatatgtaccaattgtttagctcctacttataagtgagaatatgtggtattggatttgttgcttctgggttagttcacttaggttcatttaggattatggcctgcagctctatccatgttgctgcaaaggacatgattttattcttttttatggctgccagaggttcttgataaaaaatctcagtatcatatttagggaccctggccagcaccacacacaccacatacacacatgcacaggcacacctgtgtacacacactctcactcacacactcacacacagccactgccgcccattcccagctcacgtcacctcttcttttctagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtgggtacgttgcatgcccactctgtcctcctccctccctcatccccagcctgggggcacctctcacatcagccacttcactgcctggggtaggaatccagtgagttcagggtagtgattgtaatgcctgtgttgccactttacatgatttgaaagaaactctagttcctaacaagctctgatctggccacaggctgagctctgaccctagtcatagaccaagccctgatcctaatcatggactgagccctgactacagtcataaacttggccctgatcctgatcctggactgagccctgatcctgatcatgggttgaaccctgacactggtcacagaccaagccctgatcctgatcgtggactgagccctgaccctagtcataaacttagccctgatcctgatcatggactgagccctgcccctagtcatagactgagccctgattctgatcatggactgagtcctgaccctagtcatagactgtgccctgattttgatcatgaactcacccctggccatcagaggcatatctcactactctttggaacaaacttcactcacttcctctgactgtcaggactagcacaccaagagtgtagcctttacatgtgacgactgtcatggcctgccactaaggcaaaaggattcatctctaggggccatgcaggagtggtgtgggggacagagcactagccccaaggtatgtcaccagcctgggctctgggctcaggaggttactactccacctcttcagtacacctcagactccagagggtgccagaaaagagcttccctcttcagtccagagtctccagccagggccctgggaccagaccttcgggttgagtgtgagatcctggagttcaaggggatgcaagaaatgacaccactcctttgggggcacctttccaggagagggagaagcagctcattgctgtcctccatttctctccctgaccccaaccctccgccccctccctcatttccccaggaagcacacaaaccacctgatctctttgaccccttcaaggttgacctggctgggcccccactgccaccagcactttgcccccatgcaggctcctcagaaaacaaaacagccttttattcccaggacctgggggaggtggggacagagcacagcctgagccccatctgctctgttccaggaatggggtaaggggcctagcagtcacaagtcagcaaccccaggattctctctctgcagggacctcagtcatctctgtgacagcagtggatgcagacgaccccactgtgggagaccacgcctctgtcatgtaccaaatcctgaaggggaaagagtattttgccatcgataattctggtctgtgtgactaacactcctggacagtcactgatttggagggacaaggggaggtggatactccaggtgcatgtgctaagggaagtccagtctgacaggtgtcactagctactgaaccacactgtaccatggaagtagtcagtatcatatgtaaagacaaggcggctggtcaagggagaaggaagcaggcaggtgcccaagaggtggactcaagtccagggaacaaaatcaggatcttgttacccaagaagtggccaaggggcagcagaggatggtggctagccgctctgggtgcaggttcagacagatctggtttccaaagccagctctgccactcaccccctctagagaccttggacaaatcaactaacttctgcaagccttagttccctcatctaggaggtaggaatgcttatatttatatcgtatggtagctgtaaagtttgagttagatcatgtataaaggcagcaaggcccatagtaattgcttatgtgatgacttaacaaaaaatataaggactgactcttgggagcaagaaagaagtccagtggaactgtctttcagagagatggcaaatacatagcacagatgccactactatgctacagtgcaccaaggcagacatcactaatctatcacagcactctttccatctgagcctagatatggcctcatggtctttgtcaacacaatatttcaggtggcgaggaccaataccgaacccaactattgggccagctttggcctcacagtataggctatggaggtagtgggttgtagactcacagttctcagccccatttgcacagtggaatcaccagggaagctcttaagtcaggttctctctgggcaggccctaggcatcggtattttctagaagctggtaacatggttcctgctgggaatctttttgcaggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagagtgagcccctcctctagggccctgggaaggggggctgggataccccagactcagtgacttggggctctgggaaaagagttacaaatcactttacctctccctctatcccagggtaggcctgatgcccaaaggagtcctttgggtgaagggaggggccctgcttccatcccaataccacattcccaaggccatcctgccgccccctgccacaatcccctcataggccagagggaaatcccactccctgctgggtgccaccactgtactgtgtcccaccatgagacacaagcagtttcacccagatcccatgggcttgggaaaatcaaagccctgagactcaggtcccagctagaaattcccacaagccagtgaacatggggacagcaaagttctatatccagagccagggctgggccctgaccccacctacacactgatccaccccacagagaatgtctaatgagagcttttcccatgcctggggcagatggctctccacttgcaactcccagtgctgatactgtcattcagttgttcagccaccctagagacaggccaattgtcctgaagtggcttcctcgtacatggcataagctccctgaaggcaggacttgtctctcttgtccattgataggtcccctagcaaagtgcctggcatacaataggtgctcaatagctatttattggatggagggatggatggatggacatacagatagggaagaccctctttaccttgagaatcccaggggtattattatttatgattattttattatgcccatttcttttatcaaaatatgttagaatagctgaaagaggcaatcgccttgtctatctcattaacccaaagccctttggggtgctctgtttgcatcagccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaaggtttgtaggccaatggcaacaatgtcaaacgtgaggcttggggctcttggcacccacaggtcctgcttggggattgctcctgggccagagaccatcaaaggaccatcaaagctccaaggtggtcatgtgttcatggagactgtgatccagtgtcttaggccgagttacttgggaagcaaatcttaaggccatgactgggtgtaaattgtttatctgggaggtgatcccaggaagccccaggagcaatgacccactgcggggtaagtgtggaacacatcccagagttggagaagctgagggtgaaggagctggggtatttatacacccgctgtctgtggtgttgactgggggctgcccctggagttattacctctctggcactttctggcctgccatgtgtcctggccagtagaaatccatcagcatgaagaaaacagtgagtaattgtggtgacatggatggccactgacactggatgctgctgacagccagagaagccagattaactgaatctggaagaggagggagaggtcctgtgaggggcataaaaaatgcctctggaatggccatgcagaggattgcaagtcctgggcctgagtccttctctgaaccagccccatgctggggcttggaaacaccaaggagaggcagacacagcctccagtgtcagcaaaggtctcagtgaatggggaagacatatgcatgaacaaaaaaagtacagccaggtgtaagtgatacacagcagctctgaacagggagcaattacctctgctaggaggggtttctgagagagcatctgattaccttctgcttggcttcctgagggatgagtaggagttttctaggcaggcaagggcaggagaaggatcttgagcaaaggcataaagaaaaagcatgtccggccgggcccggtggttcacgcctctaatcccagcactttgtgaggccgaggcaggtggatcacctgaggtcaggagtttgagaccagcctggccaatatggtgaaaccccgtctctactaaaaataccaaaattagctgggcgtggtggcaggtgcctgtaatcccagctacttggaaggctgaggcaggagaatcgcttgaacctgggaggtggaagttgtagtgagcggaggtcgtgccattgcactccaatctgggtaccaagagcaatattctgtctcaagaacaaagaaaaagcctgtccttaaggacctgtgggtagaaccactagtgacgctcttaagagcaggaccatagttgatccattctatgtcccaaacgctggaaatagggccaggcacacagccagggttgtgggtgtggccatgaggctgctgagatgaaatggggagcagctgaagacagacaccaggcccagccgctgtcttgatgacctcagaaatatcacttgtcgaggccatgggcccctcatctataaaatgggtgtcatcctggtactaccttgcatagttgctgtgcagatcatgtgccacacacatgcttggcccagagcaggcactcaccatcctttttccttacgcagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattgggtaagggggcgtgtgtcgatgagaatgataaggacaatccggcctggatgttcctatgcctgctggtctgaggccaggactcagagaggggaactggcttctcctagcacttacagggaaagtgacagaggcaagaccagaagcccaagctcttgcacttggcagcctggcatcttgacctgcctggactcccccacctagcatggtcctgggcatccagagctacttgtcctctgtccggccttgaaggcttattctctgcaccacagctctcaccagtcctatgtggtaagatctgacagtcaagaaagcaaccaatcagacgacacaccagaggccccttcactaaaactgtattcttgaatctatcttccccaaaccacaaaagtaagaagtgttcattttatacagtgaaacaacacagagatctaccaagaaaacactgataacccccactctcagataactcatgttcgtggcctaacctggtcctattgctcctttcttttcgtgaccacacaaacatgtggatgcatttatggtgggtttgttgttgtctgtttgcttttgatgtttgattgttttaaaatttttttggatcatgccatgctggtttcatcgatatttgctcttctatcttaactaaatttctcttttacaatctttagaaaaaaatgatatagttccaacagatactttttagagccatataatatgcaatagtaagtataaattcaattcaatcttattttattgtagatgcatagctgattttgccagcaccatttactaaatattataataataagtcatcgttttcccaccttcattatatactaagttttctgtatatacctgtatctacttctaattctctgtcctatccatcattctatagcaaagctattctgttttattctactagcttgtataagtccattctcctataaagaaatagttaagactgggtaatttataaagaaaagaggtttaacaggaagtatagtggcttctccttctggggaggcctcagaaaacttacagtcctggggaagcaggcacgtcttacacggccagaacaggagtgggaagggagttgttacacacttttcaacaacctggtctcatgataactcactagcttgagaacagaacctaggggatggagctaacccattcatgagaactctgtcccatggtctatccacctcccaccagggcccacctccaacactggggattacatttcaacatgagattcggtggggacacagatccaaaccatatagctttacactagatcttagatatacataaaagtccttcccatgttgcttttttatttgatataattttttgtcaactctcattttttcttttgtgaaatttaaaattttgtatccaggttttttaaacattagaattctagtgtttatatattaattttggtatagctaatgtttcaagggtattaagtcttcttattaaggacaaaatatgttcttccattttggcctcatatcctaagttttgggactactcttcattgccattcttttctaaatagcctgtaattataatttttgtttctcctttgatccaagggtttatttaagagattgacttgatttctttattttcatttataagtcatagggtgttttttttgttttgctttagcttgttctgtgatgtgatacaattgtatttgtgtccacttcttcctagaatatctaagttttgactttatgtatttaaatttttctattcagttaacaaaggtttgcaactattttaccttcattatggtttgtaactttcatccaaatgtaattagccaatttgttctgcttaaatattttgcctttaattctgtttcctgatgttacatttgttagtcctgttttcatgttattcatatacgcctaatgcaaattttccaacctttacttttaatttttccaggtcatttggcattaagttgtctcttgaaaacaagaatgcatttggctttgctttttaatctaaactgaaatgctttgtgtttaacctatttacatttttcatcataattgatatgtttgatgttccttcttttatcttgttttacatttctcatttatcaaatttaatggcttttttctttttcctcatctttgctatacagtctatgtttctttatttttttttctcctagatatttggatgaggtgcatccatttttatttctaccagtgagatttacttctatctgcaaaatttaaaatgttttcttggacctatattttctagttaaaactattatagacatacacacacccattgcttttctatgtatgataaaaaaaatcaatagttttgttttaattcttcccatgccaggtttttactttatattgagatgtttagttagatacagtaagttttcaaaaaaaaattcaggacacaaatatcttagttctttgccttttttggggggtgggggggacaggttcttcctctgtcacccaggctagagtgcagtggcacaaccatagctcactacagccttgaacatctaggctgaagcaaccctcccacctcagcctctgagtatctgggactacaggcacacaccaccacaccaggctaatctttttttttttttttttttttttttttttggtgagacagggtctcactctgtcacctgggctgggctggtcttgaactcctggcctcaagcaaacctccagcttcagcctctcccaaagcactcaaattacagatgtgagccaccatgcccaaccttgccttctaataacacctagatgtattcgtataatcctcagattataaacacttcccttcaaaaatactatcaatgtattctagtatttaattttgtgggggcatctgaggcaaatctgatttttctttcctcataaggaaattatttctttctgtctggactcttttcagtttcttcacacagccttgaaattcgtaagtgtcatcaggatttgcctaagtattggggtttttttcaatgatgcctgatgtcaatgacatcttataatgtgtagactcaagcctttcttcagatcaggaaacttttcttttctttttttttttttttttttttttgttatttcttctgttctgtttgttctgggattttcctcattaatagcaactattattcctatatacacaaaacatatatatttatctttccatagatttttcctgatttctgaaagaactttttaagttttttatttcacaaagttaatttctttgtaattacttcttatctcttccagctctttttgtattccttcctggctcttgcccaatgatcttttcattaatcactaaaacaagtcccagctatggtgtgatgtcacctgttcagctctgaaagtgcatctgatggtctcaggtaccacctccagtccagtgatggcaatgtaactaagatcaaagacattatcttgctatcctgaatccctctgtgtaggtccgctcttgtctgagtggcagagtgcaatgagcagtgagagaggggcatggagtgggatgcaggggacagatgcagaagggccttgtccatcatgctgaggagtgtagactcagcaaagaacaatggaaagccatgaaactctctcccctgggcagatactccatccgcaggaccagtgacaagggccagttcttccgagtcacaaaaaagggggacatttacaatgagaaagaactggacagagaagtctacccctggtataacctgactgtggaggccaaagaactggattccactggtgagtggccacatctgccagggcacctggattcttttccttttccctcattcttccaaaactggcataatcaataatttggggtctctagacgtattagaagtgcctgctgaagcacccgctggttgggatgctatagagctcccatgcccaagtgtggtccttgaacccagcagtatcaacatcccctgagaccttgttgcatctcgggcctcacccccacactgaatcggaatctcatgcatgtcacagtttgaaaaccactgtcatgaaacaggctgtgcagatgtctctgtgacgagaatcacccaagtcacctattaagcataaagctctactccaccctgcaggttctggtccagtgagccagagatgtgcatttaacaagggtcccatgattcttagttatcatggctgtttgggaaatgttccttcagagggtgtttatgcaccagttaataggtagaattcaaaatgtgaagcagcttccaattttgagattgtgagtttctctagaaattgtgtaatttttgccagagggaggggcaagagttggagttttgcatcctctatctatattagaaaatcacaatcaccctccaggagaactattaatactcccactttacccaggagcccgctaggccaaggatccctggcgcctgccgggcccacccagactcacttctgccaacacagctgctgccccaaactgtaatggactcctgcatgtttggccagatcagtctttgcttctttctcctccacataatcccattcatagactctttacatttaaatggtttaaaatacggaaaatacagaaaatgagaagaaaatactcctcccaccaatgccaccatgcagagacagttactattagcacattcatgtatttttatttttatacatatttttatacttacatgagattgtaatgtttgtgtaagatattatattccacatttttacttaacctttacttaaccttattccagaaccactttctcatggtactaattttttttttaagagagaaacagggtctcactctgttgtccaggatgaagtgcagtggcacgatcacagctcactgcagcctctaattcctgagttcaaatgatcctcccacctcagcctcctgagcagctgggactacaggcgtgcaccacattgcccagcaaatgtcttaattttttttgtagagatggggtctcaccatgtttcccaggcttgtctccaactctgggccccaagcaatcctcccttctaggcctttcaaagtatgaaattacaggggtgagccacagcacccggccttaaaattttttttaattatatgtttaagatgtaagtgacataggcattgtcagtggccatccatttcagtcttttccggtagcctagtttactgacccaatctcacttaggttgtttaccttttcaattcttttatgattaatttattatgttttatgtatttaatcaaataattaaatttttaattttaggaatttaattacaatttttttaatgcacttaggtggtttacctttttgattctcataatcaaagtaatacctcagtaaaccttatggatgagatttaacacctccccccaccaaactccttttatccagaacaccatcctgggcctctgttccacagcctcctcctgcaaaaagtggcctccatagggcagccctccttccacacatcttccaccgcccaaggccagcatcagctgagcccataatggtgacagtcttctcccctgcaggaacccccacaggaaaagaatccattgtgcaagtccacattgaagttttggatgagaatgacaatgccccggagtttgccaagccctaccagcccaaagtgtgtgagaacgctgtccatggccaggtgagtctggttcaggtgggaggggaaggcagcaccaccctggggcaggctggggggcagaactgctcaacagagtcagcaggagttcccctgtacaatagccttgaggaaaataacattatgcccattttacagatggagaaactgaggctcagagggaatatatggggagtagattggcggggcagggaagtagaaagaatggctttatgaagaactaaataggtgagtgttgcaggtgggaaacagccatggtcaggacttaaacccaaaggctccatcgctaaacctcagaccaccccaccaccccaccaccatcactgaccatctcctgtcttccacactccagctggtcctgcagatctccgcaatagacaaggacataacaccacgaaacgtgaagttcaaattcaccttgaatactgagaacaactttaccctcacggataatcacggtaggcatcaaagtaatcagttcagctgggcgtgatgacccacacctgtagtctcagctactcaggaggctgaggcaggaagatcgcttgagcccaggagtttgaggctgcagtgagctatgatcacatcactgcactccagcccgggcgacagagcgagaccccgtctccaaaaaaagaacaaatgcagtcagttggctctaacagggtcggggtgaggttatttgagtcttgaggcaccaaggtcaaagaccaggccaacaaattgagggcaggctcccactgggattttcaaatcattagatattttgtacaatttctgccacatacattgtacaattggtctatgcaatggtcagagacactccatccaaactcccaagtccacgtcgcctgcaaggagccagcgaggagtacagaacagatgtgaggatgcaggcagtcagctcagttcaagaactagccaaggagtcccctcccatactggaggctctatgggtcagcaaaactgcacattaaacatggaactttgaggtcattcccaaagagtcaaaactggaaatgtgaaatcctaaatcccaaggatccagtgagctttgttttaattcagctacaacgattactcacgattagcagggtggcccgtgtgatggcattagcagccaatcagagcttctgaggagtaggtgctgacttaagtgatgatgctgagttgacttcattccagccacaagtaggcaagcttccatggcctctgaaatttcctcaaaaaaatagagaaaattccccttgggtttaaatagagtgatccttcacctagcatgggatggaattcctgcctgtccctaatgggcaaaactatggtggatgaggatggctgtattgcagcagcccattactacatttaaggaagactggggagtggggtccctgaaagttggaggcagacttgagggatcaaccacagaccagtccttaaggagactcctgtgggatggagaaggtggccctgatgtgttgacagtcaatgacagaccattcaacacccagttgtcattagaagtaaataatgtggcaaaaatgtcaccccctccccaatgtccacctcagtcccatctcagagtggggatctgcaatacagtagaaagattcagtgccaccccaaagacacccatatacaataggaggcaagtctgttggtgtcaaattcacttatatcatgaacatcctgcatgtcaaaatctctagtttctcccataagtgtcaatgacatatagtttattttgaaatataatagacttaatgctgaaatgtaattatgaataatgaaatataattggctttcattcaaaatcgaaaagatggattcctgggtttttcaatccagtgtgtggagcctgtgtagctaagtaaatcctggagtagggagttcctggatccttctctgatcgttgacattacaacctcctgggaccctgcaaaaggcagattatctggcctctgcccagaatcactgaataagaagtgtgtgtgagcataggggtctgaaaatcagcatgttttaaaagctccctgggggattcttgggtacaggaaaccactgattggatctgggaaggtgggcggggccaatatttggacaaaagcatttcccagttccaaactgcctgggaaacccgcaattctatatgtaatcattttctctgtgccccaagggacatgcccattgtttttactgttttcaacaatgtaacaatggattttcagagagagcagaagctgccttagaaattagcctaatgctaaaagactttttaaaactttatttttccccgctgcttgtcaaagcttgaaacggagcattaattaattgagctgaaagagaaaacctcctgttactggagtggggttagggaagaggaaggggagaggcatcagttgcccacaaatacagaaagcaaaggatttgaccttctttcaccaaggcatccttggagattgggtcaaagcagctgccccaaaatatcccctctgtggcggaacagacctgcactcagatggctgaaacaagaggcgctgggtgcaaagggcagaaaagcagcccagcgagcacgcaggctggtgcagtcagggagggcttcctggaggagccaggtttccccatctgtgcagatggcaaagcctgactccgaggccttggtgtttccagataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacaggtcagtgctgggcagggtggggagaagacacagtgggtggaaggggatggaaggtgttgggaggcggggaggcttcacaggaaaagtagaggccagaggttcaggcccaaccctgcctccaatctgcaatgcagcccttagccagttcatgtgcaggatgcaggatgtgagctccaaccacctgggtgctcacggtgggggatgagccagggaggaggagggggtgggactcaggactcctcccccacgcatcaggccagtatcactttaaaataacttatacataacagtcactccttccacttagatattttcagcatttactgagtgccaggcattgttctgggcatgtatttacataaaacctatttttgaaaaaggaaaaaggatccagttctaaaatggaaagtttaaaaacttctagtttagattgtctccacgtgctttctttctttttatagaattcctccggccttgatacatattttttttcttgtttgggcctcagaaattttaggagcattgtaggccttagtttggatttcccagggagcagccctgggatgaggattggggtggaagtggtttatttgggaggtggtttatttccctggatacctcctaaggcagagggggagtgaagctgggaagggaggaggccagcgaaggtggaatgttcccatcgtgaggaactggagcctcctcccatagggttgccgggaggcagcgtggggccaccccccagcatcatcccaccgggggagcacagtgatgtactgtatcctgcatttcactcgccatgagacgcagcaggggctgatcctccagaggaagccctcaggtgattagagatcaccctggcactcacggcaaggcctggatacagccacggggcacctgcaatacagattccaggcctctcctgcctgtagccctcctgagagtggcctcggtatgccccacttctgggacttctccagcagagatttctcctttattaataattaatgatgatgatggcatccccaccacaaatagaattgcatttgacctcacaaccatcctcccaaatataaacagagcagggaggtcatcatttccattttacagacaaggaaactgaggctggggggcagggctgccttccagggcatcccagctttacttatgtatatagtagtttgttcagtaactcaaagctagaaggcctgagcctaattttagaagctctctgcacttcaaggtctacccctccttagggatccaagaccctcacatagccacacccctcagagattcccacaggctgagcatccgcacctgcccctgggtgtgggggaacggcagcggtgggagtgtcgggcgaggtggggatgagtatgcgggggagcggcagggacggggtgtggggtgtagggggatggcggggatgggggtatgggggaacggcggggatggggttgcaggggaaggggggccaaaaggatggggttgcaggggaagggggggccaaagggatgggcatgctgggagggcgtgggggtggggttgcagggggcagtggggatgggggcatggggggccgcccaggcccccagccttgtctgactctgctgctcggctccctggctgcagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacatagggagaccctatctctaccaaaaaaaaattaattagccaggcatggtggcaggcacctgtggtcccagctacttgggaggctgagataggagaatcacttcagcctgggagatcaaggctgcagtgagctctgaacgcaccactacactccagcctgggtgacagagtgagatcctgtctcaaaaaaagagaaagaaaacctttgagattcttccatttttagagctgagagagcacttgtgaaacacacacacatgcacaaacatataaacatgcatacaggcatgcacatgcacacacaaatacacatacacacacacaagcacacacacaccaccaccaccatcatcagaggaacttacagaaaaggggacatttatagattcctaggaatatgccaaagcttttcaaagcctctatggacagctcattccttaacttttccttttaaaatcttttttagcttcttatttgccccagccactatcactgcctcaggcagctgcaacgttaaacaattgccactgattactttcaacaaataacctcagagaaaaggctgtgtgtattgaatgggtatcaagtcaggtcaaaagaacacagccttgcaagtggagtttcttccagggaactaccagacaagttgaataatgacagttatctgggaattggactttgcagaagctccaaccctgttctgatctgtttgtctctagactgctggttttcaccatgattatgaatccactgggtttcaaggctaccacaggtctcgggagaaggggatgggactagggcaagttaaaatgccatcaagctctgccaggtgtggtggctcatgcctgtaatcccaacactttaggaggctgaggagggaggattgcttgaatataggagtttgagaccagcctgggcaacatagtgagacccagtctctattaaaaaaaaaaaaaaggacaatgccatcaagctcactgttcttaccaatatttagctgttttaaaaaaaaataggtacaccctggattattgcaagtttttaattagttttcagagttctgaaaaagttggttttgacaattttggccagtattctcattgcttttctcggggagaagtgctccttactcagccattcctgccaatgccaccccttccagctggtttttaagctgttttcccacctgtctgaagtacctgctccctgaactcacggttgttcaatccctggagcccatgagatctgttcactacttccttctccaagaagcctccccatccccaagacacctccagatgagacaatctctgtcgctccaaccttcaagagggcctggctctgagctcttggccaccctggtcacctcctctgcttggaacctgtttaccctaaggtaggaagagtgatcttcatagtggaggagggcctgcctctgaatttgtacattttatggtaccccaaacccagtggcctggaatcttctgaccacactgcacatgcctgctccagccaaccctgggtcccaagcctaccgaaagtgggcaaggggagcagaggctcagagcccttcccctcccccaggccaaacctgtgaagccagcatgaccttcctcatttcacagatgtccaaggtgggacccagatggggatgagatgtggccagagccacacaggcaagttagggacagagttgggcctagacactctcccattcccctagaccaccctcaaccgttgcctcctgggtcccaggacaatgcgaatctacagacttcccagacctggggggctagaggctgaaccaaggagcatcgtccgcggctgttgggttggtaatgggaaatgaccactagggggcgcgctgtgtcaataaatgctcagccagggccggtgtctgcgagctccgcggccgggcatcctggcaatcaatggaccgcaggttctgggggttctggaccttgacagagaacctggtctggccctacaacctgcctgggctctcgc

SEQ ID NO: 740 - DNA, 48522 bp, Human
actaggataaataatgtcttcagctctagcattactcactatcataactaacatattttatatatgataccaactgcttaacataggaaagtcattgaattcatagtatatatttttaaaatgttgtgataaaaattaatgagatattttaagtctactcctgacctaaactatcttgattgttgcaacagatgcatttatttgattattgattgtaaataggaagatttctttttttccaattttgtgtattccaacattggcatatgcatagtttaaaaaatgcggatgtgcagctatgcaatgggacagttatttcatataacacattgcttggcataaccagagcacaatatccataacaagttatttatatcatatgtagtcctcctgtttttagaacaattactaaaacttgttgatgttatcgattaccaataaatattgagaaattccttaactggatacctatatgcattaatacatttctggaatggaattttaaataaccatctgaccactgagttttcaaaactgctaaataccttaatagttgcattaaccttcatttaattataaaagtatgacatctgataggctttagctcagtgtgatacaaatttaattttgtttatataatatatcatctacaaatactatccagaagaagcacattagaatgtttaattatactagagattaaaagatatttaatatataaacttgagaataaataaaatagagaataagaattgagaattacgaaaggaaactgaagataaaatttgcagattttaagaaaatcaaaattcctcattgaattttgtcagaagagttcaagaactgaaataattttaaagctttcagtgagtgaaaaataatagggagaagtagcaagagagattgatttttgactcactttcaactcggtactgtttttaaatgcctttcttattttcaagcccttctcaagctgttccttgaagttgtataattcctgttagtctatagatgtgaaaacccatttttatatgaactaccttctgcgttctataaacataaattctcagggttgggatgtcttctagtctaactctcccattgaatgtttggacgtcatctaccaaatccgtgtatctaaagcaaatatagtagatctaatctggtggtccagtacctccaaagatatggaatacactcctgaaatatcctgaaaccttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcgttagtcacatcaacccctctcctctcccaaacttctcttcttcaaatcaaactttattagtccctcctttataatgattccttgcctccttttatccagatcaattttttttcactttgatgcccagagctgaagaaatggactattgtataaattattcattgccaagagaataattgcattttaaacccatgttataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtttgttgtccgggacgtacattttcgcggtcctgctagtatgcgtggtgttccactctggcgcccaggagaaaaactacaccatccgagaagaaattccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaaggtgcgttttaaaatcactttgttaaagatatcatctcattttttaaagagtaaaataaaatgatattaatgtatttcaaattttgagtaagccatcaccccaatttttcaaaatttatgtaatttaaagcatagtggagaaaattcatcaatgcagtttttgcaattacatgtggattatgaattttcatggtatgtatattcattttcaaacagttgtgtttccattaatctataaagggatcagacaaggaggttagccctgctacttacaaatcagtagtttgcccagcttcattcttttaatctgtccagtcatgcttctgccaaaaacttgatataagcaaatcattaagaatgaatccataaatctgattatcaatttttcctagtgattactttagatacacaaattttatcttgccatttgatatggtgccaaataaatctatttgagaggtgactagaacaatttaatttattactagcatttctgaacatatatagataaatatttttcatgaggatttcaaggtaaggcaaggtctttagcatatcctgaatcatcaaattgagattaaattttagtcaatgttctgttaatgttaaatattttctttttttacaattatttgaaaacagagtgttcatttgttgtaaagggtaagtaagccttttaacaaaaaagagtcaatcagttaatttgaataacctactctggcttgatttgggtcttaggatggagaagttagagagaagaatagatagaatatttggtattcttcaaaatatgtgcagaggggccacatttatcaagttaatgatcaattcttttaaattacttatatgatataaagagaaatagataactcagatttgggtatgtgaaatagtacaatgcacttgaatgatcttggaaaatatatgttaatgaaataactaatgtgcatgtttcagatagatatgttcaggggattttcacacttttataaatattctgccaaactatgatctatataataactagtgttaaaaatatgccccaaaacatataaataagacattctgatatatatcatctgaaggttttgacctggaggatatataatatgggaaaatttctcaactaatgctgatctattgtaaagatatatttatttataaattcattcaggaatggaaggctacaaacctcttgagcaaatttcggtgaaatgcagatatgtttgagtatatgaagtgaaaacagaaagagaaggatttggaaaacagggaactcttgaatactgttggtgggaatgtaaattagtacaaccactaaggagaacagttttgaggttcctcaaaaaaactaacatttagatgatttttaagtgagcactttggggtgaagttcctgcaatgacatctccttatctgatgaaatggaaaaatattcaggagtcagatagatatggatcacagttttatgcttacctcttaccagacatgctactttcagcttaatctttttgacctttaatttcttcagtcataatatgaggatgataatatcacaggggcagaattgggaagaataagcacttagtatggagtagacatacctgcatagaagatttttgaacatgctttaaaacatttaagtacttatagaaatgtgaggcttatcacttgacataataaattgagtaacagagtggacagtctctctctaaagcaacacttcacaacagaattttctgcaaggacggtaatctgtgtgagaacaatgcagtagccaccagtcacacgttgctgtagagtccttgaaagtacttagtagctagtgctactaaggaactaaattcttaattaattccattttaattttaatagccacgtggttagtggctatcatactgcacagcacagcctaaacaaataaaaaacgtttatttggacaataaaaattaatagataaaatcaaaatgagaccttaccaagtttaaatcagatattagcaatagggtctcttcaactgaccatcttgacaaatgtgttgttttaaaacgtagtgctttattcaaagaataattttgtcatgtctcccttagggcagcttaatgaacttccaagaaatttctgatttgtcttgaaagctgcttaactaattcagataaaacaaataagcctgctggcataattttagctttgttaaaatgtgctttcatttgacattctttgaaagattgtcagcaaatgacaaaaagtctcactacaggttcttagatgagtcttagaaatgctctaaaatttctttctgttttagaatgtgtgataagcctaaagtaactatatgatgtgcctaaagtactggggcatttgtgtggccccgtggacaaatactgttttgactgcttgttaaaaataatgagaatggaacacaaagcatagccccaggcatgcagagggccatgacatgggcgactttaactgaatgcactttgactcgcaaaaaggccctgtcatgaaagtggcatatatgctatgggaaaggagacttaaagaaaaacagagaaaagaagcatgtgttgattcatccataaactttagtaaattttacaatgtgaaataagtaggccaaccataataatttcttttaaaaatccctttgtcctgcagaataggatgagaatttaattaatattaatttgctctacttttgttgaatagacaagaatagaaaaatcaccgtttatcctaactaggctaatataaaatgtatatgaatagttcaaatagcaaagggagagaagggagaaatatagagaaaaattctaggaaaaaagctcaatttaaatatttaaataggtcaatttatacatgaaggtgtcctactatttactatttgatattaattaactgaaattaaaggcattggtggaaaatatttaaatgtttaaaatgtatgtagtataaaatttcataagacttaaaacttagaatatttatttctaaaactaatatatacatatattaatttagcttaccttttgatgactttcagtataccttggcacaaacagggaaagtattatttcacattttaaatatttggaaaatgagtttcagagtgataatgtattatgcttatcatcatatgactggtaaatgatagaggtaggaaccagagtgcagttcctgactcctaatcaacagacagattgtagatggatagataaccttcagagcaggatcactgcaagttcatgatacaaaacgaaaagagtgaaagaaagaaaaaagactgggcgcagtagctcacacctgtaatcccagcactttgggaggctgaggcgggtggattacttgaggttaggagtttgagaccagcctggccaacacagtgaaaccccgtctctactaaaaaaatacaaaaaaaaaaaaattagccaagcatggtggcgggaggctgaggcaggagaatcacttgaattcgggagacagaggttgcagtgagccgagattgcgccattgcaatccagcccgggtaacagtgaaagactctgtctccaaaaaaaataaataaataaaatttaaaaaaattaaaaagggaaaaagtgggggaatgaagtgattaccaagtaattctgcttgtttaaaaaataagtaaaaataaaacttatttatgtgactttgatgcgattaattttcaactttttaatggatcatgttactctttaaagaaaaaaaatcatctataagagttcttgatgttattaatagttaccacttaaaaaagaatccagatttgaaagcttctcttttctctctttcaagtaaaatcatactgcaatgctaattccctatatacatatagctatttacatactcacacacatcgtactacacattgcagtatttcgaagaactgttgttcaggagtaggaaatcacagatctctttaactttcactttttaattcagatggcctgttatttataaagctttttaaaatattgtaagtattttttgacagggaagccaacattttcacaaatagaaacatccctcaagcacccagtctgactcagaatatgtatataaaccacagggacttccttcttttctcatggtaggaactcaggggaaattagtttatataatgatgttacagttatttttattttctgcttcaaatttccatcttccgtggcatatatcaacagtcacatttctgtactagcccagtgacagtgtgctgattgatttccttaaggcaggcatgacagtgtttcaaaggttgacaatttttgttgacagaacatgaagatcaactttttctcagattagtgatcctactcaaggccttcccttgtttctacccatcccataaggcatcctcatctgttccatgaatctcaaaagatcatttaaactggggtagtcttttaacatagtcaagatgtttgggcccttgtttttattttaagtaaacatcttccccattgatcaaaagctggactggatttatgaaactaaggttagaattagatttgttttgcgatctggggttagaaaatctaaattgtgaaaaatctcacctaccacaagatttagaaatcttgatttaaaattgccaagaatgagacatcaaataatacattgtgaagacaaagagcaagcaaactttgttgttctgaagaaattaatattttttaacattatgtaaccataactcaaagtgatgtgtaacattagaagtgagtaaagattcattgatgtcagtgcagagagaatatactataacaatgagtataacaattttagaaaacttacttagtttatttgcctccaagaggctcagaagagtttgaatataatgatttcctcattttttcaaatataaaatgaagtttcacttaaaatttctccatttcagctttaagtttacttgattttatagtctctgaattctataatttgcatattaatatttttgatctaatgttaaaaagcaaaagagatgacaatcaaatgctaacgactatgaggtttctgaaagctggggttattatcaaagtacacttccactggggaaaaaatgacaacataaaactcactgtcttcataaatgaatctttattaatgctgtcaggtcttaacaaatgagagtgtgacactaataggattaagtaacttttgacttcattactattatcagagtcttggttagtgttcatcgtccactaatgccttttgttaaatatatctgttattaaaaatcccacagtatggatggacacttatggaacataagttggacatcgtaaatagttcaattctggagtttataaattgaggctctgaagaacaaatgtgttcccaaatctgaatgatctactcacatcatgcctcttaacttaatattaccaactaactataagaagcaccactaaattttatgttattagatacagatttattgatctgttatttcattgtccactgtatctaagtaaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaactttgatcaatgctaataatctaagattataaatatcccaatgtgggtagttttcttggcataaattattctttttgtctacactgatttatattgattatataacaacactgctgtggagacactctcttagtgaactgaagtgtgatctttcaatcttagataaaataaattgatggattggtaagatttctgtatcagaggtgatgacaccttgtatgagaagtgatgataaaagcaataaggtcattctgcagaaaactttctgagtttgtttgagttttatctataaaataatgtatctatcttcatgattttaccagggtatgagtttggaccagtttttgatggaattggtctttagcaaaaactataaagtgcagatgaaaactaattctcacttaaaaatcaaatactgaagaaattaatattctcccttttgtatttatcagtgtacagtcatcttcacaaaactaatcaagaatgaataattaaataatctagtagcctaatagaccaaataaattgctttgaccacaaattaaattttagcagattgttgttcaagtgtctttcaatttcccagtgcaggtagatgtcactggaggaaggaaaatattgagtctaatttaattaaataacgcagaacttaattttcttaattatttttgaaatgtccttttttcattggtcttttgcttgcacaaattatatcttcaccaatctattctacaaataggtaataaagtgttttatccataaaatgttaaatatctattactagagcactaagggcatcaaaatagaatacatgtggacacacactttttagcaattaaaactataaaaatatcgctagttatctattttgtatttcctttgaaatagaagaggtacttctaggtgaacaatcataagaaacctattgcttattctttatacattggaagagtatttagtggtagcatgttttaattgctgcatgcacatatctctatacttgctggtaaactgaggaaagtagtataacgtcatatataggaaacatattttaaaagacatattttgcaaagtaagtgtgaattttgtttcattaagcaaaacaaaggattttaaaagttgaaaatcataaaatgaagttttggattttctaacctaatttacatttgtctttgcgatctcacttaatctggaattttattttatgtagagtattatcatgaatatttctcatccttttacttattttatatatagaatttcattattttaagcttcttcaatacaatgaagtgaaattctaaagaatgaaaggctgttctattaaattttgtctagatgtaacaactgactgctaactaatatcttagtctaattccagtaatctaaatttaacacatatttaatgagtgctcaatgtacaaagtcttgagggataaaaaatgtgtttggaaaacagtcagtgtccccaaggagattaataacaggcattatcaggattatatttttgctctaatgatagtaaagaggaaagaatatttattttatatatacatacatacttatgtgtgtgtgtgtgtgtgtgtgtgtgtgtgtgtgtgtatcttttttctttctttttctttgtgagacacagccttgctctgtcgcccaggctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccaggggctcaaactcctgacctccagtgatcctcccgcctcggcctcctgaaatgtcatggttacaggcatgagccatcacacttggccatatttattatgttataagaacattttatcttaaattgatcatgctgccattaagaaaatggaattatttaaagttttattgtctcagaaaagttaaaattttatatctatttttagtagatttttaccaagcactctcattaacttatgatatcttattttgttactaggtttgcaattatggcagttaatactttttgccaacatttatctgcacaatcattttgagactggaaataaaacgttttgatgacaatggtaattcttgtgctagttgtggtaattacctaagtctttctattatcttaattctcaaacttgttatctgtgcctacaattcctctcctatataatagagaaaattaaaattatccttatgtagcatgcagggatattataaaagctaatgatataagtaaaatctataaagtttgctgagtaccctgaagaaaactgttctgtaaacaatagttatgggttttactctgtaggttgaggttaattacagtctttcacaatttttctaagagttgatgcttcatactccttaaaaagcctattttacgacttaaacttagttttccatacatgttttatgtatgtatacagagaaaaatatgacaacattaatctatttcttgatcagtgccactggctctacatttttttctggacctagttcagtttttgttttgttttgttttgttttaagtcttccacttaccctctttggcttatctcttgaatcaaatgtctcctcttcatttgtctttgtctcctcgtggccctccatatgacagtgatactgctaatatgagtactttctcatatactgcctctaccatctggaattgctttatttacatctcattcatatgcccttatttttttaaaaaagatttcctctcttgtcttttgttttttcaagctgagaacttattttcctatcccctttctaagacaatcacgactgttttttttttccagtagattttgtagaacaggtgtgtaataacatacttgaacttttttatttttaattattctaaattaaataggtcttaaaatatcctttttcaagcagaagatttgctataacaagcctttcctggatgctagtatgtttttctggcttataagagagccaagatatcctctgaggacaagagttgtttagaagaattcatttaaaatagtttgaccagggaaatatagcagaataaacagcctgcatcctaaggacagtggaacaaggggagcattgctgtcagtaatgcaaataacaaagtaaatggttaacagaagaacgaagttgtgttctagataatcatacactgcctctacggtctggatgcatgaattctagagaaacaatttaatggactataaataaattaagaagtttaatactttatagattacttttagttgaacagagtgctttatttaagtcactgaatgattatatgcatgaattttagattgcatatagatatcaaaaagccaaagaatatgatcatgcttagctacaagctaatgcatattcaattaactcccattaaactaccttcaataaataagtaaatataaaatgaaggctacttacattgtttgaatacacaatataataagattctgatgctgattatttgattttgtgtttagtggtttcatactgcttttgcttggaggatgtaagtatttaacagatcctgtgtgtttcaggaggcatttaaatcttttaattttgctgtgaggaaagttattcctaagggatcagtcacagatagctatattacccccatcaaatgcatcattttcctagattccaaaccctatgtagaaatctccaagttgaagaagtaacaatgaccatgctatcaatgtttaatcctttggaaaccatagtaatggtataggaatgcacctttttaactagaagtactcatgggcctggaaaagtgaagatgacctcattggggaatggatatatggccctaaattggaaagtcattggctggcttctgtataggctatttatagcccatttattcatctgcagcttttaagattctaaacatttctctataatctattttccctatagtttgaggttaattatactctgtttatctatatgtttaagatcaattacctaactgctaaaatgaaagcattttcatatagctagagctctcacacagaaaactagtttacgtgtaaggtaaccagtttaataaaactgataatctctttagctcttagaaattggattttaattatttatctaatagacaagacttcttaagctatattttctactcaaatatactaatggaaatgtaagtaatttaaaatttttctccaactgttttgtggatgttttgtaaattgtaatctcattgtaactatgtctggtgttctacaatctagactataaaggtgtgaagcaaaaaaaaaatgatttctttctgaaataatgttttgcattactattttacaccacaaaatagtgactggccttatttaggtattgattaatgtaaaaaatggcattttacccaataaccttcctgttattaccaggcaactatgaaatttagtgacacaattatttttgtttctttttttcatcttaaggaacaagttcttaattagattcgatacagctataagtaaacataaactatgttcttatgtaacctcaagagttattttaggccgggcgcggtggctcatgcctgtaatcacagcactttcggaggccgaggcgggcggatcacgaggtcaggagattgagaccatcctggctaacatggtgaaaccaagtctctactaaaaatacaaaaaaattagccgggcgtggtcgcgggcgcctgtagtcccggctactccggaggctgagacaggagaatggcgtgaacccgggaggcggagcttgaagtgagcccagatcgcgccactgcactccagcctgggcgacagagtaagactccatctcaaaaaaaaaaaaaagaaaaaaaaaagttattttaaagtgtctccatgccttgttacacagttcattgacaattgtttaatctgttgctgctgttaagtttccttaaatttgtgattatttcaatgagttagtgatagtttattcacccatatttgtggtgcattgccacaaggaattattgacacttctttttactgacaacagcttttttgttttgtgtttacagtgtgatgttgagagttttgttgtttcctcacaaataactgactgcataactctatgctttcctacatggttagcaattgctatttcatgaaaaattggatttgctttcctagttgcagttatcagtcggtgcttcttaaaaagatagctgtttattttgatgactgcttaggcaatatttattattaagtattgctttctcaaatgatttttcacagaggcagtggacaaatggtttgacctgtacagtgtacagtgtacaaagattcattttgtagcttaaagaatgaattatctttgtgtcctctgtgtgtgtgtgtgtgtgtgtgtgtgtgtgtgtgtgtattatagagacagggtctcacagtgttacccaggctggagtgtagtggctttgcacaggcacaaccatggcatgctacagccttgaactcctgggctcaatcaattcccctgcctcagcctccttagaagctgagactacaggctagcactaccaggcccagcgttttttgtacattttttaatctgtattttatcctcatatgaatttttgttatctatttgccttgtataatattaggatgggtatatcatttatcctccaaattaagattaaacagggacattaaattaaattaaacagggacaaccagaatatatagtcacaatatttaaaaccccaaatttctacagtaattccttcttttccattttacatccttcttctcaaggtctggtctaccttgagccagagagctgccatcttctgcaaaacatcaatggggtcaactattatttgcacaaacttgaacttcactctgttttaatttagcagagcgactctcaggctgacttggttctgttggcaaaagactagcttctgaagaattgtctaacagcagaaacgctgtcatcaagcttgtacatagggtgaatttttttctgagctggcattgttcatctaatgtagtgttttctaaagctaaattttacacacacacaaaaaaaacagacatggaaaacgggcataattgcatttagaattatgttacttttggacataagatttctatttcctttgatactattcaaatagatgaagactatgtcgtttgcttctatgcactgatccacaaaatgtaggaggtattaaatgtcttgccaagttactaaacaagtaaagttttcagaagctcaatgtgtgaccgagtttctccttttctacacatatttccctaaatagccatttgtctacaggccatttgagtatagcctgaagacaggatgagatacagaaccacttaagcagctttccaaaatgaggttttagattgtggagccaaagctctgagtggtttttgtaagagaggaattttttttttgttttttttttttcttgagacagagtctcgctgttgcccaggctgaagtgcaatgatgcgatctcggctcactgcagactccgccccatgggggttcactctattctcctgccccagcctcccgagtagctgggactacaggcacattctttatgactgtatctccatggacatattcttcataaatatttagaacagcttatactgtcttctattatactggcttgaagataattgataccattgatgcaggatcaagtgttgtctgtctttgttcatctacattacaaaacatggtgtcaccaataatctaattatttttgttatactttcctgtgttactggtttgaagataatcgataccattgatttgggatcaaatttgtattttgctgtttttctccattcatcaacagtacaaaatgtgctgtcacccataatagtttatttttgcatcatatgttttggatttctacattcatttgcctgaatttttcactcagggttttggatattatatatttcatatgcagcatgtatcatttgttggtgacttaaatgcctgtatcctattataacagaactaatcacttttctaaagataagtataagtttggtccacaaaaaaatttctatgtgcattgactcattgaacctgctacgatgaagacttctactttacaattcaactatgcatatcaggattactgatttctttatatgacattacttatgaaaagaagtaattttatgaattactaaacactttccaagtatgtttattttgaaacttgcctttaattaatagagatagcttgaatatttagcatagtccctaataaaaataattgaattaaatttaagtatctagtcaatagaattaatagcaattgctataaacctaaataattatggtgataataaaaatcaagttaaatacaagatgtggtatagagttcagttagcttaataatctaatgttttactagtccacattcaattttagagtaatgatgttgaaaatgcaaattacttattattaggttccttaactttactatttacttactttttagtttttttaaagttttattttaggtttaggagtacatgtgcaggtttgttatataggtaaactcctgtcttgggggtttattgtacagattaattcatcacccaggtactaagacaggtaagtacccaatagttatttttttctgctcttctctctcctctcaccctccaccctaaagtaggcccaatatctgttgttcccttctttgtgtccatgagttatctttatattaattatttttatttcactacttggcagtttgccaaatcagaaacttgattttgataagagaaaaatgtctatttcagaagttaaaaatccgtatttaccaaatgtttaccagtctactatcattgatagggttcactatatttcaatatatatatcccagtgttgtcaaatttttgaggtattgtgattttattagtgtttgataatgaaaacataacttcaaagtctattacctgagcattgctttaatatccaggattctttgtacatgccattatgttcctgaaagtacatttagcataatatgtatagctaatttatttgaaaacatagccaattcttcattattcagaagttaataatcaaatttcatgaatcatatccctccccactacatcctactacatttcattttccttcaaaatactttaaaaatacttcctagaaattatctactttagcaaatgcatttcaagattctcagaaaatattttttaatagtccagaattattcataggattagataagctcaaatctccattagatgttcttttctgttattagtaaactcccctctttagtttagatcagtgttgtagcacccttattcttggtttctattacatttacagtatcttacaaggagcagcatctgttactgttctaagagattaagtcaaaccaaataggtgtgtctatttagaataatagggatttttaagagaattataattggatcttgtaggtgtcacaaacctcagtgtaataggcatcattgataagagattcctcttttaactgtttattttggcattgctacattcgttttgaagattttcttggtagccttgcatacatgtctttaaaccatttttcttacaattagatgctgtgataacatacagaggctgtggatacctacaattttaacttctgctttgactcccagaaggaaagtataaatattatactggctctgatatattacaactttacattaatttttagacaagataaaaagtatttttaacatattttctaccatattgctcaattatcatccttttatcatagtaacttatcaatgttacaaaacgtttttgtgggcattatagtttggaactcaattttgagaacattgtcttaaaaatcttatcaagatatgactttccaaatacaacatttgtattacaattagatgtataccttgttcttttttcacttttaaattaaaacatgtggctgctcacggattgaaaacaggtttacctatatatgtccttaccaattggtaagcattattcaaagtagatcataaaaaggagacaaaagccttgatattcccaattaaaaagatttaaactaaaaactccttctgctaactgtatactgttgaagcatttattgtataacccttaactgtcaagaactgccacatcttttgatatttgtgacagctattttaggagaataagggagatgcaatgttataataggtaagggatgaagatcagcttcctggtagattacaaagtagtgataattctgctttcatcctattgtgttttttttctgcactatagattgaattacatattattgctcaatgtgatgctgattaattaagatgtagggagctgtggaaaattatccatattttgtcataaacatgtttactgactgtacatcagaaaatcactaaataatgcatgaaattataaaaattacattaaaatattaaaattacctgtaaaacctaggtatttaaaccactgtagtttttcatatgatattgtcagatcaaatacacttgccactttcatttaagaaataattaccaatattagatgtaagttaaaataaacataaaataaaaagagttggacatttattcatatcaaataaatagactaatgtcttctatggatacctactcttttccatatttttagttgttcttccatttttaatttttatgactacatagtaggtgtacgtatttgtgcggtacatgagatattttgattcagtcatacaatgtgtaataatcacatcagggtaaatggggtgtcctcagttctttgtcacctgtggttttagctctgattaagaacttgtcttggaacctaagtcaaagtttgattttaaatttttcgttgaaattgacaggtcggctgaggaaatgaagatttctccagttctgtagtcaggtggtctgatcgttagactaattggatttacataaacccaagtattatattttacatatgcattgatttttatcacctctattttcaagctgttgtataaatgttgcagctttcaggccctacttccattggtaacaaatagaaactggtttgctgctattctgtcctggcatacaaataatctaagtcaaaagctttgcttttcatgtttttctaggatagtgagaggaaaaaaaaaatttctcctactcaaagcatttatttcatttctattttcataaaattaggaattctttttttttttttttcttttttgagacggagtttcactcttgttgcccaggctggagtgcaatggcacgatctcggctcactacaacctccgcctcccgggttcaagcaattctcctgccttagcctcctgagtagctgggcttacaggcgcccaccaccgcactcagctaatttcttgtatttttagtagagacggggtttcaccatgttggccaggctggtctagaacttctgacctcaggtgatcctcccgcctcggcctcccaaagtgctgggattacaggcatgagctaccatgcccagcccaaaattaggtattatttgttaatgacttacgggtttttaattagccacaagatacgaaagtctaaacaaaagtatgttttgttatagtcagtttaatgccctaaaaaaatgatgtttgcacaaatgattctaatgcacaaatgttattagtttctatacatttatattttctcagagtcttttctgattatttgctggaccctacatttataattccatttatgccgatttcagagtaaaatttctattggggtacaatttagtctttttcttctaggattgcaattttcattctgttggcctagggcttctcaaccttggcattattgacatttgaagctagataattcttccttgtggggtggtgtgagagctgtcttatgtactgcaggaagtttggcagcatctctggcctctaccaaatagatcttagtggcactctcttgcctaattgtgacaagcaaaaatgtctccagagtttgacaaatgttttctcgggttgcggtgggggccccaggaatttcaacaatagaaaaccattgctttagctcacccttacacatattcataagagaggattttgtattttatagaaagattttattaactccaaaaaggagtcagacttgaaaaccttcaaaaaccttcaaatgatgagcattctcagataaaatatttcagaaatgttgaaacaataaatgctatttgaataacacatactttagtggtcataggtgaaatagtattaggacatatatcaagtcctttgataaaaagatattttatgaagtaatagtgccttttaacaaattcataatatgttataatttatcgtaaatgtagaagttactttcttatctggtgtgactgaaggggaacacagtgctaaatgataaaacagagtagcctgaggtggttttcttctaatttcaggtcagatttacatttcactaattgcacaaaagtttttcaatattaattttgttttatatatacagaaaacatatttattattagcactagcaaaatcttatgtaatgaacccacttcataaatagaatatttatgttaatcaaatatgaatgttttgccaacctaatttcaaatcttaacataaaaaattggaatgagaaaattgatacatatgagtatattggtatatgtattataaatgattcaacctcagctagtaaaggaagttttattattttcaatagtaaaatcattatttttctaatttgatttcatagttatgtaagaattattagcaatgttaaaataataaactttgagcgaaactatttcctgattgttaatggataagaaaaagataaaaattgacatctagaattaggcaaaggaaaaactaatggaagattcaatatatgaatgagacacaaaagttgatagtggtgtgtgatagaactaattacaagcgttttttaagctaatgtttttagttatagatttatttatgaaaaattgttcttagctcttgaattttatagtgtttttaaatttttaatgtatttacttttttctttttaatttttgttagtacatcataggtgtatatattcatggggtacatgaaatactttgatacagacatgcaattgtcatgatcacatcgtggtaaatgggacatccattccctcaagcatttatcctttgtgttacacacaatccaatgatacttttagttattttaaaacatatgattaaattattattgactgtagccaccctgttgtgttagcaaacgctaggtcttattcattctttcttttttggtacccattaatcatccctacctcccctgcctaccaacaacccttgctagcctctggtaaccaccttctactctctgtcttcatgagttcaattgttgaaatttttagctcccacaaatatgtgagaacgtgtgaagtttctctttctgtgcctggcctacttcaattaacataatgatccatccatccatgttgttgcaaatgacaggatctcattctcttttctgaatagtactccattttgtatatgtaccagatttcctttacccattcatctgttgatgaacacttcagttgcttccaaatcttggctactgtgaatagtgctgcaaaaaagcctgggagtgcagatatcactttgatatacttatctcctttcttttgtgcgtatacccagcaatgggattgctggattgtaatggtagctcaattcttagttttttgaggaacctccaaactgttctccaagtgattgtactaatttacattcccacaaacactgtacaaggattcccttttctccacatcgttgccaacatttgttaccacccgtcttttagataaaagccagggggtgagataatatcttattgtagttttgatttgcatttctctgatgattaattatgtcaaacatcttttcatatgcctgtttgccatttgtatatcttatttcgagaaatgcctattcaaatcttttgcccattttttattacaatattagatttctttttctctagagtgatttgagctctccatatattcagattattaatcctttgtcagatgggtagtttgcaatattttctcccattctgtgggttgtctcttcactttgttgttgattgtgtcctttgctgtgcagaagctttgtaacttgatgtgatcccatttgcccatttttgctttggttgcctgtgcttgtgaggtattgctcaagaaatctttgcccagaccaatatcctggagattgtttccaatgttttcttgtatggtataatagcttgagatcttaaatttaagtatttactccgatttgatttgatttttctatatggtgagagataggggtttaatttcattcatctgcatgtggatatcaggtttttccagcaccatttattgaagagattgtattttccccaatgtatgtttttggcaacctcgtcaaacattatttcactgtagtagtgaggatttgtttctgggttatctgttctgttccattggtatatgtgtctgttcttatgccaataccatgctatttggttactatagctctgtagtataatttgaagtcaggtaatgtgattccttcagttttgttctttttgctcaggataactttgtctatactgggttttttgtgtggttctatacaaatctgaggattttttttctatttctgtgaagaatatcattggaatttttattgggattgcattgaacctgtagattgctttaggtagtatggacattttaacaattttgattcttctaatctatgaacatggaatattttttcccttttttggtgccctcttcaattgctttcatcagtgtttcatagttttcatgattgagattttttacttctttggataagttaattcctaggtatttaattttttgtgtggctattataaatggaaataatttttaaattctttgtcacattggtcactgttggcatatagaaatggtattgatttttgtatgttgattttggatcctgcatctttactgaaattgtttatcagttctaatagttttcttgtggagtctttagttttttccaaatataacatcatattatctgtaaacaatgataatttgaattcttcctttccaatttggataacctttatatctttctcttatctgatggctctagctaggactaccagtactatgttgaataatagtggtgacagggggcatccttgtcatgttccagatcttagagggaagaatttccatttttccacatttagtatgatactagctgtggatctttcatatgtgactttaattgtgtttagatatgttccttctatccccagttttttgagagtttttgtcatgaagggatgttgaattttataaaatgctttttcagcatcaattgaaatgatcatatggtttttatccttcattctattgatgatatctcacattgatttgcatatgttgaaccatccttgtttaccaggggtacatcccacttggttatgatgaatgatctttctaatgtattgttgaatttggtttgctagtatttttgttgaggatttttgcattaatagtcatcaaagatatttgcttgtagttttctctttttattatcatttttaagttccagggtacatgtgcaggatgtgcagttcattacataggtaaatgtgtgccgtggtgatttgctgcacctatcaacccatcatgtaggtattaaacacagcatgcattagctagttagctgatgctgtccttccctaactggcctcagtgtgtggtgttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattatgtatatgtaccaaattttctttatccagtctatcattgattggcatttgcgttgattccacatctttgctattgtgaatagtgctgcaatgaacatacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgttgctggagaggcctcacaatcatggcacaaggcaaaggaggagaaaggcaggacttacatggaggctggcaagagagagcgtgttcaggggagctcccttttataaaaccatcagatctcatgagacttattcactatcacaagaacagcacaagaaagaaatgcttccatgattcaattacctcacaccaggttcctcccatgacacatgggaattatgggagctgcaatttgaaatttgggtggggacacagtgaaaccatatttttctgcccctggcccctcccagaactcatgtcatcacattttaaagccaatcatagcttcccaactgtcctccaaagtcttaacttatttcaacattaactcgaaagcccaagtccaaagtctcatgtgagataaggcaagccccttccacctatgagcctataaaatcaatagcaagttactttctagatacaatgggtgtacagggtaaatacacccattccagatgggagaaattggccaaaataaaggggctacaggccccataaaagtctgaaatccaatagggcagtcacatcttaaagttcaaaaatgatctcctttgacaccatgtctcatatccaggtcatgctgatgcaagaggtaggttcccatggtcttgggcagctccacccctgtggctttgcagggtacagcccctctcctggctgatttcataggctggcattgagtgtctgtggcttttccaggcacatggtgtaagttgtcaatggatctaccattctggggtctagatgacagtggccctcttctcacagttccactagatagtgcaccagtggggattctttgtggaggctcccaccccacatttcccttctgccatgcccttgcagaggttctccatgagtgctctgcccctgtagcacacttctgcctggacatccagttgtttccctacatcctctgaaatcttggtggaggttcccaaacctcagttcttgacttctgttcaccctcatgcccaacaccacgtataagccaccaaggcttggggcttccaccctctgaagcaacagcctgagctctacatcggacactttcagccatggctgggatgtaggtcatcaagtccccaaactgcacaaagcagcaaggccctggtcccagctcatgaaacaattatttttttctcctaggcctcccagcttgtgatggatgggagaggctgccatgaaatctgctgacatgtcctggagtcattttcccattgtcttctcgattgatatttggctccttgtttcctatgcaaacttttgcagtcagcttgaatttctcctcagaaaatggctttctcttttcaatcacattgtcagactgcaatttttccaaactttcatgctctgccttccttttaaacataaattccataagttccaaaccatattgtagtgaatacataacactgaatgcttttgacaataccgaagtcatttcttgaatgctttgctgcttagaaatttcttctgccggataccctaaatcatctctctcaaattcaaagttccacaaatctctagggcagggacaaaatgccaccagtctcttcactaaaacatagcaagagtcacctttgctccagttcccaacaagttcctcatctccatctgagaccacctcagcctggactttattgtccatttcactatcaacattttggtcaaagtcattcagcaagtctctaggaggttccaaactttcccacatcttcttgtttatttaggatccctctaaactgttacagtctctgcctgttactcagttgcaaagtcatttccaaattttggggtatctttacagcagcaccccactctaccagtaccagtttactgtatcagtccattctcacatggctagtacagacatacccgagactgggtaatttataaagaaaaagaggtttaatgaatccacagtttacaacaacagtgtaaaagcttttctatttctccacagcctggccggaatctgtattttgtggacattttaataatcgtcattctgactgtcctgagatagtatctcattgtgattttggtttacatttctctagtgatcagtgatattgagctttttttccatatgttttctggtcgcatgtatatcttcttttgagaattgtctgttcatgtcctttgcccactttttaatgtttttttttcttgtaaatttgtttaagttccttatagattctgtatatgagacctttatcatagggatagattgcaaaaattttctcacgttctgtaggttgtttgttcactctgatgattgtttcttttgttgtgcagaagctctttaattagatcccatttgtcaatttttccttttgttgcagttgcatttgacattttcatcatgatgcctttgcccttgcctatgtcctgaatggtattgcctagattttcttctagggtttttatagttttgggctttacatttaattcattcatctatcttgagttaattttggtaaaaggtgtaaggaaggggtccaatttcaattttctgcatatggctagccagttctcccagcaccatttattaaaaagggaaccctttccccattgcttgttttttttttttcaggtttgtcaaagatcagatggttgtaggtgtgcagtcttatttctgagttctctattctgttgcatttgtctatgtttctgtttttgtagcagtaccatgctattttggttactgtagccttgtagtatagtttgatgtccggtagtgtgatgcctccagctttgttgtttttgcttggaattgtcttaagtatatagtctcttttttgattctatatgaattttaaaatagtttttttgctaattatgtgaagaatgccaatggtagtttaatgggaataccatctataaattactttgggcagtgtggacattttgacaatattgactcttcctatccatgagcatggtaaggtatatttttccatttgtttgtgtcctctttgatttccttgagcagtcgtttgtagttcctcttgaagaggtccttcatttcccttgttagctgaattcctaggtatttgattctctttgtagcaattttgaattggagttcattcatgatttggctctctgcttatctgttgttggtgtttagggatgcttgtgatttttccacactgattttgtatcctgagactttgctaaagttgcttatcagcttaagaagcttttgggctgagacaatggggttttctagatttaggatcatctcatctgcaaagacaatttgacttcctctatttctatttgagtatattttatttctttctcttgcctgattgtcctggccagaacttccaatactatgttgaataggagtggtgagagagggcatccttgtcttgtgctggttttcaagggagatgcttccagcttttgcccattcaatatgatattggctatgggtttgtcataaatggctcttattattttgagatatgtttcttcaatagctagttcattgagagtttttaacttgaagtgttgttgaattttattgaaggccttttctgtgtctatttagataagcatgaggtttctgtctttagttctgcttatgtgatgaattatgtttatttatttgtgtatgttgaaccagccttgcatcttgaggataaagctgacttgatcgtggtggataagctttttgatttgctgctggattcagtttgccagtattttattcgggatttttgtattgatgttcattaaagatattggcctgaagtttcattatttatttttatttttttggttgcatctctgcgaggttttggtataagaatgatgctggcctcataaaatgaattagggaggagtccctccttttcagttgtttggaacaatttcagaagaaatggtatcagctcctctttgtacctctggtagaattcagctgtaaatccatctggtcctgtgctttgtttttttggtaagctatttattactccttcaatttcataactcattattggtctcttcggggattcgatttcttcctggttcagttttgggagggtgtatatttccaggaacttatcgatttcttctagattttctagtttatttgcatagaggtgtttatagtattctctggtggttgtttgtgtttctgtgggtaggtggtgatatcccgtttatcatttcagattgtgtctgccccagtgagatcagagttctgtccataaacccctgactggagttgctgatattcctgtagggaggccttgcccagtgaacagggatagatccaggtcccacccaaagaagcaatctggccacagtctgtcacagccactgtgctgcactgtggagaattcctcccagtcgaaaccttccagtctgtcaggccctggcagcagaaaatggctgtttggagccacagggatggctgccgcacctccccccaggaacttggtcatcttagtcagtctccagcctgctacctacctctgggtccaacccaaacggctgctgagattctgcacagttctgtgcttgggagccaaagtcctggtggcataggctcacaaaggaatctcctaatccctgagttgtgcagatgggttgaaaaagcatgatttcccgagcagagtagcacaataactccctcccttggctgagggtaggaacttcccttgccctgtgcaactagcagatgggccatcactccaccgtgcttttctctctgcatgggttgcatcaaccacctagtcagtcccaatgtgagaacctggataccttagttgatggtgcaggatgcactagctttttttgttcttcttggtgagagctgccaaccacacctgcatctaatcagctttctcggccccaccgccactcatcttggccccgccaacacccagttttctttttttgatgtgtcttagtctgatttttgtatctgggtaatgttggtctcatagaatgagtctggaaatattctctcctctattttttgcaatagtttcagtagaattggtattagttcttgtttgaatgtttggtagtattcagcagtaaagccatcgggtcccaggcttttctttactgagaggcttttttattacagctttgatctcactactagttattggcctgttcaggatttgaatttcttcctggtgaaatcttggttggttctatgtgtctaggaatttctctattttcttctaggttttccaatttattggcatatagttgctgatagtagccactaatgagcctttgcatttctgcagtgtcagttgtaaagtctcattttttcatttctgattttatttatttatatcctctctcttttttcttagttcatctggctaagagtttgtcaattttgtttaactattttaaaaagccgctttttgtttcttcaacaatcttttttcattttcttcatttcaatttcattttattctactctaatctttattatttatttccttctactaattttgggtttggcttgttcttgcttttctacttattaagatgaattgttagattctttatttgaaggttttcctcttttttgatgtaggcactaatagctataaacttccctcttggtactgcttttgctctaccccataggttttggtatgctgtgttttctttattatttgtttcaagaaacttttcaatttacctcttaatttctttattgacccactgatcattaagcagcatattatttaatttccgtgtatttgtatagtttccaaaattcctctctttattgatttctaggtttattctattgtgcttagagatgaggcttgatattatttcaattttttgaatgttttaagacttgctttgtgacttaacatatggtctattcttgacaatgatccatgtgctgaggaaaagaatgtgtattctgcagccgttggatgtaatgttctgtaaatatctattagatgcatgtggtgtatagtacagattaagtctgatgtttctttgttgattttctgttgggaagatctgtccagtgctaaaagtggggcattgaagtctctagctattattgtacttgggacaatctctttttagctctaataatattttctttatatatccaggagctccagtgttgggtgcatatatatttaaaattgttatatcctctgactgaattgaaacctttatcattatatactgactttctctcttcttaattgcttttgtcttgaaatttactctgtttgatataagtatagctacacctgctcttttttgttttccattggcatggaatatttttttctctttttcattttcagtctatgtgtgtcttcataagtgaaatgtgtttctcataagcaacagatcactggttctcagttttttcatccatttagccattctttgtcttttaattgaagatgttagttcatttacattgaataatattgataagtaaggacttactcctgccattttattatttgtttcctggttgttttgtggtcttctcttccttctttctgtccttcctgtcttcctctagtgaaggagattttctctggtgatatgttttagtctcttgcttgtcattttttgtgttttcattttatgttttttggtttgaggttattttgaggcttgcaaataccatcttataatgcagtattttaagctgataatagcttaacattgtttgcataaactgacaatcaaaaagaaaactaataaaaattctacaccttaacttgatccccaagatttttaactttttgttgccgtactatgtcttgaaaagcggttgtagttattacttttgattggttcattgtttattctttctacttaggataagagtagtttacacattacagttacagtgttataatattctatgtttttctgtgtacttgctgttaccagcgacttttgtacctccaggtgattacttattgctcattaatgtctttttctttgggtttgaagtactccctttagcatttcttgtagggcagatctcgtgttgatgaaatctctcagcttttgtctggggaaatgtttatttctccttcatgtttgaaggatattttcaccagatatactattttaaggtaaaagtttattttccttcagcactctaaatatgtcatgccactctcttctgatctgtaagatttacactgagaagcctgcttccagacgtattggagctccattgtgtgtgtgtgtgtgtgtgtgtgtgtgtgtgtattttccctctcttgctgtctttaggatcctttctatatcattgatctttaggagtttaattattaattacctgaagtagtctttgcattaaatcttcttggtgtaaaacttccttttactttgatattgatatatttttctaggtttggaaagttctctgttattattcttttgaaaaactttctacccctatctctttctctacctcctctttaaggccagtcactcttagatttgcccttttgaggctactaatatttcttagatcctgtgggcatgcttcgttgttttttattctttgttcttttgtctcctctgtgtattttcaaataccctgtcttcaagctcactaactttttcttttgctagattcattctgccattaaaagactctgacacattcttcagtatatctattgcattatttaacttcagaatttctgcttcattatttttagttatttcaatctctttgttaaatttctctgatagaattttgaattccttctccacattatcttgaatttctttgagtttcttcaacacagctattttgaactctgtttgaaaggttgcatatctctgtttatctaggctttgtcctgggtgacttatttagttcatttggtgcgatcacgttttcctggatggtgttagtgctaatagatgttcttcagtgtttaggcattgaagagttaggtatttattgtactcttcactgtctggaattatttatacccatcctttttgggaatgctttccaggtatttgaaagggctttggtattgtgatctaagctgtatgtgctttagggtacactccaagcccactaacactgtggttcttgcaaactcacagaggcaccacctcaatggtttggacaagatccaagggaattctctgtattaccaggcagagactgttgttctgttcccttatttttctcaagcagagtccctctctgttctgagccacctaaggttggggatatggtaacacaagcaccactgtggctttcaccactatgactgcacctggtcagacctaaagccagctcagcactgggtctcacccaagttcaagctcagcactgggtctcacccttgttcaaggacctgtggctctacagtcagccagtggcaaagccagctaggtctatgtctttcatttcagggtaacaaggtctctctgggaccaggtgggtacagaggtgccatctggaagtgagggactacagtcaaaaaccttagaagtctccctgctgttctattgtaccacgactgagttggcactcaaaccacaacatgcaatccttcccttgcttccctctactttccaaaggcagagaagcctcatcctgtagccactgccatcccaggccacagggagtcctgccaaactactgctgatattcccttaagacccaaaggctcttaagtcagcttgtggtgattgctgcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacctcctcactcttacctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagagttgtagtccttatggtctaggctgccttttaagtttacttagagacctagagcactttggcccttggtggcaaggtttgtgagaattcaaatttggaccactgggatcagtggttccccaccagatagggctggtttaaatgctccctctgtgggcgattgtcagctgcgtttggtctggtatttctttctgctctaacagaacagcactgagttcaatggctcacaattgctgtattcttcctcccccagtgcccagagaagctctctgtaccatgaggccactgcagcagttgggggaggagaagtggcttcggtgattcaactttttttttttcttttaatctcttcagtgcctcttttggggtatgaggttcaaactaagtactatgagtgctcacctgattttttcattcctatgaaggtgttttttctttgtagatagatgttaaatttgtgtccttgtggggaggatgatcaatggaagcttctattctgccatcttgctctgtctttcattatagtattttttttcttttagtattgtggcatatgaaaaaatatttctgaccaaccacccataatcatttttatctaaactgctatcagtcattaaaaatgtctgtgtttcattgagcaaaactgggaccagtgtctttaagcttgtcacttgctgggtctgtaaagaattggttaattggatattaatggaaattttagttattcgaatgacttacatggttgctgaatattgtgccataaaatactggttctgactttcaatacatcattttaattaattttggtgtaatttcatacatgttattaatctctggatggaggttagagattatattgtattgatgccctgattaaagtgtgttatattcactgcacttgaagaaaaaaatcactagtagtacaaaaatatcattgtttctcttaattcaacttgatcccaaacataacttaaatcactcctagcttcgttgctatggggcatagtatcttaactagaaatattaaatacttctagtaaatttgagtaggtaaagactccctaaatatataaacagtagttatgcttacagaaaattggtggcatttttcctatcaatgagttgttttaagatgagtcagagctaatgaagagtcagaaatcatctcagaagacatggtactttcttctaaaacagaaacagaaactattaggacaaatggcaatgaattctgcctccccctaaattaaagcaggaaagtatgagtcagaggtaaggcccttttaacatctccagatatatcccatggtgtcaggccaactggatagaccttataaatggacttacctgaagctttctttagcctctctgtgcatggcctcgtattttctgccctaaacttttctctttttacttcaattatcacttatcccggagacatatcacgactatcccatactccccattccttgactagtcttacctccaacaaagaagaatatgcactttagttaaaatccagatttataaaaaaagacacgtctatgattcccagtcctttgcctccactgggaaaaaattttttgatctgtttgaaatgttcaagggaaaaaagacccaagtttgctgcctctcccatgccatccttcagcttcacagccctgcctgtggaggtttgattctacttgggctacatcctacttctcaaaaaccaggtcactgagaaatctgggactttcattcatatatgtgtccaatgttttagtgaccaaaaataacaacaacaaaaaatctaccacaagattctgtcattcacccactatagcattaatgacttccaattattcaccaaggacttgattagaatgagccatctctgactagttactgccaatttgaaagtatttacattaaagagcaaaagatacgaactattcttacaatgcttacccatttccaaaagaatgtgatccacagacaaatttgtcatttaccaaacttctctcaccaaaatttgccaccatctttattatgacgtccatttaatcaatagtcagaggccatgagacacagaagaaatggccttctcatgtgatagagaaactgaaatcttcttttggagaaaaggagatttctggactttgatgatagtagatccaaaagaaactggttgaggtcttttatcaatttagaaggtagaaccaatcagagttagaagcacccaagaagtcctgagacttaaaagataaaacaccttcatatgatcttaaatttttagcactattttcccttcttgaagttgtattattactgacttcctttacctgaggttttctctgacatacaatgaaccagaagcaactttagttttattttcctgatattaataagcaatcagttaggtttacagcagtgtctattagtgaaagatcatattttcatttttgattactgatttttttaaagtttaacctaatcacaagttttcattaaaatttaccattagatcattaccctgcttctttaaaacaatagttcagataaagtacacctgcaacataaaaagcttttggacttttcttacaatgttcttaaaggacctttttacaagaaatttttaagaaaatcttctaagaaatgtaaaatactttataccagctattgaagaatagtaacggtgaattttgttttgagaacctgactcaatttatacatagaaataatagcactcaatatttattcatattcttaaatgagcaagttaaaattgtatttaattatatactcttaaaattttagatggtatttctttggtttcttttttcaataaacattacttttaggggtggtagttttgaagggagcagggaagaaatctttttatcagtagctcaatattctgggatcagaaaacacaatagtttttgttttgcttttgctctttttgggcagtaattacctgataagtttctcatactgagagctctgcagaatacagagttcttgccagcatcaaaaggacttccttttgagaagtaaccatatttcagtgaaaaaatccttgaactaaaaactaagagacttggctttcaaatcgggttctgtaataaaccagctgtgtgatcacgggcaagtcacctaaccttactgtgtcttagtgtccttttcataagaggagaagtaaggctagatgatatctgaagtcttttctagtactagtattcagtggttgaatatactatatttttgttatgaatgcagctcatctaacttaagcacaagagagcagctgctaaaaagagctgattagcaacaattaggagtggcatttcatttgtattgcatatcttcccaattaaaagcatttagtgattaaaattacatgcttgaaatacagtctttaaaaggaaatattttcaaataaatgaaatctctgggtcaaggccaatttgtattttaaacatttgcataatattaaagagttttgctgtagtataaggcatgcttagccattgcaggttttagaatctgaagcgagacagagatagagtcaaagagcgagatagagaatgcaagtgcacatgtgagcacaagcaaatgaaacaagtaaaaaagagaattctgaattattatgcatgctagtaaaaaatgattggttcctcctaggatgtttacagaattaatcagattatatcttgtgtttcatttctatacttcacattaagtcatatgtttaagattttcctttctctctgaaagccaaaagctgacttttcaaaatcaagggaagaatagactaaaaaaaatggacctgaaaaatagatgtgcttcactgttctcgtggatataacaaccctgatgtcttcaattaaatctcctttgttccagcttaaaacattgtgaatttaaattaacactttaagacatttcaatctgagtgcacattccaaataacgtaataaaatcatctgattgttctctcagatggagaaaccagagtagtgatagtgaacacaaggccagaaaaaatgaaatggtatttattatatattttcttataaaaacaaagttgggggaagtacacattaaaacagaacttagtacaaaaattctatcattttcaagaatcttcctgagtgcctactcttttgtcaaaagggaaaaacaaagactgttcttaattttgaaatctgacacaatagggaaaaaaaaatcaatgacagaaattcctattctttggactaacatttaaaaaaaagaaccacatgctatgaatagtactgttctacaaaataggttttgctaagtcctagtgggaaaaaaaatacatgtataatatcttaaaccttgtatgtggctttatcaaaattaacaatactattattaatattttaatgtaaacttatttcttcctaagagacatagtgttttcttacccaaagggagatggtgttttcttacccaaagggagatggtgttttcttacccaaagagagatggtgttttcttacccaaagggagatggtgttttcttacccaaagagagatggtgttttcttacacatcactctcctttccttagtatgactttaaagtagcgagggacttggtgacattagggttatcggcagatatgtgactaacggcttgggacattttattgtaatccgttttttattgtatttcccttgacaaggctacaaatgaattctgaaataaatgttctagaagtagtgcatagactctaaaaggtaccacagtattgaatatataagcaacagttgcttttccccctaatagttttagacagcctatagcaaaccaagaatttttagtggaatgaaagtgaatttatgataatacttattatatctgtattgagaatattcaatgtgtattaaagtatttccttagtgttttctaaaacagccattttattgtagtgttatccatttgaatctatgttcttgcattcctgtggcccaaagatgtatcagtaatactaagagaaaagtgaaaaaaaattaaatatcaggttagttattgataaatcaagcagtggtgaaagtcagaaataaattttgagtctttccaccagcattcctcgatctaaagagtaaatggcttttaatcagttttagaactagatctctttggaactatttttagtacttactggcactgtatgcattttctgggcaactgtaccagatttatagctctaaaagtgctgtgttatttattgccttccaataggcaatgaagtggtgtcttgcacatgcatgtgtcaaaaatgttaaagttttctccagttgtctcgttaattctttcccaggacaatagacaaaatatatggctctctatttggcaatgaatatcctttatcaattttttaaaagaaaaaaaaaacttctcttgcaaatttcacatccaacgtcaactttctcttttttgattttacaaatctccacaaagaattaaagtctcagaagggctttatcttgcttatttcagcagtttttgtcttgggtttgcaatcctaaagtttatttttgaatttaggaagaaatatcactcacaaatgaaggttattaggatgaggttattagaaagtccatgcatttttcatgacctcaacctgaattggcacttttgtatactagagatcaatgccatttcagatatcagaatccaaaaatcaacatatcatgtgtaaattattcttgcatgcagttcttatatattattttcttccctgatttttgttttctttgttgatcacacgtatccatgtttgacagatgtagggttttgcatcttttcaataatgcactggctacataccacacttagtatttgtcataatttattctgaaaatcaagttttacaactaggttgtaaaattttactagcaattgacactttggcttttattacatttttgaacagaaaagaagtagttgtttcaggaaataattttgaaattgttttctggacagttttattaaaataaaagacaaaaaaaaaaacccaagtcaacaattatagagtattcctgtgcctatacagactgagaattaacaacaaccaaattctgctcttcttttatcttttaaaataagagccactactttaattcatgcatttatttatctaacaaatgttttctgaatgtgttcacatatgccaggtgctatatctttagagattatacatttaaacaaagcttcatgccatattaccctacactcacattatttagtatatgaaggcgtacctagagatatacacatagagagtttgcccctatacacagaaataaataattttaagtggatttggaattcagggtagtgcaggtcaattcttccaaacttttaacttttttgtatataaggatgtgtcgatgctgaagatagggagatgatgaattaaggagccatatgttttatcttctttttcatttttctcactgtcctgctgtcatggtcaaacatatggcaaaaggcttcagttttttaattgctcatgtggatgtgagctcagttgaactaactacatttggggtaggactgatgttggattcatgtgttagttattctttattcctgaaggagattgaacagaaaacagtcttggaatcatcattcagtaataatagtaagctcatgttggtactatactttgacgtcaacttagatatctcaccaaaattttgttgaaaattatttatgtcttaacctgtgggcaactcctgttcaaatcccgtggacaatattaagtttaaatatgtttgctcagcaagtctttgtagaactctaaaaatctggaaaaatgggggttatgcatgcaatcacctggctaatcatagattctttttaaagaaaaacatgatgtcttaggatagtacagttcaatagaatttgtgcaataatgaaaatgttctacatctgcagtgtccaacgtagtagctactggccacatggagctgttgagaacttaaaatatgggtagtgcaagtaggaactgatgttttaaattaatctaattcatttaatttaaatctaaatttaaatgctcctttggggctaattaccatcatattgaacagagtagttgtgaaagacagaatagcaatggtgacattatccattaactaatatgtacatttcattatcaccttgagaattagaaaaatatatttttaagattattgccatttcacataaagtaattaaaagacagtgagtatgctgatcttggatttttcatctgacacaagcttgccttaatttgctttggaaagcaaaggccaactcaaaattcagacaaacacataaaagtaaaaactaaatatataaacaagaaatgcacaaacataaatacataaattttaaaattaaaacttacatattcgttttcccagatgtattgtattcataaattggataattggctccgaaacttaagaactttggaacattttccttgttctttttatattatattatctttgtttctgtttatgcaacctctaataataacttacaatttccccatatagctcttattaaaaatgtagtgattctcttaatgtaaatccgttagtgtcaataccatcattaaatccatagttattgatttttctttcaccttaactagaacttaccttttatcacattagtaaaatatgtttactcaccaccataaccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttagaatatcattacaaaaattaaattatcattaatcactaaatttgtttagatcaaattatagtagtatgttatggtatttacttacattcaatgttgtcatgaaattctattttttcttaaaatatgcagtatatcaaataatagattttgcttgctaattttcaaatataaatacgtataacatgaaaatgtttttcttactatataatcaaggaaaagccaggttgattattgctctatctgagtaaaataggaatagaatgctcacgtttattgtatgaattaaaaacaaaataactaatatactttggttagctcttgtgaaatgtttttttaaataacgttggaacaaactaatgattttaattaatatttctgaaatgccatcttaaattttgtaataaacatctaattcctccacaaagatatattatggcactgcatttgaataaaagtataagtgaatctcagcacccccccaaaatctgaaagtttgcagaaatatcttcaagtaattcataagaggaaaaaatgagatgcatttggatattgtttaagactatatataggcaattataagacaggtaaattttttaaagataatgtgattgaaatacatttataaactgatcatatattctagcagtctctgaaaacctggtattatttattaggttctaatttttaggatcttgttttagacagtggtatgacaaaactataacctcagatcttatcctgttcttttatgatacagcacataaatgagagatcaataaccaatccatgccacttgtccagaacatgtatgttaaaaatgtagtagagaattaaaaattatttagatgtacgtgtgtgtgtgtgtgtgtgtgtgtgtgtgtgtgtgtgtatctgttcataaatcacccatgaataggaatcttaaagtcctcctccgatcttttcttcataccctccagtacctttttatctcattcatctctgtcataatgctgcaagtaacactggacaggaatcctcctctctcatttctcctcggtgagctggcaagatcactacgtttgtgtgtagggatcatcttattgtagtacagggaggggattttttttttttttttttttttttttttttttttgagacgagtctcactctgtcgcccaggctggagtgcagtggcgccatctcggctcactgcaagctccgcctctggggttcatgccattctcctgcctcagcctcctgagcagctgggaccacaggcacccaccaccacgccaggctatttttttttttttttgtattttttaagtagagacggggtttccccgtgttagccaggatggtctcgatctcctgacctcgtgatccgcccgcctcggcctcccaaagtgctggaattacaggcgtgagccaccgctcccggccgaggggattgttttttaaatattcccatactgtgactttgtgggcatgaattgaaaataggtcctatccgaagctacctttttcaatttgagatcttgacctgtgaattttagttccttgtgcttgcatgttaaaaaaaaaaaaaaaaaaaagtaagaaaataacattgcattgttaatctctgagataatttcattttaactgtgtgttcctatgggaaatattgaaattctttgtattttatacaaatttatattttaaccagtttgtgtattttttttccatctgctaaaggttttagctgtatttattagatatgatacttatgatgttgtcttggaggaatatttttatttcggtgcttactttagtactgaaaaagcatcttaggcaactgaaatctacagtaaaaaatattttaattcatttggaataatcttggataattcgcttacagcttcatttatcttgcaaaaatttagtgacaattctttttaaaatatacttttttcttttgaaaacttaaatagttcgaaaaccaaacattgtgtgttctcactgatatatgggtgctaagttatgaggacgcaaaggcataagaatgatacgatggacattggggacttcggggaaagagaaggaaggtggcgagggataaaaaactacaaatatggtggagtgtatattgctccagtgatgggtgcaccaaaatctcacaaatcaccactaaagaatttactcatgtaaccaaataccacctgaaccccaataacttatggaaaaatgaaataaaaaattaattaattaaaaaaactgaaatagttcacataatttaaaaaaacttaaatagctcacataaataagttacatatattaccataaaatgctacaatctgaagcctcctgtccccagaacatcttctagtacagttctctaattttacaaatatcaagaaaagtaaagtaacttgtttgtaatcacgatatttgttataggcagagttgagacttagaactgaagtcttctggcacctatttctgaactgatcccattattttatgtggcttcaagaaactgaaaattgttctcattagataagctaacataagttaaattatattttattattcacattaatattaatatattaatttatattaacataagttaattctgtttcattgcatgttttccagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattcttaaaagataataacttttggaaaataaaatgtttgctttctctaataggcacaaagaaaactgtgggcatgttaagacccaagaaatctgtgcacaataacttaaaacccaatacatttatgaaagcaagagtttatccagtgccttttatcagtgttccatgaagaaatgaatacaaatttatccagaaactcttaaatgttgaatgatttaaatataattgttccctttaaaaatacaagcaatggaatttacccacatatttttctcgaagtcatgctacatgttgagtttattattttgtttgtgttaactcttaaaaaagtattaatcttagtttcagggaataaagtcttttgaacacctattcaggcttaacaaaatagtagcaatgtgaaaatcaaaactgattttctttcaccaaaagttcgagatattaaagaaggctactggattcaagatagcaatgcaaatagtttaccataactttggaaatgggtttaagaatggaggtcattcaagcataagcgcagttatataatacgataacattaacttttctctctgaatcacacagtgaacgtaaggtactaattcagatgtgggtgcatttttgttacagtaggtacacaattaaatgctgtttcaaaaggtaaactagaaccctagtgtctgtatagagagcttctgttagactttaaaagaatttacgctgcagttgttatttctacagtttagatgaatcccatattttacatagttagtggatctgggatgggcaacaaacgttaagagatgtcgaacatctccacagggtgtgtttttgtttatatttaaccattaaaaagggcactctcattttcaaattcttattgctattctgcttattggataagtttctcaacataaaagtatcttttatgactaacactacatgatttgggtataataacattttttcctgggtttaatttgtgactttctttaagaagtgtacaaagagtgggtttgtgaattacatatgtagatcatcatttttaatagatttaatgaagttaattaataaagcaagttctggtttcagtgctttttgaaggcacagagatattttatgagctagactgattttacttgagtttatgaacacatagcaaggagggcatggatgaagaacaaaaaactgaagtatttttcaaatatcctcacttttttgtttttttaaaaatattttgtaatcctaaaaagtcattaaaaataataaacctttttccatgacgcattttatatcatataactaagagacattttctgaatcataagaattagtcaaaatacaaaaaagtaaatgctaatgagaatcagttattggttgttattaggtttttattaactgaaaggactatcttagaatcattgaattagcagatgacttattatttcacagcttaaaaagtaaataaattatatattttattattggttcacagttgtttcatattcgttactaaatatcttcaagacatgaattggtgaacttaggcagactaatatgatactaaaaataatttgaatctttacattttgtgctacatttgcaatgttctttaccttttctatatgctcttcaatttgtgtttaatgttagggtgttcactgatgttgcagaatgctagcaaaataagtgagcactgaaaaagaaattatgtatttaaaaattcaaatgcagtaggtgtcttctttttaaagaaatatcatacaaaatgggagaagtgacagccaatacaatacaaattcattgttccttaaggaaatacttagagtggaataaaatattactgttagcagaaggcagaattattccaatttattttaaacagtgagaaatgcattttcaaaatgagggtttggggaatatttacatttagttcattactcgtctgaatagaaacaggaaagtggaaaataaaatgttctagtagactataagagacaagggaattc

SEQ ID NO: 741 - DNA, 11585 bp, Human; identical to SEQ ID NO: 588

SEQ ID NO: 742 - DNA, 29373 bp, Human; identical to SEQ ID NO: 576

SEQ ID NO: 743 - DNA, 5355 bp, Human
  misc_feature (1)...(5355): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcaccatattggccaggctggtctcgaactcctgacctcgtgatccgcccacctcggcctctcaaagtgctgggattacatgtgtgagccaccgcgcctggcctaggagtagtattaagtggcccaggcaagaggaacatattcagactcggaggaatgaaggatgaaatgtggggaggggcagtgtctatgctgagggttatttccaaagaatgagaggctgggctgaacattgggcaggaagttagcaaaaactaaggagggtaggaatcaaggttagagggaagagaagaatgaaattgagtagggagctgagaaagcagggcgaggggcatttggacttacattttcttccagcaaaggtttcttatttaacccctgtgggcttatcttgcagccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgtcaatccacaggagaagagacttgcagcaggtgggtagctggagcaaactgggcctggggcacaggaaggggtctgcttgaagaggttgggtacaggaggtggctcctttaccaggctgaggctgagggaatcctgttgggctgagagccagtacaaatagtggagccactcacactggtggcctttgccctctcaccttgcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcggacatgcttttctgccactccatattaaaacatatgaccattgagtccctgctaagtgcgaggctctctgtgctacaacagtagcaactgggtttgaatttctttctctccaaagaatgtgtgcccctcacgaggccaaaagggtgggatgtttcctcctctgagggctgtccaggaccggagtgctcctgacagctgtctctcgggttctgagctgcactccactctggaagttcttcctatccgacctctaccccactcccactccgtcaccgcagggctttggcatactaccattcaggtactcacgctgtttcggtgagtcagggaagctgggaacgccagctgaggcatgcggccccgccccacagccacactagcagagacgtgtgggaggctgggagggaaagttcccagtaacaagtgggttggaccgggggtcagtgatagaggcgtcagtggattggccacgtcatgtaaagttgacccgagagggagggcaaaagaggaaggcttggtgattcctggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaaggcgcacaggcctgtgggaacacgagcgttgagactgggggcgtctagatgatccaaggggtaggcagagtgtgagcagcggcaggtatcggggacacacccgcggagccctaggaaggggactgaccgggacatggaagaggtctggaccaaggtactgggaaggcgctcggaggagaggggcgcgagttccggttcggcgtcggagggagggtggggcttcggcgcagtttccggagggacggcccgagcgtgcgggggcggagccgagtgcgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctgtgagagtgcggccgggctgggttggggaggactaggcagtcaggaaaggagagagaggggacagagacgtggccacagcacctggctcgtccggaaccgggatcaaagtgggatcgggtcgaggggaccggggtacaagggcgaggctggtcactaggcctgaaggagaaggcaggatagctggcgggggggagaggggggcggggtctgcggtggtccggaaaggatgacaggcattgggcatccccctctagcactctgcttctcccttcccacccccacccctcccttcggggccccattacagctcggacctcaggcacatgcgaatgacccggagtgtggacaacgtccagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagaatggcgtgaacccaggaggcggagcttgcagtgagccgagatcgtgccaccgcactccagcc

SEQ ID NO: 744 - DNA, 7968 bp, Human
atatatatatacctatatttatatgtgtatgtctagatctatatctctacatctccatcgctgtctctgtctagagatagagatatcgacaatgagagagagagggaggtaagagatagagatgatggagatagatgagctagcgatagagacatatccacagaggaaaacctaccactactttaagagagaaatctttttcccaagaatcaaatccttaaaggaacaaacactgtaaccgactatatcctcaataattgttttaaaacaaacgcagcagcatttcatatggcatttttttccttcttggtatgagtcaaggacaaaacaaagtcaaggacataacaaaaatgtgtgagtaaaggttattttgaatggttgggcagagtggagacagggctgggactgagctaatgacatccaggtttgccgctctccaagcgtgttgcacaatgccaacgcagaactgagaatccctaggatggacggaagagcttcagctaagacttacctccttacctgttccctctgcctccattatgaacatacggcacatgcgcgcgtgcacacacacacacacacacaaactgctgctaggatattaatgtgcagtttgttagacgagattccccttccttctcgtcctctgatctggtgcttttccttctcccccatcttttgtctttcctgatctaacaaggctgtggatcatatgctgatcccatcacagaccagccctccgttaggttcagtcctcagctctgacacacaggcctgctggagaaaccctccaagcgttggtggatcttgcaccttctgtgtgcctgctgtctaactactgatgatgtggtcactgcctgatggggaactgcatcagctctgtgaattcttgcaatctattgcctgggaaagtgtcttgcacattaaacaggtagcccataaatggatgaacgggggtgggggcagaagggtggaggttggagggattcatctaataagggaaacaagcagaacagcctacaaaggcttaagaacgcagagtcctgctctgcagcccaagcccctccgtgggatgaagtgccatcagatatttggtgccatggagagttgatgaagaaagccttccaaaaacaatgaaattgttttttaatttattttaacttttagagacgagatctcactatgttgcccaggctggtttcgaactcctgggctcaagagatcttcccaccctggcctcgaaaagtgctggcatcacaggcatgagccaccacacgtggccaagagcaaaagttttaaagcaggacactatggcctgatggacaggagagactagggtccctcctccctcccaggggcctggcttcatctcagaaaaaccgagtccctcttgctccacacccgcatccttagcttcagccctggcagttgtgttgagcagatgctaaggagatggggacattttaccccctccgcagccgccccagagggtctcaaacccagggctgatttagggttgccctgacatggccaaccctattctatgtccaagtgtcattcatggctaaagcaggccagggccccaaggcaaccaagctcctctctcctctgcccgctcccacacaccctcctctgccccagtgttcctatcattacgtcctgggcattgaaacccgggccattcttggaccagggctgtgggctgaatgagggcaggaagaacagggtcaatgggaaaggacagcccagaaaagagaattcaccaccacctgtggtctcccactgctttggtaggaaccttgtaaacacagcagcagcccccaggaaagtcttggaagaagggagaagctgatcagatttagagactgagacatctgggcctccaacccaaggctccccgggccctaaaaagccagactcccgtctccttagccctttccctcaccgaccagcaggtggcaccacaaacagggatttcaaaaccaaaactaaattaaagtggaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtgagtaagggtgatgggcacccaggagggagggagaagccaggggagaagccagggcatgggaggcaattcagggagacaggaacacccttctctcttcacacacctcatcagttccactgtgcacacgcgtggacacacacaacacacgccccatccctcctcctagggatcagaggagacttcatacatagatgctcatgccatggtcctttcttccctctgggctcttggcagggagcagcgagaggaggggaccccttgcccaggacgggacactctgtgcctgtgtcccccactccacagatggtttctcccagacgctcttgctgaacctgtgggagccctttcagagacccacgggtggaaaccctcaccctccattaactggtcccaagccagtcctattcctggaaggggaggggagggacgcgtccgggcaggggaggaggctggaaagggagtgtgaggggagtgtggtggcctctggactggacactgccctggagagtgacccgatgcagcagctgcacaggccatcctccccacccacgcacccctgctgagaacatgtctgtgaggttcagggtgggcagagaggagaatgcccagtggtatggccgtctcatcccctgccacagccactgcccacatggcaagagtgctgaacccctccagctccagatactctcttttgttttggcaggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaaggtaggggcaggatgggcgggcagaggggagacaaaactgggccctctgggatctgggatctgtatggcatgcacacccccagacacagcccagccccacaagagctgatggccaacggcctctctgagagcccggggatgccctggatgggcgctcactggtgtagaggccctcggtgagcactgaggggagaagcacagagaaggaaggggacaggacccactcaggaaattcaacatccactgagtcaggaaaaccttccccatctgctgtctagctgagagtctttgggaaaccactgtgcctcagcttccctgtctccaaggaaatgattgacatggctgcctgcttcaacaggaacacagggacatgaggaggagaaatgtgggctctggcagcacaggaatagccttcagcaaggacagtgtgctcagaaccctcacctctgtggcaaccaagggtaccttcccaggcctgtctttctctatccagtaaaaatgagattcagggctcaagcagagcctgcgaaggtccaacaactaccattcccaggagacccctggagattatgcgtgaattacatgacaatggcacgtcttaccggctcagaagacttggcgagtgtgcagtgttgggggagggcgtttgctggcagagtcaaggagaggttgaggaggctgtgaggaggaaggaagagggacgaggcagtgcctgctgacactgagatgggtgggcttcagggctcatgttccgccgagggcatcaggaggcactcgaggtgtgaatggtttgattaggctgaggtggaatctgaagacagaaaataaagcggagctgtctgagctctgggaatgaggggcaggtaaaggctgggtacagacaaccaggaccccaggggaacaggccataggaggtggtggggatggagaaggacctgaaacctgccagaggagcagaaaacagggaaagggtgaggtacccagtccaggacaacacgcaaagagtgagtcagtgggagactcagggaacagctgaaagtcacatggggaagtttgcagcagctgagcccagcaggtagtgaccagccagagccactgtggtgcatgatgcactctgggcgagacaaggaggaccatcactgagccaccacgtgcgccactccgcaacagatcttcttcctaccccctgtccttcttccaccagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtgggtgagtagccccccagggatcccttttctctgacctcagccatattgaatggggggccaagaaagggaatcttgaatgcaaagaagccgaaagcctggctttccttgttcctcccctcgagagagcttttcctaacgaggcctgtcaacctgggctctgtccccatggagcagtccccagagagcattggagaggcctggaggtccaggtggcctaaagatgcctttgtctttaggtctctggtgagtgacctccctaagatcagagccactactcaggtctcccagcagaagcttaaccctccttcctgaatgccttccagaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccagggtgagccagagtggtgtagcagaggggaaggggttgagccagggcttgctgggccagctggagtcccccgtaatgccctgtggctctgctctcacagctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacaggtacagccgtcctacccctgaaagaccccttcctccccttctgtctgcacttggctcctcttgtcccaacttcctcctggatcccctggccagctggggcaggaacggccaacatcacccatgggctgggtaagttcccacacaactagaattgggtcatggggatcccttttcaccttcccctgaaaacacacataaggcaggatttcatcaccaccaccaccaccctggccaccaggctactacccagttggccctgtgtaaaaacgtccaagctgaaaaaaaaaaaccctcctcccctactagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagagtaaggctccctgcaggcctccctcgatggccagcaatggggaaaaggggggaagaaggaaggacaagtggctctgaaataaatatgccccctggtctccccaacagtcatcaagtgcccccagcccaagaccctagacgagttcaccatcatccagaacctgcagcctcagtaccagttccgtgactacttcattgctacctgcaagcaaggctaccagctcatagaggtaagagcccagggctgaggggagagagccggcccagcaccccaggaggaattcaggtggtgggttcacagaggatttagtctcaccccagctggagtcgtagacgtttcagctggaagagtctcctggtccaccagctctcaaacttgctgcacacttaaaacagagagtttaaaatcctggaagattgcttgagcccattcattcaaggcccctgtgaatagccactgcactccagcctgagcaatatagcaagactctgtctctgaaaaataaaaataagcaaataaatactgaagatgagggcccccaacagagactctgattccattgatctagagtagagcctgaacatcaagactatttaaagctacccaggtgattctaatgcacagccaagtttaagaactattgccctagtccaataactcaagagagctgaaggaactgaaaaggcagggtggagatgtagtgactcgtcaacatcacgtagcgattgtgtacggcagggactaggacgccaatctcctgcctcctgctccggggctcttttacacatgttggtggtctccccctgcgcccaccgtcctgtcctcggctctgcagattcaggagggaatatggttttatccattgatcaatctcacaaaagctggtaaactaaaaatctctgtctctggacagagacccaagactggacatcccatcgttgttcaacaggtccacatggaacacttaatcagaatcaaagaagagacctaggatatgtccttaagtcacagttaattcatttaatgcacactttaagtgtctactgtcaggcactgtcctagatgtgggaggttcagtaaaaagaaacccacatagtcacacagcctttgtggagctcacatttgaatgttgcatcaagtcgagttcacctgatgcattgttctttactccaaggtgcttccagctccatcaggaggattgggtgggtgtcctgggtccagaagaatggagactaccaacctctttgctcctattacaaccctcccttgcctgcaccacccactgcccttacttttgcatttgttattcacatcatagaatttaaagcaagtcacacggtttctcacattacctacattttactcagacgttctagttctcatacacattctcttacaaccttttccagggctaactccatggaatgatttttggtctttttgttttgtcttgttttgtttttgagagagagtcttgctctgtcacccaggcagtggcatggtctcagctcactgtaaactccgcctcccaagttcaagtgtttctcctggattcaagctattcaagtgcctcagccacccgagttgctggaattacaggcgtgcgccaccatgcccagctaatttttgtatttttagtagagacagggtttctccatgttgcccaggctggtctcgaactcctggcctcaagtgatccgcccacctcagccccccaaagtgctggggttaccggcgtgagccactgcacctggccgaattttggtcttagtaaaacttattcatttgtccagtaacttttcatttcaaagactgccatttcctagtcttgtccctgctcaatagcaacagcacttcacatacatcaacgtctccagcacctttcaaagctgcgaggtggctctagtattttagggaaggcctctgtccttaggaaaactgcaacccaggagagataaagtgatgcacgcctggaggcaggggacaccagcaagagaaacacagttctgccctggagcacaggcttttgttttgatacagaaaacactcaaacgtggcttgtgattttttcaaattacaaattgtgggattcaactggacctcagtaggaacaggccacagtctagagagaggatgatcaggtctatcagttagctctgctctgacttgctgtggtgtggctcaatgctcctgtctgtaatgggctggggagaaggaagaaggagccacattccat

SEQ ID NO: 745 - DNA, 22347 bp, Human
aaccagatccagaacatttccagcctctcaaagactccttcctgcccctcccagtcagagacccccaagggtgacgccattctggcctgttgttcaacttgacttgaacaacccttcaagtcaagtttggatctggcttcttctgctcagttgcgaggcccattgatgtttcctgtggcctagctcctttttattgccgagggctactctgttgtatgaaaaccacaattcatttctcccttctcctttggtgaacatttgcactgtttccagcctggggcaatgatgagtaaagctgttaaaaacaggcacatatgttttcctttctcttgggtaattttttagaagtagaaaagccagaacatagaagtagatatttgactgtattacaactcaccaagcagtttttctttttattttttatttttcaattttttgagacagagtcttgctctattacccaggctggagtgcagtggcgtgatgagggttcactacagccttgacctcctggggtcaagtgagcctcccacctcagcctcccatgtagctgagaccacaggtgtgcaccaccacacctggctaatttgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcgcccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagtgagttccagggctatgggcacagggctgcctcagccagagggacacagctctggggctctgaggaagcaactcctgggtggcaggggatgggggtgggggcatcccaaagagaacacaagcagggcagaaatatcagaggaggtcatcctggcacacctgtgccgtgctgagctcactcatgcctggagggatgctccttcccacgagtcatggctttgacagtgttgactgagctgtcctgtcctgtcctgtcctgtgtgctcaggggaagacatgtagagcggggtggttcatgtaaagaggaagcaagcacgcttctgggacagtaaggacgctacccggcatggtagttaagggtgcttactgtgaaggtggcctccctgggtccagctatttactggctggtggtctctgggcctcagtttccatatctgtgaagtgggaataatacttgagccccccactcccagggttgggatatggattaaggaagtagtgtatctagtgtgtttgaacagtgcctgacacactgtaggtgctttgggagtgtttcatgttattgggtgtctgagggcagcagggaagacctcccgaggaggtgtctgtgctctgaaggttgggcatgggcatgttcagggcatctgtggaggggcagtctcagaggtgagaggggggtgaggactgtccctgcagcgtggggtcagagggcggcaggtgccttgctgaaaccctgtgaggtttatgagtccccttcatacacggaaaatctgaggctcagggaggcagaggccagttgccaaatgcctccagatgggagtggcagccccaggagcccaggagacttcaggggtcactgtgtcctgggccggctcctgtcataggatctcaccccgccttggcaaagagcttcccgaggggctggagagggtgggctgatgggtccttcctgggtggggaggcagggtggggagggtgggcagaggcagggtactgagggagggaagctgccatggcccacctcggcagaggccagggtcgggcttgagtgccccctggtgacactgagtccagaatgaggctgcctacgttctggtctgcagagctcggctctgctttctaaactccagagagaaagaatggggaaaggaggcctgtttcctcctggctgtcaccaatgacacctcagccaccctgtggaggcccctgaggtaggacctgcacagagggggctgggggaagctggaacaggccgctggtgggggccttagggtcagcaggtgctgccttgggcatgtcaccctgtctctggttttctgtcaaagaggggatcccagagcttcttccaggttctgacatattattattctggtgactggtttttactttctaatccttggattcagaaggaaaattatcctacggacatcagagagttaaaacagggccttggagtccagacaagaaagatgatcagtgcagcccctatgggtgtccagagtacccctctaccccacgggggctcccctgggttgggacaattaagcctcacttggtgacccatctggcagtcggagccacgcttcctccacatgccgacagtgggggaaggtcacgcggttcgctgtcctgctgaggagggctgagtgccatgagggcctggcttggaaacctcactcccacttcttgtctggcctcatctagcccagcctctttggagggcctgggggaagctggaaccacgtgctgtgtggtccaggaagcactgggagagccaggaataaggatgttctcagcttactcatgagaggaagcctgtgtggtggttagaagcgtgggtgctggggttcaaatcccagctctgttgctgaccagttgtgtaactttgagcaagtgactgaacttttctgtgcctcagtttcctcatctgtaaaagtggccggggttgctgtgaggataaatgttcctagtcatgcccagagccctcatggactccaaatgccacagcagccttagctggtcaacctcaaaacaacacatttgttcttacagtgttggaggtcagaagtctaaaatcaaagtgtcatggaaggtggccagcaggaccatggagcctctgaggcagcggggcaccttggctaagagccacgtactggcctcctgctggcacgcagtcttggccagccaggctgagctccccacttcggggtcgggcctgggtgtcctctggtgatgctgagtccaaaacaaggctgcccacattttggttcacagggctcagctctgctttctagacttccagataagaagaggaggaaaagtccccggtctctgggcactatcaggaacagagagcaagtcatgactcagcagagggatcgatttgttcaatgcaaagagctgcactgtcatgtctgacatgagccaggggctcagcacacggaatcgcacccagtcctctcagaacgctgccagccaggggctcagcacacagcgttgcacccagtcctctccagaacactgtcgggtggtgttactgtcctgccattcagaggagggaactggggcacaggcaggtcaagtgacttggccagtgtcagaattgctagtgtacagagctgggaggcaagcccagtcccgtgggaccataaatccagtgtgaaaatccatcctcctgcaccacatggaacaaaagcaggtccggttgttttcctgggttttctggacacacttatccaaattccacagcagccttggctggccaatcttaaaacaacaaatttgctctcttaatgattttgaaggtcagatgttaaaatcaatgtgtcagcaaagttgtttccttctggaggccccaggggaaaatctgtttcttttccttttccatcttctagaggctgcctgcaggccttggcttatgacccctcctgccatctttaaaaccagcagctttggctgggcccagtggctcatgcctataatcccagcactttgagaagccgaggcaggaggatctccttaatccaggagtttgagaccagcctgggccacaaagtgagaccacgtctctacaaaaaatagacaaacattagccaggtgtggtggtgcatgcctgtagtcctagctacctgggaggcggaggtgggagggtcacgtgagcctgaggaagtggaggctacagtgagctgagatcgcgtcaacacactccagcctggctgacagaatgagatcctgtctcaaaaaaaacaaaaaacaaaaaacgaaaacaaacaaaaaccccccaaaaacgcaaaccagcttcttcttgcttctgtgcttctgttgtcacatctcctacctctgacactgatcctcctgccttccttttataggatccttgtgatcacattgggaccacctttaaaatcaggacaatctccccatgccaaaattactaatttaatcacatctacaaagtcccttctacaacatattcacagtttccggggattcgaatgtggatgtttctggggggtggcccactggtaaccagtgttataagtttcttataaatccttccagatatattttatctataaataaataaatgcaagtccatagacttcccccacccactttttatacaaatggcatcattccatatcagtgctcagagttctgtcttcctctttttcttttctttttaaggctacacagaacctattaaatggaaataccctaatttatttcacctttttcctgtcagaggacttttaagctctttccaatgctttgctttataatcctttgtgttataatgctgcaatgaataaccttgtttgtaggatgatattcaatttaaaaactcatttttcaggccaggcatgatggttcatgcctgaaatcttggccctttgggaggccgagccggaaggatcacttgagctagcccaggcaacacatagagaccccatctttacaaaaaatattgtaagattagtgggacatggtggcctgcacctattttgtcccagctattcgggaggttgaggcgggaggattacttgagccagggggtggaggctgcagtgaaccatgatcacacccctcactgaactccagcctgggcaacagagtgagaacccatctctaaataaataaataaataaataaataaataaataaataaataatcttgtttttccgaattttgggggcactatttaagatattttgaaacctcacagagcttttttggggaacttgttgccttggagattagcctgtcctgtcccgcccccatgatctgtacttcctctttctccctcctggcttccttaattaagccttgtgtgtacttgccagcccatgtccatcacgctctgccttcaattctagatgctgtgctgtgaatacacttaagtggaggccgcatgcttcccaggagggtgtgtattttcagtgttgtgtctcatgatagtatgaaaggctctggagagaatcacaggcttccacaaacaggcaaggagaaaaatgttccacagacatgtttcagggaaaacaggcttcccaatcctaggccgtgctggtccataattggatcaggctgactctccttcccctacactgctggtgtagacagggacaagaatgagaagtcagagacacagagaagctgtgatttgcttgaggtcactaaagtacttaatggcagagttcagacctgacctgaggggcaacaaaagacacccccctcaaatccatggggagcagagtctaactgaatcagatcccagatttcctggggctctcacggtgccaggtgtgtacactgagctaggatgggtttcccagggttctgtgtggtcacacaactcaacaatacagaccagaaagcagtggcaagtaggctgaatttggctggtgggtgttttctgtttggcctgcacagtgtttcttttaacgttttattataggaaattcaaacatgcagaaggaattgtaccatcaacaacacacacccatcactctgctccaacaatgatcaactcaggcctatcttgcttcatcctataccctccctcgcttgcttccttcccaccctcagatatgtggaagcaaatccaaagataccattccatttcaaatatttcattttgtatctctataatatgggaatttggggggtttcaagacaggatttcactttgttgcccaggctggagtacagtggtgtgatcatggctcactgcagcctccacctcccaggctcaagggatcctcccacctcagcctcccaagtaactagagttaaaggtgtgcaccaccacacctagctattttttttttattttttgtagagatgggggacccattacgttgttcaggctggcctcaaactcctgggctcaagtgatccttctgcctcagcctcccaaagtgctgggattatagatgtgagccactgtgcccagccaggagcttttacataatcctttttgacaaattttcccccaagaaattagaaagttttatagaaaaaaaaaatccggacttctgtcttctcttaaaaatttggaagctctgccaatactgggcccagatggcaatcactgcttagcacggagtagatgttgacttttcagatgaggggtgtgacatctactttgccacagtccccaccactcccccacctggccatctcacccatacacatcacctgcctggctcctttaggcatttaatttgtgtaggaaattgacctaaaggagatattagagaagacattaaaaacttgaagaatgtgaaaatcagccaggagatagaactgtgctttaatgcgggttatagaacgacattggatatgaagcattttgggaataaactttgaaaattggaagtaccagtttgtgaattttgctcagagagatgaaggtggggggtgggtgacagtggtgaagcatctcctatgtgccagtctcttttaccacaggctgtttctcacaaaatcatcaatcatatgcagtaggagaaacacctttgtattttacggatgagaaaactgaggcacagagaggtgaaataggcttcccgaggtcactcaggtcatatgagcagcagagctaggattcagacctggagttggcctgactctaaaacgatgcatgcctcaccatggcgcattgctcctttaaagagcaccagaagagagaatttgacaaagtggttgcccgtggggcctgggatgggtggggaaactatgctagggctctgggctgctgagggcctgagggaaggaatggggagcccgggcgcagaagtagaggagggggctgccccacggctacagaaggcatctgggaagacactttgctgaaggtggccaggagggcaaaggtcacagtggccattgttatatggtggtggtggggagagggggatggcttcttcttaaccttctcgggtgagtcgaaggtttaccctccagacccttgatgggtcccttatgtcccttggacatcctgagtccccagccagggccctgggcgctttgctgggagcttgacataaggtccagcagcccccattgctacctaattccttagcagcccagggtgtctgcctgctacttccctgcctggaaggaaggccttctgcctggtgcgttcctgctgcagcctccactgcctcttagactctcacacaagctcagctccctgtcgcgtcctctcagggccaggcttctccttatcacaagcttagactgtctgagtaactaattggatttgtgtttgcctccacacaggaccctaagacccgtggggctgcgactccctctgtactggtcacagccgcaccctatccccttgcatggcgctgtcaaacccaggctggccactgactagcgctggaggggagcaaacgggaggccggccacctgactgatggtcccacaccttctccctgcaggctgtccccttttctgggactattcaaggaggtctccaggacggacttcagatcactgtcaatgggaccgttctcagctccagtggaaccaggtgtgtgtgtatatggatggaaacgtttcactccagcctcgtcccttagtaaaccactgtgcctgtgagcctgggttagttcaaacagcaacatccaagctcacgtgcctggctcaggggaggcccaatgcgtccctaacccatgccacagggcagcactccacaggcacaacctgcacccaggggtgccattaacctggactccaggatgaatggggccctgggagctgacggtctaaggagggcgtgggatggtcagagttggatgattatgttactgggttgaaccttgcacactgtgactaagagttgcaaaaatcaaacttcctccatttcccgtaactgctctcatccactctgaagctctccttctgctgatgtgaaaatattgaaaattgccatcaaaagtaatttggtctcttttggtttcaaggccttttctagaaactactaagtcaattcaacatactaacattgtatcagggctgtttcccaccccctcctccctcccaaggtgggctgtctgggaacagagaagagctcacatggcttctcagtggctgggagggctctagaccctcactcaggcctggctgacccctgccgaggcaccccgaccgggtggcacagaggtgtgcagctctctcctggtttagtgggggaccatgggtggctgcctgctgaactctgcggggcccacagaagagcctctggactcatgactctctctcggaagcctctctgcctcagtcccaggggacctctccttaagaccttctgggcctcacagatcccagctaaacctcagcttggacacctagattcttggtgacctcctccgccattgccatcctgctgtgggacttctctgagagactgcggtgccctcaggagatgccaagggcagggaggccccgatctccctgaaccctccaaccaggggaatcaggaccatgaccctgatcttccgccccttcctctctccctctccctccacctcccccaccccccagcaccaggagggcttcccactcccatcctgtcatatagagacagatcctacctcagagggccctctcctcttgggagctttctgtctctcccttccttggggcaggaatttcgaaaggactacagggatgaagctgaaggactccaaaggaaaaaatacatgcagatatatttcaaatgcaatcttctccatttattcatttaattaattaatttttttcttttgagacagggactttctttcacccagcctggagttcagtggtatgatcatagctcactgcagcctcaaattcctgggcttgagtgatcctcccatctcagcctccagagcagctgggactacaggagtgcactatgatgcccagctaattattattattattattttgagatggagtctcgctctgccaccaggctggagtgctgtggcgctatctgggctcactacaacctccgcctcctgggttcaagtgattctcctgcctcagcctcctgagtagctgggactacaggctcatgccaccatgcctggctcattttttgtatttttagtcgagacggggttttaccatgttggccaggatggtctcgaactccagacctcgtgatccacatgcctcagcctcccaaagtgctgggattacaggcgtgagccatcatgcccagccaatttttttttttttaactagagatgagctctcactatgttgcccaggctggtctcaaactcctgggctcaagtggtccacccgccttggcctctgcgcccagccccaatttcacatgctctttacatttgttctcttctttcccatttaatcaggcatgtgctggcctccaacaagtgtccactggcacagaaggctctctcttctaggtgtgcttaacaacttccatcttcggtatcaattggtaatcactttccaagacctatgtttcttgtttgctaataccagcacttttccttaaccgttttctatttgcttttagcaaatcatgctgtaaaggcaaaatccaataattaaaacaaaaacacattagatcccaattagaaaaacaaaaacgatgccaacaaagcagtctctgccatacaggttgtgtgcaagatccagacaaatgcaaagcacaggcgccgaggccctcctgtgcctgtcactggcaataatccatgccacagaagactatttgctttccctgggcctaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgagcaagaatcccctccccacctctcacccctgggacccccagccctatcaggtgaatggcctttaagtaatcacctaaattgacattcagccagagtgacaccactatacagataacacgctcatttccttgtgaggtgttacccatggctgcctagtctccttatgcaccttcatctgaatctacaggtgcacctgctgcttcttttactctgaaaataagaactagaggagtcatcacgttgctatttggtgttgtgtgtctttgaattccaagctcattccattcctctgctatagccattcctcctctccaggtcactggtaacatttatttttcagcgacatcgttccagcctttatccagggtctattaagggtatagttttgtaagcacattgcaaattacctttgcaagcagagtaggtctctgggcttgagaagcctgtgggtaagtcagtccaagtatgcttatctgagataaggatgtccccattcgttcagtatgcaacctgaggtcacctctcctctgctccccatgagcattttatgcatatataaataataccgctgcagccataaaaaggaatgagatcatgtcctttgcaggaacatggatggagctggaagcctttatccttaaactaacgcaggagcagaaaaccaaacaccacatgttcttacttataagtaggagctgaacgatgagaacacatggacaaaatggggggaaacaacacacccttgggcctggtcggagagggagagcatcaggaagattagctaatggatgctgggcttgataccaaggtgatgggttgatctctgcagcaaaccaccatggcacccgtttacctagttaacaaatctgcacatcctgtacttgcaccctggaacttaaaatcaaagttgaaggggatggaaatggcagatcacgcctataatctcagcactttgggaggctgaggagggcggatcgcttcaggtcaggagtccaagaccagcctggccaacatggtgaaaccccatctctactaaaaatacaaaaattagctgggtatggtggtgggctcctgtaatcccagctactcgggaggctgaggcacgagaatcacttgacccactgcactccagcctgggcaacagactgacattccatctcaaaaaacaaaaaaaaacagttgaaggaaaaataaataattaataaatgaaaccccaggtgagctaagactagaaagacaaacctactgcaggaaacaaccagaagaacgaaaagtccaactggagcctggtagagactcgggttgatgcactttgggtcacacacacgttcctgtaactggccccacactgaagaccagactcaggtcttcattttctagaaagagggtccaggagctcaggggtggtccccatcccagcctgggatgcctcccccagaacatgtgctctcctctggcaggtgatggtgaacgggatcctcttcgtgcagtacttccaccgcgtgcccttccaccgtgtggacaccatctccgtcaatggctctgtgcagctgtcctacatcagcttccaggtcagactgtccacctggcaccggtcccaggggctgggatgcagggcccagcgtagctgtgtctaagccctgctgggtgggcccaagccaatctcctacccaggtcactctggggacaacctctgcttccctgtcccagtacctgcccgccccttctcctctgtcactctgcccctccttctgtgttactgtctctgtccggaacacctgccttggtctcccagactcctcagctgcccctttctcttcatccctcagtttccatcctggtaaggagggcatattgttctagaaagagcccaggctcaagaaccaaactgaatccagttcaaattcccagctctgccattcatcatctgtgggatcttagacaagcaacttcacctctctcagccttggtttcttcatctgtagaatggtcattgcctgccccccatgggtggttgtgtggttcagtgaggagacagatatcagaggtcacacagtggcccccctgggcccacaccagggtctgtttgacctctgtgttttaacaactttgaatgtgttgccaacatctaaaaggtcaggagagtcaggtatggtggtggaggtctgcagtcctggctactcaagaggctgaggtgggagaattgcttgagcccaggaattagagttctgtctgggcaaaacagcaagaccctgtctccaaaaaactttgtttaaataataaaataaaataaataaaactaaataaggtcaggagataccaataccatgtgaaaaatgggaagattagggtatgctgggcccacattcccacagggcaccagcagctgggtgggagctgctgttacccttttggcattcgaggctgctccctgagatcagcgaagcacacagtaggccctcagcaaatctgggcttctcgccctttggtcctcatctctcattccctccttccctgactctctcccctgcgggtggtaggggagggaagagctggagggagaccgcacccctgcactgctcaccagagcctggctctttcccatcccatcttggcatggccctaacccccttgcctcatcgccctgcctgcctggtctctccctcttgcccctgcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggggcgcagacaaaaagtgagttcaacacagaggccctgggtggccgagcagacagtaggaaggaccgagggtctgagaggctggccccagccagcaggccactcagggcctacaggccgcatcttgcccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttcacagcccccagcccttcaaataaagcccaaattccccagcagggtatatgaattcctccccagtctgccccaatccacgtccctgcctcacccccaacccacgaagctcacgcagcctctgcagctcactcaaggccctcttgggccaccatgcttttgcatatgctgtccctggtcccggaagcaccctctgccagcctgccccgagcacatgcctaattgcccttccatgctctgcctaagtgccgctcctctgggagtcctccccgcctggaatattgttggacgctcccctggtgtccccacagagtctgtatgtatctgtgccatgccagttcacagcaccccattgtaactgtatttgcgtgtctgtccccgttactccacccccatgtccctatgcccatgaggccccagagggccaggactgtggcttgttcatttgcactgtgcctggcactcagtagggactcagtgaatgaatgtggaatgtggttcacacagccagggagaatgggataccagccagggcaagaacagtctactgggtggggcaggatccaggacaaggaggtgagcagcccttcctccggccactcaagtagtggggactgggaggaggggcgctttgtctacgcagtcttcttatggctcatcaccgtacagacagggcacctgcctcctgccacgctgacttcaggactggtcgagccccagggaacatttgcagggcagcccaactttggccctggccctggcgctggccctggctctggggaggatagaaagtgtgctggatacagtcagacagaactggctgccactttggatttgatcccttccaccttggcaagcttgggcaagttgcttaatctttctgagcctcgttgcctcactagggacacaggagctgaggctgcttcccttgttggaaagcactgaagcccaggaatcgacccacaataggccttcaacaaataccacttctcaccttatgggtgaaatatggcactggaagtaatgctcttcgctgtgggagctacagaaagcaatgaggtctctatcaaacccagtctcctctctctcgagaggaaccagtggggataccctaccccccaaccccaaagccctgtacacctgggggtaaaaatctgggtgccacgggctcaggaaggcttgcttgggagcaagagggaggtgggtgtgtccggggaggcatttctgagcacaagagcctccctggagttttgccaccatctcctcccattctgtggtgcccgcgataaccaccatttctgactctcctcacccctccagcctcccggcgtgtggcctgccaacccggctcccattgtaagtctcttgctttctttttggatcgtcctcattttggcttttctgggctcatggaggaggcagggccaggcattgggcctctcccattgggagtggggagggcacagaccagacccttgaccatctgcccggcctggtgaggttgggggttggatgtgggggttggatgaaacaacctgagttgccaccccgtgggcagccacggaagaccatgccccacattcacttctgtcacctgcaaagggaggctaggctgagagacgtttccccgagaggaaagatgggccagagccaccagcgtccccatctgtcttctccagggttctaacctttgcccctcgctcatccccttgagagaagagacacctgggcccaccctctgtggggtctgtggggccattgggcttgttacgccccctggagggtgcctgccgtgtggcgccctctggtgggagctggtggttttcacacgtgagagcctgggtgagacctggtttctttcttccagacccagacagtcatccacacagtgcagagcgcccctggacagatgttctctgtaagtctacaagttctggtcagttcacagctgcacagtgtcctccttcaccaaaaactaaactccctagagccctagagtcgggaagaaagcggtttagcaaggaggatggggacactaggggctgagtgcttggctcaggtgacatgtggctaaagctgtccttgggacagcagagattctggaagaagcagggtttatccagtggtggaagagacaagtcccctagagaccgggagggaaactggtccatctgtcaccaagtggggagtacagtggccccagcacccggatgtgaggttcctggccctgcatcctgggtccccaggatgtcactattgatcacaggcttaagctcttctcctgatggtgcaaatgaggcaggggggcttagaattagtggggctgcctgcggaggggttgaggggcaggtgaccgtggtgtggtctgggaacacggcaggaagttccaggaaggctaacatgaaaagggaggtagacgggcgagtccaagggccaaaggctcacgaggtcagcctcacagtggagtcctctctagaacgcgtgggtgcgcctgggtgagtgctcgcgcacccatgtgctctcccattgaatttcctggtttcttttcaacagactcccgccatcccacctatgatgtacccccaccccgcctatgtaagtggtttctcagggagggcagaggttctgtttgtggtgggcaggctgggggtgaagggccgctgtggggggatccactggccttgaaaaattaaaagcagtcatttgttaagctgaagggcttcaaagcatcccagcgaattagaaggctgtggagaggagctttcaaccttaaaactgtcgtgtcaatatgagcacattgcatgtccctcccttttcaccccacgaaacgagtctttttgtgtttggccaaagttcctttcatgacactaatctaagcccattaatttgaggagcactggaaagttttcctttggcttttatggaaccaagtaaagatatcatgggcttcttctcagctgacagcccaaattcatgggaactggtacaatcttccccttccgcgtggtggctgacctgtcccccttcttccgacagccgatgcctttcatcaccaccattctgggagggctgtacccatccaagtccatcctcctgtcaggcactgtcctgcccagtgctcagaggtaagccaagggctccagtgacctctgggaagagagagcccttcaaggtcagtccagccattcccctggcttcaggaaggctactgatgatggggaggaaatgggactcagaactcggtggataaaggttcaggtgggctgcccaccccaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtaaggcaccgcagtctggagcttggagaggctcccatgggtgcacagggggagggggtaaaggaggtttgaggtaccttgaacaggatgggggctgattcctctgggatgaaggcccaaaagaagagaaggtggccaacaaattattattattattattattactgtcccgcatgaaggaagtgctgggatctgctttttcagatgaggaaacaaactcacaagtgcaggttacttgcttgtggtcacacagtcagtaagtgtcaaatcagacccaagaaggaggtgttattcatttcttcatttactcaacaaccattttcttgtcgcctgctttgcgcaggaagcaccccacatgctgggggcacagtcatgaagcacacagacagggtcctgcctccagggagtttataatttaggtggggaaagaacaaggaaagtaaagcatggacagattgtcacagataacgacagtgccacgcacaaagcaaaacagagcgatgagatagagcgagcctgggaggggcagctagggccaacgtgcagaggcacgggtgtggcctgtccaggaacagcaggcaggcgtgctccaccctgactacatattcaaatcacccagagagcttacaaaggaaatatcagtgctgggaccccagcccaggccaatgaggcagtcagctgggcattcgtattttaaaaatatgccttaagtgattatactctgcagtcagagttgaaaatgactgatgtagggctttgcagccatggaaaggagcttggattttaacacagtgaaaagcctcaggagtgtttcaagccagggagcaacatactttgatttgtagacagctgtgtgacctcggacaagtgacttaattattctgtgcttcagtttcctcatctacaaaatggagctaataatcatgaatttcctagagttgtaagaatggaatgagacagtatctgtagtatgcttaggacagtgcctggcaggtggcatgtgtgataggagtgttagctattgcaaagggaaggaggttttaacatttgtaccctgactgcttcgtggagaaggcattggggtggaaaagacaagttaggagactgatgctgcaggagcccaggcccagagcactcctgtgtgctgggcctgagggatacagacggcacaggccagtgctcctgtccctgatggggtgggaacagtattctagaccagggaacagtacaggggaaagagcacgcacagcctgtttagtgaagagccgtcgttcagtggggatagagtgcaggtgaggggcttattaacaactgaggagggagggagggtgggagggagggagagaggaggctgcagtgagggtggaggacttcccaagtgtagtgcaaacggcatgatctctgcacaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtgacgtcctcagtccctcccctctgacctttaacctcactctcaccttgcaccgtgcaccaacccttcaccccctcctggaaagccaggcctgatggcatcccactggcctccaccaactgaccagagtgttctcttcaggggactggctcctttcccagtgtccttaaaataaagaaatgaaaatgcttgttggcacattcatgtgggttgaccgtggcttctttaattcatttggagacattttggagtctgtggaatcgggcggaggtgctgctgagaggagtgggatgggaaagcatggactccctttgggcagggggtcctgacctcacacctcctcccagagggtctcttgcaaatcccacgagggtgttggagaaagcaggctggggctctagccttttgggcaggagtctcggacacaggaagggtggtaatgggggacaccaggaaacagccccatgcctccgagatgggagaggggctggggcagagcctgtgagggccacagcagggtcagagctgcctcctcagacctggcgtcccagtgggaggaggtggcttggggaggggggtcaggagaagctgatccgaagcaccgtctgggtgtgtgttccattgtgggtctccccggcattaggggttagggcttgcgtgggaaaagtggctcagtgttcatgtgtggggttctgccagccactgggccactgcccaacagcccagctccgcgtccacgtgatgccaacacatcctgcttggctcagcaagaatccagttcctcaggccccagtgtagtcctcggagctggcagcaccagcagcaactgggagcttgttggaaacgcggcatcccgcgcaccgcccccctgccccgcgacacacacacatacctacctgagagatcagagccttcgttttcacaacaccccaggtgagacacacacattaaagctgagaagccggctgggcatggtggctcacgcctgtaatcccagcactttgggaggccgagacaggcagatcatctgaggtctggagtttgtgaccagcctggctaacatgacaaaaccccgtctctactaaaaataataataatttaaaaaaaagtagccgggtgtggtggcgggcacctgtaatcccagctactcgggaggctgaggggggagaatcgcttgaacccaggaggcagatgttgcattgagccaataatgcgccattgcactccagcctgggtgacaagagtgaaattccgtctcaaaattaaaaacaaaacaaaacaacaacaacaacaaaaacacaaacctgagaagccccggtccgggagcggactcctggctgtgttgctgagatgcacggctgtcgcgcagggcacagagcttttctggagcctgaggttgacactacaccttctcctgccacctgagactctgctgctagaagagggaggggagagagaggggcgaagtcggccagggcggccaggaggcagacaccaaacccgagctgggagccgtgtgttgctaggaccccagcgtcccctgctgagctccttccttggttctgaccaggagaaggaaatggggctcagtctcttaagaagccttccttggccagctccaaacccgggagggtccccaatccctcagacgaggatgctgtggcccacacttgcctcgacatgttgccttcccagggaccacatccgtatgagacaaactcacatgggacaggtggccccagagcaaaacgctaagacagtgtctaagaagaagctcaaggccttcccagaagcgctggcctcatgtgagaatcccacccacgccagaccccgtttcagatcctttgtgagggaggcaggcctgtgccccctgccctaccacaggtctttggacaagcaacgaagctccatcttctgctgtcacacctggcagccatttcagaggagccatggcctgcctgggttgtccctctgtgggggatctgtccaggctgcgacacccaccagctccccactctgtataactgagggccacattccctacaaaacagcccccaacccccctcccccgccacacacacatacagtgtgattaaagtaaaatgcaattcatgtaaatatctccatcaaggaatcatacagggaagacccaagtggccgttgggaacagactgggtgttagttttttaaatacagaggc

SEQ ID NO: 746 - DNA, 22345 bp, Human; identical to SEQ ID NO: 681

SEQ ID NO: 747 - DNA, 16341 bp, Human
aactgtgcagccagtgggcccaagggttgccattgaacttgatgttagtgagctctcccttcgtgagacccctgcccatggatgagcaaggagaatgggggtgtttcaggagcagacagggatcctgtgcaaagctgggcttctgtgcaactttcgcttgcagttatttaaatatttttgctgtaaatacagaactgcaggggagagggcaggaaacccagcgagcagcagcccggcctggctggggacaggatgtgtctgttggagcggggaccggcaaggcaggcatgcaggcagggggcttccctctcggggtcttcggaaggcgcagtgcagggagtgagagacgcccaggcctgggcagcgagagggccctgctccccgctcaaggctcccaggacattccacacaggagccagcctgttccaaccctgcactgcctgatactccacagccaccactgagatggaccccctccccctcagctccccatgacgtccccagcacctgaccccaggctgaccacctcggccaccacctctggccccaccttcctccccaggtttgttcccaaacacccctagagtcttttccggagcaatctcagacgtgcagaacgctcagggggaccctgggcctgaaggcggtaggagaaaccgagaccgacccctggtctagaggagaggtgtctgccgctctccatcctggactctggctgcccaaaagcaaacggcacgcctgcccacgtgggaatcttggtggcgtctctcactgcatcagttagcccccagcccagtgctgcctggattcaggcttcctggtaccttcgtccacccttcagccctaatccatgctggccaggtcatctcgttctctggctcagtgggaacactcgtgcccagagacctctcgtggttctctgcagcctgcacacagggcctgcttccctggcttgaccgcacagacaaggggactgttaccaaggcctcccactgaggccaccccccctccaggccatgcctgcggggccaccacagcctcagcatcattgcaggccccaggcctctgcacctggtcttgttttactgggggcactgtccccactcacgtccacctgggaccctcggctcctgtccactgcagctcccctcccggacaccttcccagatgcccccggaagctcctgtccaggccacagcatccctcagcctctgtcactggtcctaggaagaccctttgggagctctcactcagggccacactcaggacccccgttgtggggctggccgccttccttctaaagcacctggaggaaggaaggagggggtcaatgcgagcctcaatccccaggcgagtgtgccccttttaaagatgagggaaccgaggctcagagaaggaaaggacttgcctggcgtcacacagctagcctaagatggtgaggtcaggagctccctggcaacacccaggctgccgtaccgtctcctgcatcagactgagcctccatcgggctcctcccacagccccaggcgggcccctgagtaggggctctcagcttgtgtggaggtcccccaggaacaccaccccgatccagcctccatggaggctcttgccggccactgggaggggccggtgcaccctgggcagcccctgccagggccctgagacccgagcctccccgccgagggcacctgtctcggctttgccccattcgagcagggccctcgccgaggcaggacagggccacattcggaagtgagagttctctgagtcccgcacagagcgagtctctgtccccagcccccaaggcagctgccctggtgggtgagtcaggccaggcccggagacttcccgagagcgagggagggacagcagcgcctccatcacagggaagtgtccctgcgggaggccctggccctgattgggcgccggggcggagcggcctttgctctttgcgtggtcgcgggggtataacagcggcgcgcgtggctcgcagaccggggagacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggtgggctccccgcccgccccccgctgcccccaggccctgtgagccagggatagtccccggggaagttccaggaggaccccgcccctccagatccccaagcccctccagccttccccaactccctccccacaaggagccaggggcgtccctgatgacaagttagaagttggtccccttcccccagccgtccccacacctcacccccaagccaagggaatggcctccaggttcccccagccccaccctcaacacccctacaccaccacctgactccaccacaagccgaggagatgggcgtggagctgtccaggtcgccagcgcctctgcctgggagctccaccctctagtcatgatggagatgggcaggccgcagggtgtgggggaccatggcagggaccctcatgccaccccactgcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaaggtgggtcctggtggactcagccatgctgggggcctggggcagctgctgtcacctgctcagcccagctggactggaaccggagtggtgtttgaggagcccgtgggtgatgttccaggaccgtcttggatcctaagaggcaaaggggccaggcctcacctgtctggccaaggtgtccagttctggggcccaccctacccctggagaaaaccctgaggttgggaccctgctcctgcccctgagctgcagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggtaccctccctgcaggggaagccagccagggtctccagtcttcccgggcttccccgggagcccacgccccctccccacccgggctcccacccactgggtgtggggccagcctgcctggggctgtgggggtctcctctgggtactagacccacacactggaccagcctctcagctccctcctgcctgaaggctgagctccccggagctggtgaagtaggcgggcgggtctcatttcccttttactgatgagaaaccagagcccggcaaagggactacccagcactggaccgccccctccacgccctcccaccgcgggcccctgcccaccggcactcacccccactgagaggggaggccaggctgcccccagctcccccattcaggctctcaactgaaggccaagccccccaagaagccggagagcagcgcagagcagcagcgccttccactcgggaacggtgagcggggcccagtgggagcgcctcccttctccctggccaggggcaaggggtcaggggtcagagcagggcctgccctctgagaccctgtcctaggggctggggacgtgctggcctggtgtgtcattccaagggcctaagctgcaccaccagacccaggaaggggacaccttgggtctaagcatgatcttgccagtcgcccctgcccccactgcaccctggttctgggacccccttctcaggcaccttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccattgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccaccgtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgttcctgggctcaggacccaccgctccagcctctgcttctgtggtctcacagctgtctcccacgtgtcctctttataaggacaccagtcattgaacttatggtccagtgtgacctcatcttaactaatcacatctacaaagaccctgatttcaagtaaggtcacactctgaggttctgggtggacgtgaacttcgggggacgctgttgaacaccctggtgtagatccaggacaatccccgggccccagactcgactggggtgggggcgggctggaggaatgcaggctgtgggaactccacctgtctctgctagaccccaccctggggcctacacgactgccaaggcaggtcctgctgggcgggtgagccaggaccagccggcatctcctcccaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccgtaagcacctgaccttccctggggagcctggctcttgatgccccccgccccaggaacagcgttgcctctgggggagtggctctgctgggggctgggggctgctgccgagagacgcctggtgccacagccatgtgcaccctcgctgctgaggctgcccccattgctgacgcccctcttccttgcagggtggaggtgaggctaggctgggccagcagggcagcgttcccgcccctctggccctccccagtgacccccagctccaccaggtaatgccctagaccacaggagaggcccctgtctgcccttgctcccctcgggtgggtcctgctgcctctgcctttacctgggcactcagggatgagcaccggggcctgagcccctacccacagggtacagctctttttctttaatagacagtatttttttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcagtctgtgggaggaagagctctgggtgcagtggggacccacgttcaggcgaggctctgccccagcccctgagtggccgtcatcaggccccctctcagccttgtgcctcatcactagaataaggggcacagtgggggtcattgctcggctcctgaagccgttcctccttgccgtctctttctgcccttgatcacctccccattctgctgggtgccattccccttaacaggtgggtcagtttagggaggcccccggcagggcccagccctgagaggcaggcaaagccaccagggctcgcaggtgttggggattcctggggttcatcagagagcacgccaaggggaccctgatcacgctggccagggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctcccacagaacctggctcctggtgcgcgttgcggggtgtgcggagatggtacggacgtgctgcggtgtactcactgcgccgctgccttccactggcgctgccacttcccagccggcacctcccggcccgggtgagtgagcgtggtcggcggggaggcctgaacccacacccacaccctacaccccaccccacactccccacccacatcatacagcccacaaccacaccccacccacaccccacactcccacccacaccttgcaccccaccccacacccatgccctgcacccacaccctacactccacagccacactccaccacacccccacccacaccctactccccacctcataccctgcacctcaccacactccacagccacaccccaccccacaccccacactcccacccacaccctacacccaccccacaccctacacccaacccaaacccacccaaacccaccactcccactctccacccacacccacaccccttcctcacaccccacacccccatcccccactcaccacccacgcccacaccccacaccccataccccggaggtggcactcctgctcccccccagggctggcagcccctcatcctctgctgcaggacgggcctgcgctgcagatcctgctcaggagacgtgaccccagcccctgtggagggggtgctggcccccagccccgcccgcctggcccctgggcctgccaaggtcagtgccgcaggggccctccatgcatgccggtgctgggggtggggaaccccttgggttggtgttgggggagcacatctcagggcagaccctgggtgccagcttcgagggcttgcaccagacgcactgaccatgtgctcattatctgtagaaaatatttcccctttaaaccaattctttttggcaacttaaatatagttaaaaaggaagctccccccgagggttggtggctgacgtcacggttggctgtgtggccgcctcacagcatgagcctgagagtcctgccagggctccctggtggggtgaagggagagcgggagcgcccggcctgcaggagcaaacccccaccctgtctgacccctccaggttgtctcacccccagccctccctggggccaggatccaccccactgtgtggccagagccctctcagagaggcaaagtgaccccgggtccagccagtagctcttcctgtcctcctgctccggggtcagagaggacctgggtggcgcggagacccctgactgctggggcggctgggcttgccctggagctgggtgtgggggaggcccgagtcgctgctgcaggagcctccgggggggtggcctcttgccctgaccgtccccagcagaggcctcctgagcacatcctggccaccgaggagcctttagggatcctggggtgatgacacgtcccacctgctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcgggggtggcatggaccaggcactttcctctctgggcctcagacttcccctctcagagtgggactccttgctggttccctgagctccctcgttttccccaggaggccacacagtgtggaggctgtctgggggccgtgggcagctggccgtgggcaggaccctggggaggcagccccagccccatcatgcccacgcagccctgtgcccccacccccagtggagctgggtgtaagaattcccatctcagtgtgggggaaacacccccgcggcccctaggccctgcggcctctgtacccccaccagggctgtgggagttgggctgacctcttctctttactgggttccaggatgacactgccagtcacgagcccgctctgcacagggatgacctggagtcccttctgagcgaggtaacgcctcccctggcctcctggtgctcctccactccccctcccctgcctcagccggcacccaggctccccactctgggggaggactgccggcccccactgctcttgagccgtggaaactcaggctgtccctgctccacccaccaggagccccagtgctgctgagcacctggcaccccccacaggagcccccctagcccccttgcaggagccccccccggcccctccccctgcgggagcccagtgctgctgagcgcccccagcccctccccaacaagagcccccacacggcccctcccctgagggcctgcaccctggcaggcagaggctcgagcaccaggctcaagatccactttcccagggagggtggggcgtgggagtggggggggggtcccagaccccgtccctctaagatttgcttgcccctcccaactcaggcctctctacgctaagatgggcaggtagaatctgtggggaaaatgtgacttttaagggctctgtctgtttttgccaagaggataagctccttcagcctccacgggttctcctcagtgtctgatgtggcacccgggggtcccagctgaccatggggcaggggttctgccctgtgcagtggccgtgccccacacaccctgaccgtgcaggtgtctgcagagccccagggcctgagagtgggccagggggcccagcgctgggtaatggagctgcccctctggatggggtccccgggtatagctggagaaatgagcgacgggctcacagcctctcccgggtggcggtcttattctgctggcatcgtggggcccgtggccccatcctgtgggagcatcaggctcctgagcagaataagtagctggccccgacccccccaccctgaaggagccacccgaggaggcagaactgccatgaactgccatggggatgtgccctgggcttataggatgtggtgaagtacacaggacagggtcctcggtctggcctgtgccatggggaccttgggcctcagtttccccacctttgatggaatacggtgaagtgcacaggacagggtcctccccagactggcctgtgccatggggcctcgggcctcagtttccccacctttgacttagagggaaggttggatggtgacttcttgtaacgatggccatgattctgtggctgcggcgggggcgcacctggaggttctcaccgtcactctgtcccgcagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcacatggtaattatatttttaattttttgaagaactgccatcctgttttccacagcagctacaccatttcacatccccaccaacactgcatgagggttccagcctccccatatccttgaaacaattactattttctgcatttttctttcttttcttttcttctttttttgagacggagtttcgctcttgctgcccaggctgcagtgcaatggcgcagtctccactcactgcaacctctgcctcctggcttcaagtgattctcctgcctcagcctcctgcatagctgggattacaggcgcacaccaccatgcccggctaatttttgtatttttagtagagacggggtttcaccatgttggctgggctggtctcgaactcctgacctcagacctcaggtgatccaccccccccccccccccaccccacgggcctcccaaagttctgggattatgggcgtgagccactgcgcccagcctgtgtttttcttttatagtagccatcctaatgggtatgaggtggtacctcattgtggctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgcactggggccagccccgccctggtccccggccacatcctcgagaccaccggggtggaggggggggtctcactgctcagggcccgcgtgacattgcacaggtttagaaacgcacagcgggaaggtggccccggcgggccgagggcgcaggatccctgctccgtccagggtccgtcctgcgaggaggcgccgggggcgggcccggggcggggcgggcggaaggcgcgcgcggggcggggcggggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtgggcgggggtcccggccgcgtcgcggcgca

SEQ ID NO: 748 - DNA, 5830 bp, Human
  misc_feature (1)...(5830): n = A,T,C or G
ccgttgtacaatttacccacagtacatgagcattctacttagtctacattcatatatgagcattctggttggtccacatcctcaccaacacatggtattgtctatcttttttcttttagtctttctggcggatatgtagtcaccctgggttgcgttcctaggaaagtggactataagataaatattagtgtgcagaaagtttactggggagtgctcttaggaacagtatctttgagcaagtggagaaagcaggattaggcaggcgtagaggttggaccatgatgcagtcataacaaagaccttggccagtgccatggagaactctgaagctgggatgacccttcagaattgcctcagatttgggcaggggactgagcctttatacctcatatcaaccagtcattggatgcagacctccccagcaggaggaggaactaggctgtgagctgtcagtaatcgacacttacaggagtcagcgagatgagtacttcagtcctgatttgtggaggaggaatttgggaagcacactacagaattcactacagtagtggtattgcattgtggttttaaagtgcatttctctgatgactcctgaggttaagcatcttttggccatttagataacttcttttgagaaatgttcgtttgggccctttgccaagctttctattgggatgtcagtcttttttttatttgtaggaattctttacatgtttgaatagttctttaagatatatgtctctggaggcactgccagagacatacatctcaaataactatctggaatacataatatatattgtatataaagaatttttacaaatcaatgtgaaaaagacagaaatcccaatagaaaatttggcaaggaatctgaatatatactataaatgtcttcttccccttaaggatgaccttcttccactcaatgttttttgataaataaaagttgttgattttaatgtagtctaatgcatttttaaaaatattattaatgtgtttcgcatctcatttaaggtctttgcctacttcaaggtcatgaagatattctcctatgttttctataaaatatttactttttaccttttacacatcacctagaattggtttgggtgtatgatatgaactaggagtcacgatatatttttttctatgtgatattcaattgacccacaataatttatgaaaatgtaattttttttcataaagcaagtgaccatatatatgtgggtccatttctgaactctattctgttacattttcaaattgaatgtccttgcaccaatatcatactgtcttatttattacagcattcttaatatctgttagtattaaaagtttttttaagcctgcttgaatttttattgggattgtgtcaaatctatgtattaacttggagaaaattgagatctttacagtatttagtcttccaatacatgactaatagcacatccctccttttatttagattttctttaatttctttccagtgttttcttgttttcagtgtagagatcttgcacaccttagatttatttctaggtatttggtgttttctgatgttattataaatgaaatcttttataaatttattttgtctttttgttgctaatatataaaatgcaaatgatttttaaatatgtttactttgtatcccactgccttgctaaattcacttattaattctaatagtttgtctatggattttattggatttcttatggacccaatcatgtagtttgtgaataatagatttatgtattctattctgatccttatgcttttctcccatttccttagattattgaactacattggacctctgatataacatgaaacagaagtggtaatagtaggaaacgctttctcattctcaatctatgacgaaggattttaatacttcactgttaattacgatggctgctgtagggtttttttgtgtgtgacttctccttatcagatcagaaagttcccttcttagccaaagtaagcagtagccaacttgtcagggtgggagtcatattacaaaaccgagggcagtgaagaagctgaagaagaacaagaagagaaccttgaagcaagaggagactataaatattcagaaagagatagtttgatttttttggttgatgcctccaaggctatgtttgaatctcctagtgaagatgaattgacaccttttgacatgagcatccagtgtattcaaagtgtgtacatcagtaagatcataagcagtgatcgagatctcttggctgtggtgttctacggtaccgagaaagacaaaaattcagtgaattttaaaaatatttatgtcttataggagctggataatccaggtgcaaaatgaattctagagcttgaccagtttaaggggcagcagggacaaaaacgtttccaagacctgatgggccatggatctgactactcactcagtgaagtgctgtgggtccgtgccaacctctttagtgatgtccaattcaagatgagtcatacgaagatcacgctcttcaccaatgaagacaacccccatggcaatgagagtgccaaagccagccaggccaggaccaaagccggtgatctccgagatacaggcatcttccttgacttgatgcatctgaagaaacctggaggctttgacatatccttgttctacagagatatcatcagcatagcagaggatgaggacctcagggttcactttgaggaatccagcaagctagaagacctgttgcagaaggttcacgccaaagagaccaggaagcgagcactcagcaggttaaagctgaagctcaacaaagatatagtgatctctgtgggcatttataatctggtccagaaggctctcaagcctcctccaataaagctctatagggaaataaatgaaccagtgaaaaccaagacccggacctttaatacaagtacagacgatttgcttctgcctagcgataccaagtggtctcagatctatgggagtcgtcagattatactggagaaagaggaaacagaagagctaaaacggtttgatgatccaggtttgatgctcatgggtttcaagccattggtactgctgaagaaacgccattacctgaggccctccctgtctgtgtacccagaggagtcgctggtgattgggagctcaaccctgttcagtgctctgctcatcaagtgtctggagaaggaggttgcagcattgtgcagatacacaccccgcaggaacatccccccttattttgtggctttggtgacacaggaagaagtgttggatgaccagaaaattcaggtgactcctccgggcttccagctggtctttttaccctttgctgatgataaaaggaagatgccctttactgaaaaagtcacggcaactccagagcaggtggacaagatgaaggctatcattgagaagcttcgcttcacgtacagaagtgacagctttgagaaccccgtgctgcagcagcacttcaggaacctggaggccttggccttggatttgatggagccagaacaagcagtggacctgacattgcccaaggttgaagcaataaatagaagactgggctccctggtggatgagtttaaggagcttgttcacccaccagattacaatcctgaagggaaagttaccaagagaaaacatgataatgaaggttctggaagcaaaaggcccaaggtggagtattcagaagaggagctgaagacccacattagcaagggcacgctgggcaagttcactgtgcccatgttgaaagaggcctgccgggcttacgggctgaagagtgggctgaagaagcaggagctgctggaagccctcaccaagcacttccaggattgaccagaggccatgcgtccagctgcccttccacagtgaggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactacctgaataaagagccctaagtttgtactaaaaagaaagaaagaaagaaagaaagaaagaaagaaagaaagttcccttcttagttttctaagagatttttgtttgttttttggtgttttattaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 749 - DNA, 36907 bp, Human
  misc_feature (1)...(36907): n = A,T,C or G
acccctttgttcctgtttgtctggggattggggcgtctgcccctgggggaattggggctggtggtggcagtgatggcagtggtgtttcaatagttctgccctagctgggtgggagacagtgaaaccagtcccaggtttgactgttgttggctgttttacttgacacaagtcatttcacttatctgagcctcaatatactcaaaaataaaatgcagataaacctatgaactaccagagattgttgtgaaaattaaataaatatgcacggtgccataccagtgtggtgctatgcaaatttaggtcctattattttagttcaaaagcttgggtttgaaaagtgaggtcccagggtaacaattggttttgtttagagaggcacagttgaccagttcaaagaaatgttgctggagatgttttgtcccagccctacctgggacatctgttgtgacatcccctgtgtcatgctttatgtcatgctctgtgtgacatcaagcgagtcagcagcccttcctgggacttcagtgccccagtttttgtcattctcaaacatgagtctatcccaaaccaccagagaatgagggacttgaatgcagggctatagcatcaggttttatctgggaggcaatggggagacagaaagattcaggctaaggagtgtggacattatctaggcaatggggagccccataaaggcttcaagcagggaagtgacgaggccagatgtatactttggtaagaagtagcctggcaagggtgtggaggctgcctgagctggcggcagggcccagccagaagggataagatcagggcccagtggaggaggggagaggaagctgtttcacagagcagctctgagaagctggctggaagctgaggttgacacaccctcgaagcacctttggggtttcccaagttgatgtaaaaaggaaatgattaccctcgagaaggcaggggagttcttcggccagtcctgcgtgcctttggcatgtgatcttagcaagtcatttaacctgctcaggcctcagtttcctcatctctgaacagggatgagaagcagagatgttgtgaggattcatgtctgtgcagctgggcctgggcctggtacagcccgtcctcagtggccatggctgctgttttaggattctcatccatcaagtgggaaggatgcgtttgtctccactgcgtgaaagggaggttgtaggacagccagaactttgatccctaggggctggagtgggagcttagagggatggtgtctttgacccgctcacgtgttcagggaaatgtgcagtctacagcgcccattcccatctctactctcctttcccacatgacaccccagcgggaggcaaacggacgccattatcacctccgttttataggtgagggaagggagaccgagaggaggaaggtgacttgttggaggtcacacagctggttgggtggaagcaggtgtatgtgacttagcacgtcagagctccaccttcaccaggactgccatgttcagccactgctctttttttttttttttttttttgagacagagtcttgctctgtcgctcaggctggagtgtagtggtgcgatcttggctcactgcaagctccgcctccccggttcaagtgattctcctgcctcagcctcccaagtagctgagactacagccgtgtgccaccatgcccaactaatttttgtatttttagtagagatggggtttcaccatgttggccaggctggtctcgaactcctgacctcaggcagtccacccacctcggcctcccaaagtgctgggattacaggtgtgagccaccgcgcctggtctaccgcattttacagatggggaggccgaggccagaaagggaaagaccctcccgccctgcaacaccatgcatttgtggcagagccagaattagaacccaggtctctgacttccagaaccagtctctcaatggctaccccacttcatggaatagtaataactttctttccaccttgttttcagggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccaggtattttaaatttaacttttttacttaaagcacttttatttaaggaaatgaagatatatctataaggacattcagcttagcatataagagcaaaaaattgaggctgagcatggtggcccatgcctataatcccagctccgtgaggctgaggcgggaggatggcttgagcccaggagtttgagaccagcctaggcaacctggtgagaccttttctctacaaaaaattttaaaaaaatcatccaggcatggtggcatgcacctggtagtcccagctattcaggaggctgaggtagggggattgctcgagcccaggagtgcaaggctgtggtgagctatgatcacaccactgcactccagcctgggtgacagagcgagactcttcctaaagaaagcaaaaaatctggcaacaacaatgggggataataaaattaatgtcagacagtcacaacaaagtactatcaacagtgatgtagacgtgcatatgtacatggaaacatactgacaatatcgggaggtagaaaagtagaaaaaatcaggtaacaaaatgtatataacatctgttaccatttttgtgagcagaaaagaaatagctcggtaattggaggctttctagtgccagacactattccaagtactgtacttcaaagatattgactcatttaatcttcaactaactatgaattaggtattgtgattatgcccatttcatggatgagaaaactaaagcacagcgaggttaaccaacctggctgaggtcatgtactgccgggtccctgttttcaccagtggtctcccgtgtccccagcacaggttggccctgcgtgcaggctctggaccggatgtctgaccatttctctgtccattctccataggccccggccctcgcagccatgcagtggggaattgaggggtgcttcctgcccaccactttcctcccctccatcagtcacagtctgctgaagcccagagagggagagcagcttgcttaaggtcacacaaataggaagtaatgtctgagctgtgtgatttgaacactcacatccctaagcatcatactcactgctatcccaaatccttttggaccacttcagatttgtctccgtcgcctgtgcccaggcaagggctcagggacagtttccaaatgacagaatggctcagccagcagatgacctccctaggggagctgctgctcagcccaatctccattctcaccgcctcacccctggagccctgcctcacctcctgtctcctgcggcctcctgagtggtgagccagagaccccaaatccatgtaatctcagttcactgttgccgtttctgaagccaggggcggcatcagctgaaaggaacatgttttgtgggcttttgtattagacagactcatatttgaatcctagtgctgctgttttgtagaatgacttagcgtttgtacctcagtttactcatttgtaaaatgaggagaataatagaccctatttcatcacgttgtggtaagaaatcctgcacctgagtgttgcaccatggaggtgctcattaaatgttatctgatattatgaacattccagacactccagataggttgaatctagaaagttaattctaggccaaggagtctggattatttcctgtagctaaatatatgtatttttaagtgtagacttttgatcagcaatgaaagataaggggaaatggtcctgaccaaagggaaaattataacaaaatagggaaattgtaggggcgtgctggtcaggatggaagaggtaataggcatagcagttccttctggtattctttatctaggttactgtaaagataaacatcacagccagccgggcgcggtggctcacgcctgtaattccagcactttgggaggctgaggcgggtggatcacgaggtcaggagatcaataccatcctggctaacacggtgaaaccctgtctctattaaaaatacaaaaaattggccgggcgtggtggcgggtacatgtagtcccagctacgcgagaggctgaggcaggagaatcactcaaacccaggaggcggaggttgcagtgagctgagatcgtgccactgcattccagcctgggtgacagagtgagactctgtctcaacataaaaataaaagtaaaataaacatcacatgtctctgtcagcctttgctgtttactttctttcctttttttttttttttttttttgagataggccttgctctgttgcccaggctaggtgacggtggcacggtcatagctcactgcagcctcaacttccctggctgaagcaatcctcccacttcagcctctcaagtagctgggactacaggtgtacatcactacggccggctaattttttatttttgtaaagatgggatctcattatgttgcccaggctggtctcgaactcctgggatcaagcgattctcccaccttggcctcccaaagtgttgggattacaggcatgagccactgcacagagccctatttacttactttctttttttggcagtgggatggaatctctgtcacccaggctagagtgcagtggcacaatctcggctcattgcaacctttgcctcccgggttcaagcgatcctgctgcctcagcctcctgagtagctgggactataggcacgcaccaccacgtctgactgatttttgtattttttgtaaagatggggtttcgctgtgttgcacaggctggtcttgaactcctgggctcaagcaatccacctgccttggcctcccaaagtgctgggattacaggcgtgagccactgcacccagcccctatttgctttcttgatggcacttggagcaaatgtgcccaggcaggtcaagatgataactacaatttgcaggcagagacaggaagttgattgtctatctttgcctaaattgaaaataagaaatcattcatttcatcaaaccacccaaagcttgtcttctttcgggaaaaccccaaggttccactgagccccagagttcaaactcatcaattatcttaaaggattttggtaggagtgaagtatactgagcccacatcttgatccctgtgataccctggctcccccttgcagtaggtgggaaggaagtgggaagagacatggaggaggaaaatatgtttgtttgttttgttttttgagacagagtctcgctctatcactaggctggagtgcagtggcgcgatctcggctcactgcagcctctgcctcctgggttcaagtgatcctcctgcctcagcctcccgagtagctggcactacaggtgcgcgccaccacgcccagctaattttttgtatttttagtagagacggggtttcaccatgttgaccaggatggtcttgatctcttgaccacctgcctcggcctctcaaagtgctgggattacaggcatgagccaccgcgcctggctgaggaggaaaatatgtgagcagaggagccatggataggctatgagcacctcggcaaagcagtctcgaagctagaattcagatgaaagggttttgagcagctgaaataactgttacaaagccttagctgtaggagaggccactgggctatcagtcagaatctgtttacttactctacacatagtttcaccagccttggtaaaataccaagtactgcatgtgtcacagcctgacctttgtgctctataaacatcagctctttttacctggacaagaaacagaccattattgctctttttacatttgagaaagctcagataagtgaggcacagctcatctgaggtcagatcttgagtagtgctggagccagcgcttgagccaaattctgtttgatactaataaaggagatggggcagctgggggtagacccgctgccagcatcagggcaggacatagaagaccccatgtcagatacagtgccgctgcttctgcaattcttgtacctgcaatgacacagctcggcaggaccagaggtggtgcattttgcttgagaaagcaggcatattagcctcagtagaatagcaacaaaaaggccaaggcagtcggatcacctcaggtcaggagttcgagaccagcctggtcaacatggtgaaacctcatctctactaaaaatataaaaattagctaggcatggtctcaggcgcctgtaatcccagctacttgggaggctgaggcaggagaattgcttgaacctgggaggcggaggttgcagtgagccgagatcacgccactgcactccagcttgggtgacagagaaagactctgtttcaaaaacaaaaacaaacaaaacagagcaaaaaagaaaagcaagaaaaagaaagcttctggaagcatttccataggaaatggtttgttttttagctaagtcctggcacttgatctgacctctgattagctgtgcctcactcttggaaacaagattatgtagaagccccaagccccatctatcactatcacccaacaagtatcccatcttgttcatctactctcctgccccatctccctcccctcccttagccattattttaaaacatttttatatgaaaaaattacaaacatacaaaagccaagagcataatgaccctccatgtccccatcagctggcttcagtaatgatccacccatggccaacttctgattagtttgtatggaatccagggagattttcatatccttgatagctggagaattccttctcattctcctctctctgcccttggacatacagtgggggcctttaaagattatggttgtgagtttctcctaccacagataactaccctaggcacgaggagccaatccgattagaccccagaggaggggagggctgggtagggagagatggagagtaatggctggtgggtcctgtctgattttccagaccagagtccatttcttttccccaagaccacagggataaataaacccaactaatagccctcatgtgtcgcaggagcaggcctcagggattcccccaaactgagaggcctgggggagcctcctgagcaaaccccaggcattaagtcagataggaaactcatgacttgtgtgaggcaagctctgacctcagatttactgggcacagaaggaccctgtgtgcagagacagccctgccctgtggccaggcctggcagcaggatggaactcaagttagtctggagcagcggttcccagtgtggggcccacacctgcagtggtacacagaacctgggtgttagcacaaatatagatcatgtgtagaagaactagggacttcatggatattactgtttaacacaaggctgaatacataacactggaattaaagttggttgaaagaaaaccgtcaggtgactcatagtgaggtggcacagacatggccaaaaacttggagaccggatgaacataactgcagtctgagggatgcgggccaagggtactgagctgaggccaagagaaggcagggcaagggtggaagtggccatcacagagcagcctttctgcaggacgggggccctgtgctggccagcagaggcctccattagtccaggtccttggtgagaggcagataccaagacaggataggatttcatcaacaagataggatttcattaggacaaatacttgcaagaaaatgcagagggagctgggcaaggctgggagagccttgggaccatggtgcgccatttccgaggaaggctgggtgggcacttgctggcctgccttcggtctaaggcagactctccagggtgtccgttggccatcacagtcctatctgcctagtgtaccctctgcacacagtgcctggggaacagcccctgggaagcatggtccggatgcagatgcagggattgattggagccagccacagccaggcccgcagatagccaggctcccagcagctgggggtctccagctcgcattctcctggctgctagattcacacagcagcagggcaaagatcccaggaatgaggctgagggcagccccttgacaggctccagaccttgtctcaggtgatttcatgttatcagctatctgtgtgggttaattgtttagccaggctgattttactttcagtctcgtgaaataaaattttttgttttttgttttttgagactgagtctcgctctgttgcccaggttggagtgcagtggtatgatcttggctcactgcaacctctgcctcccaggtttaagcgattcttgtgcctcagcctcctgagtagctgggcctacaggcatgtgccaccatgcccggctaatttttgtatttttagtagagacagggtttcaccatgttgaccagactggtctcgaactcctgacctcaggtgatccacctgcctcagcctcccaaagcgctgggattacaggtgtgagccactgtgctggccaaaacaaatttttttttttgatacagtctcgctctgtcccccaggctggagtgcagtggcacagctcagctcacggcaacctttgcctccctggttcaagcaattctcctgccttagcctcccaagtagctgggattacaggcactcgccatcatgccaggctaatttttgtatttttgtagagatggggttttaccatgttggccaggctggtcttaaactctttttgtttgtttttttgtttgtttgttttgaagtggagtctcactctgtcacccaggctggagtgcagtggcacaatcttggctcatggtcttaaactcttaacctcaggtgatccacctgcctcggcctcccaaagtgctgggattacaagcctgagccactgtgcccaggccaaaataaattttttaatagccaaagttccagatgagtcattcctttcctgatgttgtaagccacaaatacctgaagcaggtagatttatccagtaatcttggggtcaagtccagtttcctttggaagggtcaggtccccagttactcagaagctgtccttgccatggggcttcctaggtatttccagatgatgatgtttgaagcctctggcctttggccaaggcctgcttctgtgcggaccagccaccatggctcacctcacccacggtctgtgcctgcgcccaccgaggagcccccctaccagatggcctcattagtcttcagattaatcttcacatggggcctagtgaagaaatttcaccctctttaacctcacgtttaagtgaccctaaactacttgtcaaacattccgtcttgtgaatcttgttcactcactaagggattggggcatagacatggccaagcatggtggctcacgcctataatcccagcactttgggaggccgaggcaagtggatcacttgaggtcaggagttcaaaaccagcctggccaacatggtgaaaccccatctctaataaaaatacaaaaattagccggcatcatggcgcacgcctatagtcccagctacttcgtaggctgaggcaggagaatcgcttgaacctgggagggggagtttgcagtgagctgagattgtgccactgcactccagcctgggtgacagagtgagactctgtttccaaaaaaaaaaaaaaaaaaagaacatagacactggaaccactgatgactgtgtgccccatgtgaagattaatctgaagactaatgaggccgtctggtaggggggctcctcggtgggcgcaggcacagactgtgggtgaggtgggccatggtggctggtccgcacagaagcaggccttggccaaaggccaaggcccttggaaaagtgacttaacttctccatgcctcatttcaccatctgcaaagaggcaatgaaaatggtgcagtggtaccttatttcctgattggcatgaggattagatgagttaacgcacgggaaggattttttttgagacagggtctcattctgcctcctaggctagagtgcagtggtgtgatcatggctcaatatagccttgacctcctgggcacaagtgatcctcatcctcccaagtagaggggaccacaggtgtacaccaccatacctggctattaaaaaaaaatcttttgtaggactgagcgcagtggctcatgcctgtaatcccagcactttgggaagccaaggtgggcagatcacgagttcaggagatcgagaccatcctggctaacacagtgaaaccccatctctactaaaaatacaaaaaattagctgggtgtggtggcgggcgcctgtagtcccagctactcgggaggctgaggcaggagaatggtgtgaacccgggaggcggagcttgcagtgagccgagattgtgccactgcactccagcctgggcaacagagggagactccatctcaaaaaaaaaaaagaaaaaaaatcttttgtagaaacgggatcttgtcatgttgcccaagctgatctcaaactcctgggctgaagcaatcctcctgcctcagcctcccaaagtgctggtattacagatgtgaagtatttagaacagtgcctggcatgatgtttgctaactcatgtacctagatgttaacttactccagccccgggcccttctactgccccacctctgcatgggctggttccactgccccatatctgcttgttgaaaacgtttctccatatttcaagcccaggtcaggtgccacttcctctgtgaaccctcctcatctcccagcctgttatggtctctcctgcctctgacctcgctctcccgtgggatgtatcctcggaggatagttactgcatccctgccctggtggaggtttctggaaggcaggcttggtagctagttcacctctgtgtctttttctgctctttgagtaggaggtgagatagtgcagggcctagaagtcaaacagatttccgtctgaatttcggctctaccatctactggctgggtggtcctgagcactgcgtctacctccggtgtctccgtgtctccacttgccaactgggatgataaacaggccccaggttgtaggggagtcagaggcttatcctgaggtgatgcttgaggagtgtgttggttggcacatggtgggtgtcaggaattggcagcaacaagtgtttggggagtgaacaggagactggcatagtctgaggactagaccaggatccctcctgtcttcctccccgaggctgcatcctgacccatagtccctcctttccagggtcctctccagccagagcccaccagccggcctttctccagcctcctgaagaagatgcccctcattccttgagaagcgacctccccacttcgtctgattcaaaggtaaatccacccctcggctgcagcccccaagccatgtctcccagcgtgtagttccctctcaaaaatgcaatttctctaccccttgagaccagtttaagggtggagaggagaaaggaaattgccatcaaattaccccaagcttctaagactgtaagtagaggaggtcaataatagcggggagagggagggagggcacttcagtgaatatacttcttgttttttaatttgttattattattatttttgagacagagtctcgctctgccacccaggctggagtgcagtggcacgatctcgggtcactgcaacctccgcttcccgggttcaagtgattctcctgcctcagcctcccaagtagctgggattacaggtgcatgtcaccatgctcggctaattttttgtatttttagtagagacggggtctcaccatgttggccagcttggtctcgaactcctgacgtcaggtgatccacctgcctccgcctcccaaagtgcttggattacaggcatgagccactgcacccggccattattttcttttattattttattttattttcgacctgtggtctcagctacttgggaggctgaggcgggaggatggcttcagcccaggaggcagaagttgcagtgagctgtgatcctaccaccacattccaccctgggtgacagagtgagaccctgtctccaaaaatgtatgaccatattggtacgaagataaataaaatccaagcaggattaaaaatgaggacatttctttgactctaaaagtccatttattttcttctgattttaaaataaattaaaatgttctgatggcccctaaaagtgttgtgagcctagaccctttgcatccagtgcctgggggagaagccagctttgcatgagtgtggttaatgaagctcttccatgtcccaggtgtggtgtcacatgcctgtagtcctggctatttgggaggctgaggtgggaggatcgcttgagcccaggagttggagaccagcctaggcaacacagggaggccccatctctaaattaataaatagatcaaccttccatgaaggataaacccaacactttgggaggttggtatgggaggttcacttgagcccagtactttgagaccaacctgggcaacagtgtgagatcctgtgtctacaaaaaagttttttttgtttttgtgttttttttgaggagtctcgctccattgcccaggctggagtgcagtggcacgatcttggtcactgtaacctctgcctcccaggttcaagctattctcctgcctcagcctcctgagtagctgggattacatgcacatgccagcatgtttggctaatttttttttgtatttttagtggagacagggtttcgccatgttggccaggctggtcttgaactcctggcctcatgtgatccgcccacctcagcatcccaaagtgctgggattacaggcatgagccaccgtgcctggccaaaaagtttttttgagacaaagtctccctctgttgcccaggctgtctcgactcactgaaacctctggttccccagtttaagcgattctcctgcctcagcctcctgagtatccgggattataggtgtgtgccaccacgcctggctaatttttgtatttttagtagagacacggtttcaccatattgcccaggctggtcttgaactcctggcctcagaggatccgcctgccttggcctcccaaagtgctgggattacaggcgtgagcacctgtgcccggcctatccatgtcctttttacagtttccattggataagttgatcccctccatccctccatctctggtgttccaaggtcccttgaggtagcagagaaaacgagattccatagtaatctccatctcttctctctgggtctccaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagaggtgagcacttcttggtttctagtgggggtggaggctgcaggggtggggcgggatcttcatgttctgatgtctttctctacagacagcctgttcaagtccaggatcaatcgaaagattcttccaggcagagttgcagatttgtcttaggtaagcctcccctttgtttagtaataatgatagctaacctttatatagtgcttcctgtgtgcccagtcatgttttaagcactctattatatataaactcatttagtccttacaagaaccctataaatgtagctactattatcacattattttacagatgggtaaattgaggcacagaggggttaaatgtctcatccaaggtcacacagctaatgagtggcagagccaggatttggatctacctggtttggctccagagtccattcttctcctgtgtagcaattctatgtgtagattagaattataaaggaaacttggcttactccaactccttccttccacatgggaataaatcttctctcctttttttttttcttttcttttctttttttgttttttgagacagagtcttgctctgtctcccaggctggagtgcagtggcgtgatctcggctcactgcaatctctgcctaccaggttcaggtgattctcgtgccttagcctcccgagtagctgggattacaggcgtgcgccaccaggcccggctaattttcatatttttagtagagacggggttttgacatgttggccaggatggtctcaaattcctgacctcaagtgatctttctgctttggcttcctaaagtgctgggattacaggcgtgagccaccgtgcctgacttttttttcttttttaagagctagggtcttgctctattgcccaggctggaatggccttggaatgattgtagatcactgcagctttgaactcatgggctggtgatcctcccacctcagcctctgagaagctgggactacaggtgtgcgcccagctcattttttgcttttttttttttttttttttgtagagatagggtcttgctatgttgaccaggctggtgttgagctcccgggctcaagtgatcctcctgccttgacctcccaagatgttgggattataggtgtgagccactgtgccctgccatgtgtgtgctttttttttttttaattatttttcatctgaaacacttgtgccttatattgtagggtattttaagaaataaagaaaattgagtatctgttcattctgtaaccagtgttaaaaaataaagaaaattgaccaggtatggtggtttatgcctgtaatcctagaactttgatgctgaggcaagaggattccttgagccaaggagtttgagaccagcttgggcaacatagcgagaccctgtctcaactgaaaaaaatatatatacaaaaactttttttggctgggcatggtggctcgcacctataatcccagcactttgggaggctgaggcgagtggatcacttaagtccaggagttcaagatcagctgggcaacatggcaaaaccccgtctctacaaaaaatacaaaaattagctgggtgtggtggtgtatgcctgcagtcccagctactcaggaggctgatgggaggatcacttgagcccaggaggcagaagttgcagtgagccgagatcatgacactacactccagccggggcaacaaagtgagtctctgtctcaaaaataaataaaggccaggcatggtggctcacacctgtaatgccagcactttgggaggccgaggtgggcagatcagttgaggtcaggagtttgagaccagcctggccaacatggcgaaacctcatctctactaaaaaaaattcatacaaaaatcagcctggtgtgttggcatgcacctgtagtcccagctactcaggaggctgaggcatgagaatcacttgagcccagaaagtggaggttgcagtgagcccagatcgcaccactgcactccagcctgggcaatagagtgagactctgtctcaaaaaaaaaaaaaaaaaaaaattaattaattaattaaaaagtaaaacaaatttaaaaaggaataaagaaaattataaataagaaaatagaaactttttcacagcacctataaataagcactactgttttaatattttgatatattttcatttttaattgttaaaactttttttgtagagacacgatctcactatgttgcccaggttggttttgaactccctggctcaagtgatcctcctgctttggcctccaaaagtgttgggattttagatgtgagccactgtgctgggcccatattttgatatgttttctttaatgctttctctattcatacatgtatatgaatactcacatgtgtacacacacacacacacacacacagatacacacacacacatacatctaataaaaactggaagtatgattccctttccactttggcttagtgctttcatggagtcggcagtcactccttcattcattgattcagaaaatgtgggtagttaagcccttttctaggctctagggagtgtacgccagaagcatacagagcccctgccttggggaggtttatggtccagtggggagactgacatgtaaataactctaataagtatgcaaaagcgagtaataggatggcttgcgggaagcagaggagggcggagagataaggcaggaggccatttacagcagtcttggggaggctgaatcagagcctgacccaatccaagtgacccaaggcagaggagaggggaatgaagggacattttaaaagttatttgtggcagtgaatggtgactgatttgatacgggagataagaaggtttctaggaaactgggtgggtggtgatgtgcctttctgggataataaatatgggtgaagaagcaggtttgggacttgttgaggctaggatgatgttgacctgagcatcaggatgcaaattgacattcaggtctggagcttaggatggggctggagataagagatttgggaatattccttatagcaatgggaggttcctggaggagcaacatacaaaacaagatgaggagtccagctggcagaaagaggaaggcaaaggaggagggtcttagtgaaaagggccaggaaagagtggtcagagaggtaggaggaaagtcaggagggaatggtgactgagaaccagcagaagaggatttcaggaaagaaccccagtcctagagtcaggcaggtgtgggatctggtcctggctttactgctttctagtttgtgaccttgggcaagtcccttaacctctcagtctccgtttctggagatggggcagttgagatgtcatgtgttgcagagcagtaaagcaggatgaggaccaccatactcgttgaaggcagacagttttcatctttccaccctggggccaggcccttaggggtcagagtatgtggtacctgggaggttattggtggcgttggaggaggagagggcagaagaggggtgggacatgaggaagtagatcattctttccgtctgactcctcacacctgcactgacgcccgattccagatgctgccaccccaatgtcttacctgtgctgggcttctgtgctgcaagacagtttcacagcttcatctacccctacatggcaaatggttccctacaggacagactgcagggtcaggtaagggactgggtcatggtcagagaatgggaccaggctgcacccagccatggggtcaagggttaaggacttacagaagttcagaggggagaggggccatctaggtgagaccagggagacttcaaggagagaagtggggccaggatacataagatctggttaagtgctcactttggcagcacatataccaaaattggaacgatacagagaagatcagcatggcctctgaatgaggatgacaaaatatgaaaaagaaaaagaaaagctcaaaaagatctgattaaacatcttcaggaaaaatctataaaaaattatttgacgagaagcatttcattcaaatcaagagcaggacaaaggtatctcatagaactaacttcgttcgtcatggttctggaggtgttagccaatgcagtaggacaagaaaaagaattaagaggtaaagagtatggaaaagtggaggtgaatttttattataaaatgttcttctaatatatacctatttgcttgtgtgtttatggaatgtctctggaaagatacacaagaaactggtttactggctgctgctagggagcagaactaggtgattggggcctaggataagaagcaaacttactattagagtattatatcatgtgaaggtaatccttaataaaaattacagtgttttaaaacaggtcttctgcttatcttatcctcaaatagaggggaaagagttattccataacagaattattgcttcccatggcagggacaagacaaagcagttactcacggcatactaatgatctttagcttttctgggcactcactgtatgcaggttgctgtgataagggttttacgtaggtcatcacctccaggccgtgccacaaccaaagcaatttcttccctcatttttcaaaagaggaatctctgacacatagagacaaagtgacttgcccaaaggaacatagaggacaaatgtcaggccagagcttacattgggttcgtctggctctaggtttcagagtttttgagaagaaattagcaggggctgtccaggccagttcttagaggatgtgggacctacaccagggcttcaaaaataggtgatgaggctgggcacagtggctcacgcctgtaatcccagtacattgggaagccgaggtgggtggatcacttgaggtcaggagtttgagaccagcctgaccaatatggtgaaaccctgtctctactaaaaatataagaattagccaggcgtggtggcgtgtgcctgtagtaccagctactgaggaggctgagacaggagaatcacttgaacccgggaggcagaggttgcggtgagccgagattgcaccactgcactccagcctgggcgacaaagtgagactccgtctcaaaaaaaaaaaaaaaaaaaaaaccaaaacggtgatgatttagcctgggagagtcagtcttagaacaacagtgggagcaaatgagaggctttagcccatcccacaatccccatcagccctggtgaagtttcccctaatacagataaaatcagcgtaaggcccaggtgcttggcttgcaaacacaagctccctagctcctctcccatccagcttcttttagagagaaattccagagcagcctctgtaatggacatgataaaaataactgctgattgagcacctactgtgtggcaggtgctatgctaggggtataccatatactcccttgaatccttacagcaaccctaaaatatagggattaacatttccattttatacccaaggaaactgaggctcagagatgttaagtgtctttttccaaaattatacagctaatgcatgtctgaactgggagttacacctagatctgtctgatgtcaaaacccatagtacagggtcaggcacatggctcatgcctgtaattccagcactttgggagagcgaggtggacggatcgcttgagcccaggagttcgagaccagcctggccaacatggcaaaaccctgtctccacgaaaaatacaaaaattagttgagagtggtggcacgtgcctgtgatcccagctattcgggagtctgaggcgggagagtcacttcagcctgggattttaaggctacagtgagctatgatgctgcactccagtctgggtgacagagcaagacctgtctcaaaaccagcaaacacaaaacaatgaaaaaactcacagtatcatgctgagccctgtgacagaggacatgaagggtgggaggaggatcaggagcctgggaccctgccatcaggacttcgtttttttgtttttgtttttgtttttttttgagatggagtctcgctctgtcacccaggctgcagtgcagtggtgcaatctcggcttactgcaagctctgcctcctgggttcacgccattctcctgcctcagcctcccaaatagctgggactacaggcagccgccaccaggaccggctaattttttgtatttttagtagagatggggtttcaccgtgttagccaggatggtctcgatctcctgaactagtgatctgcctgcctgggcctcccagtgtgctgggattacaggtgtgagccaccgcacctggctgccatcaggactttaaaaaggtacattgtgactatttgtcctcctgcttttctttctcttagggtggctcggaccccctcccctggccccagcgtgtcagcatctgctcagggctgctctgtgccgtcgagtacctgcatggtctggagatcatccacagcaacgtcaagaggtgagagaggtgggctggaccctgctggggcctgggctgcaagggtggaactggtgcctattcctggctcacctcccgctccgccactcacccctgtcctctttgtttttctcttcctacctcctctcctctgccctcccctggatgtctttttctctgttatgccctcaaaaatgagtgtttccgggctgtgctccaagtccaattgctctcaggatgaattgcctacctgtcacatttgtctttctgagctgctgttttcccaacaagccctccacaccttgctgcgtcgcactgtccactcagcagctggcctggacctcatcctcgaactttgggccatgtctgccaaccccctgggattttgagctcctcgttcagtgtcttttctgagacctgtccccttcttgtgtagctgttggtgttagcatcttgtctggaaggctcctgcaggttaggcctgcacccctgcatgtcagtgccatgcacatgagagggagaggtccccatctggagacggttaggatagggagggattccgaagataccagaatatctggcagaactggctccagagacacagaactcgtatttccccaaagttctctttccatttgacttgtggaagtcctttcctcttttctctcccccaattttttttttgttttttgagacggagtttcacgcttgtcacccaggctgaaatgcagtggtgcgatctcagctcactgcaacctccacctccctggttcaagcgattctcctgccttagcctcctgagtagctgggattacaggtgctcgccaccacacccagctaatttttgtatttttagtagataggctttcaccatgttggccaggctagtgtcgaactcctgacctcaggtgatccacccgccttggtctcctatagtgctgggattacaggtgagagccaccaccccggctctctcccctaatttttatttgattgcatcaataattctaatagcaggcaaggaaatgaaagggtgagagaggtcaccactaacctaccccatgactcatcagctggcctctaggttttgtttcttttttcacttcctgcctatacaaatccttagtcctgaggtagcacctgggtaccaattcacatcctgttttttaccccttcatttaaacatagtaaacatttcgctacattgtataccgtcatgttttttagtgtcttagtcttcccgtgaaggaatttgcccataatttacttaaccactcctggcacacacacccgtgcatttgcgggcgtgcacacacacacacgctaaaaaagttttttttttggccgggcgcggtggctcacgcctgtaatcccagcactttgggtggccaaggcgggcagatcacgaggtcaagagatcgagaccatcctggctaacacggtgaaacctcgtctctactaaaaataccaaaaaaaaaaattttttttttttttttttttttttgagatggagtctcgctctgtggcccaggctggagtgcagtggcacaatctctgttcactgcaagctccgcctcccaggttcacgccattctcctgcctcagcctccagagtagctgggactacaggcgcctgccaccatgcccggctaactttttgtatttttagtagagatagggtttcactgtgttagccatgatggtctcgatctcctgacctcgtgatccacccaccttggcctcccaaagtgctgggattacaggtgtgagccaccgcgcctggccaaaaaaaatttttttttgagacagggccttgctcttttgcccaggctggagtacagtggcgcaatctcagctcaccgcagcttcccaccttagcctcccaagtagctgggaccacaggcacgcaccaccatgccgtgctgaatttgtttgttttagtagagatgaggtcttgccatgctgcccatgctggtctcaaactcctgggctcaggtgatcctcctgtctcggcctcacaaagtgttgggattacaggcatgagtcactgcacctggcctgcactatatatctgtacacatgtggcttagctttttcccattttggagtatgttctcagtgtttgctcctgggggttagatgactagatcaaatgattttttttgagacagtgtaccactctgttgcccaggctggagtgcacctctgcttccgggttcaagcaattctcctgcctcagcctcctgagtagctgggactacaggcgcacaccaccacggctggttaatttttgtatttttagtagagatggagtttcggcatgctggccaggctggtcttgaactcctgacctcaggtgatctgcccatctcggcctcccaaagtgctgggattacaggcgtgagccactgtgcccggccaagagggaatttttttttctttctttttttacatgatctgggcaggtttagtcacaaaggatgctggccacttagacctgagtcagccaggccagagctgggggttggaacagttgtggaagagactgagtctgcacagcctgtaggcgtggcaagctgaggctgatcagggttggcatctgtggggatcagggaggctgcactttggccacattcctggggcagcaagactaagtctgaactccatctccatttgctggagggagtgtgctcctgatgccctctcttccccagtcagggctggctcagaagctccatgctgagggtctttagagacctcaacttgcaggaggtgaggttgctatattgtctccccaaagggtctccatggcaacttgttgttatccagctcaaaatgagaaggttccctctcctttcatttccacagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtaagagtgtcctgctctgcgtagagtggggcccaccttgatttgtccttcccacggctcctttgtaatcacaggatacggtagaggcacacagacaggttccatcaaagtacaacaggggctgacaaactgtggcccacaggccactttggcctgtggcgtattttgtatggtctgtgagctaagggtagttttacatttataaaggattatatttttaaacacaaagaatatgtgatagagactgaacatgctccccaaaagctcacatatttactgtgtggcgtgttacagaagaaatttgccagcccttgaaggaaaaccactcatgagtgtccaggttctagtaggctccagatatcctctcctgacttccgtaattcccatccagccatccacttgtccatccagttgtctatttgtccttatttgttcatcgctgtccgatcatccatctaccctttagctgcccatccattcagcgaccactgacccacccagcatcccaccctaccaccaccaccatccttgtctgccattacgtcgtgccaggcactaggaatatgaatgtaacaaaaacacagtccctcccctcaggagctcatggtctgcatgtagcagtctccaaagtatatttctgtagaactccagttccttcggacctctaggattgatgtgttaaaagggtttgtgccctgacaggcttggaaatattgcattaggcaaagtcaagcaggtttctttaccacaagattaattcaagctggttgaatggtagtgagcctttaatctggtacttgtgaattcaccagagaggggtatgcagtgtttcccaagctcatttgactatggaaccttgtgttctcagaatatctgtccttgtcagtgttccatggaacccagtctgggaaatgctggctgagaagagtaacagtcaggttggcttcagccaagtgcatacagctgccccttgggcctcaccctcttttcttctctagccttgaactctgtacttcctctctctgaccacagtctcctgtctgtctacctctgctaccagaaccgtggccctgagtcacctctgccctcagccagaaccccagattctgcacctccgtgtctcccagctggttcctctgcctccctcagccccactgcaagttgttcagtgaagctcagcagggctagtccaggctccttctcctttaagaaccagggggatgggcagggagtggtggcacatgcctaaaatctcagtactttgggaggccgatgtgggcagatcacctgaggtcaggagttcaagaccaacctggccaacatggtgaaaccccggctctactaaaaatacaaaaattagctgagtgtggtggcatgtgcctgtaatcgcagctacctgggaggctgagtcaggagaatcacttgaacctgggaggcagaggttgcagtaagccgagatcgcgccattgcactccagcctgggcaacagagcaagattctgtctcaaaaaaaaaaaaagaaaaaaaagaaccagggggatagaacccctaggcccggctcagttactttcagctgtgtgacttacacctagcacttctgtctctgggcctcagttaagccttctgtaagatggggctaacgatacacatggagatgaatgggataatgtatataagcaggtgagcatggcaccctgcaccctgcaccctgcaccctgcgcctaccaagaatattatgatgactgtggttattgttattcccacctttacaccctccttctgatatctgtttactcttgaccttctaactggtgtgttagcgtcacagatgacttcctcatccatccattcaccctcccacctatccatctattcatccacccatgcacccaccctcccacccacatacccatccatccatccacccacccacccacccatccatccacccacccacctgtccacccatccatccacccacccacccacccatccatccacccacccacccacccatccatccacccacccacccacccacccatccatccacccacccacctgtccacccatgtacccaccctcccaccaacccacctatccatctatttatccacctacccacacatccacccatccatccatccatccatccatccatccatccatccatccatccatctaccacccatccatccattcattcattgaatgcctcctggctcctgccacccttttgctcagccctgcctctggttgactgataacgcttttgaactttgattcctcctgtggggatcacagtgcattgctcagtgttttttggtgagtgctcagtgacctctataaaggacttggctcagagcctgctctgtgaaaggggcacaggaagtctttgtttattcatttccccttgttctgtcccttcctggcagggacctgtcaggagtcccttttcaattggctcctgtcccacttgcagcagtgatgccctctgctgcccttttctggtcactgccagtctgttattaatcctgggtggtttaaaacctttatcctttccttcctccaggcttggagggattcttggctataaatgtgaccctattctgacttgctttgagagatgctgtgggagagaggttccacactaagtgtggggtcttcacacctttaatattcacaactgctagtccccatttaacagatgaggacactgaggctcaggttttagttacttgcctaaagatcacctgagcatataaggaacagagtcagaatttgaactcaggcctgactgtagagcccttagccatcatagcattgtctctactgagaaaccctgttcaaagcagtttcctgtttatgaagacatatatcatggtttgccaattttgtggtgacttacacgtatacagggttgtgctccttctgcgagtggatgcgctaatgaataaataatgttagtaaaggcctgtgagtgaaacatgctatggatgctgcaagatttgtctagaatagatacctgcctgcatgcagagtctttccttccctgagattcacagagcaatgcctgcttgccatagctgaaggttttttggtgtttttttttttttttgagacggagtcttgctctgtcgcccaggctggagtgcagtggtgcgatctcagttcactgcaagatccacctcccaggttcacgccattctcctgcctcagcctcccaagcacctgggactacaggcacccgccaccgcgcctggctcatttttttgtatctttagtagagacggggtttcgctgtgttagccaggatggtctcgatctcctgaccacgtgatccgcccacctcagcctcccaaagtgctgggattacaggcatgatccaccgtgcccagccagctgaaggatttttaaatgaaacaatctttaaaaaatagtgtatatatacgtgtgtgtgtatctatatttatctatacctatatatatcttatggtaatacatataaacacacacacacatgaatttttgaaaaccatcttctctgcctggctatcaattaattacaaccttccactggcagcttggtggcatctttaattggaggaggtgtttagtgatattcccatgttccagattttgggcaggtgtgtctgctggcaatggcagagctgcacctggagctcagaactgagaagagaagacagaatctgctgcctggctgtgtgcacgagcgtctgaaccatgctaactcacgttctgttctctccaggtgttggccgaggtcctcacgggcatccctgcaatggataacaaccgaagcccggtttacctggtaagggaacttgtcacatctggctgggaggtatatttgggcctcacagctctgtagagagggcaacgacctcaattctagctagttttacacatgcaaatgaggcccggtacaaggttgcatttgcatccccacaaagcagctttaacctcccatccccacctgccagccaaccattgctttttcatgataatagcatctggggcttggtgcggtggctcatgcctgtgatcacagcctttgggagactgatgtgggtggatcatttgagatcaggagttcaagaccagcctggccaacatggtgaaaccctgtctctattaaaaaaaaagaaaagaaaaaacttacaaaaaacccccaacattatccaggtgtggtcgcatgtgcctgtaatcccagctactcgggaggctgaggcaggagaatcacttgaacctgggaggcagaggttgcagtgaaccaagattatgccactgcactccagcctgggtgacagagcgagactccatctcaaaaaaaaaaaaaaaaaaagattttggaatgtttatagaaagcacttgtataaaagagaaagcacttctctatatatcaggcaattcattagggattttcctcaaattgataaaagttaatttcagcccttttaaacaagtttctataataaaaacaatttccattttgtaggccaaagatctgatatacacagtcatttaaaaaatataacaacctggctgggtgtggtggctcacacctctaatcccagcactttggaggaggccaaggcgggcggatcacttgaggctgggagttcgagaccagcctgggcaacatggcgaaaccctgtctctactaaaaatacaaaaattagccaagcgtagtggcacacacctgtaatcccagctacttgggaggctgaggcaggagaatcgcttgaacccaggagacagaggttgcggtgagccaagattgcgccactgcactccagcctgggtgacagagtgagaccctctctcaaaaaagaataaaaatataacaacctagcctgactttgtgttaaatactttccatacattatctacctaaatcatctcaatttttccatgatagagtcattatattcatctgcagatgaggaaagctggctctgagtttggcctaggatctcagttggaattaccaagtgtcagagctggaattctgagtcagatctccctgagccgacatcatgagttttttttttgttttttttttttttgagacggagtcttgctctgtcgcccaggctgcagtgcagtggtgcaatctcggctcactacaagctccacctcccgggttcatgccattcttctgcctcagcctcccgagcagctgggactacaggcgcccaccaccacacctggctaatttttttgtatttttagtagagatggggtttcactgtgttagccaggatggtctcaatctcctgacctcgtgatccgcccgcctcggcctcccaaagtgctgggattacaggatcttgagttcttaaccacagcagtctcctgcttgtttcttgtgacagtccaaccatacgaattcagtattatcattcccatttacagctgagaaaactgagggcaagctgaagtgacttgtctcacgcccctcagtgagaccagtggtggaagtggggtttaaattgaacccaaggcttttgcagagtttcaaatctcatccaaactctagtcttcctcatcagtttgagagggggcaccttttcctactgggtattgaggccattggaacagacagattattattttatttatttatttatttctggtgactgggccccagaagcatcccctgggctctggggtagggaggctgaaggcctcgctactccatgcagaaagtcacgacatgttcctttgatgaactctgtgagttccaccccttttgggcagtcaatcccatatgctgcagagaggtctgtctgggcagctcagatgtggtttggggctgtttgggggcagtttctcatctcctgactattttcttgagatggatttcccagcagtcctctggggctccccggacaagtgtcacagtggaaggaggcttttgaggcactgacaggaagttgtctagaattatttttttgctaatgatttctaaaaatgtggaaaataacaattttttaaaatgtagtttctttctcttattctagactcttgtatggtctcttatcatgttctgttgtggtaggtgcaatccaatggttaatcaagatttgagtcagggaggaaagcttgctgatttcctgtggcccagggtaggaggaagcaggcctcctccaggcttgggaaagtgttagttgccacagtgtttcctgagggcatttggtggtttccacctaaattgaaaatatgagtaccctctgacacggcagttccatttgtgcctagagaaacatgcacacatgtgaggagaggcagatgaacaaggatatttgtagtggcatttttttttttttcgagacagagtctcgctctgttgcccaggctggagtgcagtgggcgtgatcttggctcactgcaacctccaccccccaggttcaagagattctcctgcctcagcctcctgagtagctgggactacaggtgcgcatcaccacacccggctaatttttgtattttttttagtagtgacagggttttgccatgttggccaggctggtcttgaactcctgacatcactcaggtgatctgcccaccttgacctcccaaagtgttgggattacaggagtgagccactgcgcctggccaaatttaatttaatttgatttagagatagggaggggtcttgccctgtcacccaggccagagtgcagtggcatgattgtagctcactgcagcctcgaatgcctgggctcaagcgatcttcccatcttggcctcccaaattgtgaggattacaggtgtgagccatggcgcccagcctgtatgagttttgacaaatgtatacagtcatgtaaccaccaccacaatcaagatacggaatatttttgtcaccccagaaaattccctccacttacaggtcctggcaattactcatctaatttctgtccacatagctctatcttctttagagggtcatatcaatgggcccatggcagatgcacccatttgtttctgtcccccttcatgtagcatggtgcttagattcatccatgttgttgacgtgtcagtaattcattccttttcattgctgaagagtattccattgtatggatagatgactgtttatccatttaccagttgctggacatttgggttatttccaggttttggcaattctgaataaagccaacacaaacattcttattttaaaaaaatgaaaaagaggccgggcacagtggctcacggctgtaatcgcggcactttgggaggctgaggtgggtggatcacttgagttcaggagttcaagaccagcctgggcaacatggtgaaaccccgtctctactaaaaacacaaaattagccctgtgtggtggcgagtgcctgtaatcccagctactcaggaggctgaagcaggagaatcgcttgaacctgggaggcagagtacagtgagtcgagattgtgccacagcactccagcctgggcaacagagtgagactctgtctcaaaaaaataaaaaagtaaattgaaaaagacatgtatgttctgacagggacatatctccaagtgaacaaagcaaattcagaatagtatatagtatgatcacatttttgctaaaaatagatggatgaatgaatgaaaacattgtatcacatattttcttctctataaattgaggataatagtagtacccccccccaccgacaaggtatgtttgtttgttatcatttttggagatagggtctcctatctcctatcttctttgtcacgaaggctggaggagtgcagtggcatgatcatagctcactgtcacctcgaactcctgggctcaagggatcctcccaccttagcctcccgggtagctgggattataggcatgagccactgtgcctggcatctgacagggttattgaaggttaaataatatgtgagatgcctaaaatagtaactagaacataataaacaatatatgttaactattagtattatcattattatttgagataaggtctctgccaccctggctagtatgtagtggtgcaatcatggctcactgtaaccttgtacccctggcctcaagtgatcccctgctttagcctcccaagtaattgggaccacaggcacgtgccgccactcctagctaatttttatttttattttatttatttatttttattttgagacagagtcttgctctgtcgcccaggctggagtacagtggtgcaatctccgctcactgcagcctctgcctcctggcttcaattgattctcctgcctcagtctcccaagtagctgggattacaggcatggaccaacatgcccagctaatttttgtatttttaatagagacagggtttcaccatgttggccaggctggtcttgaactcctgacctcaagtgatccacctgcctcggcggcctcccaagtacctgggaccacaggcatgtgccctcacgcccagctaatttttaatttgttatttgtagagatggggtcttgttacgttgcccaggctgatattgctattattttaacagcttttaggatactgttataattattatataagtaaatataaaaccaaaataattatagctgtatagcagaaaataatataatccaaactattagcaggagttacctttggagagtagaaatgaaaggtaaacttttgtccccaaattttaaccacttatgtttaattttaatttttttttgaaatggagtctccctctgtggcccaggctggagtacagtggtgtgcttttggcttaccacaacctctgtctcccaggttcaagcaattctcctgcctcagcttcccatgtagctgggatcacaggtgtgtgccaccatggcccagataatttttgtatttttaatagagatggggttttgccatgttgcccaggctggtctcgaactcctgagcccaagtgatcctcctgccttggcctcccaaagtgttgggattacaggtgtgagccaccgtgcccagccaaaagttgctttttaagggtggtttgtttgaaactagaccccaaaaatgtccatatattactttggttatgtttgtttttttcatttttaaaaaaaaattttatgtggagatgggatgtcactttgttgcccaggcgagtttcgagctcctgggcttaagcattcgcctgcctcaacctcccaaagtgctgacattacaggtgtgaaccaccacgcccgggcatggttatgtttcttaagactcttattcttggccgggcacggtggctcaagcctgtaatcccagcactttgggaggctgaggcaggcggatcacaaggtcaggagatcgagaccatcctggctaacatggtgaaaccccgtctctactaaaaatacaaaaaaattagccgggcatggtggcgggtgcctgtagtcccagctactcgggaggctgaggcaggagaatggcatgaacccaggaggcggagcttgcagtgagccgagatcgtgccactgcactacagcctgggcgacagagcgagactccgtctcaacaacaacaacaaaaagactcttattctctcacaacctctcccgcaatgccctttttcattttggatgtcgttggatttttgcatagactaggtcatttgccctatgtagacagactgtctcacattctgggttttgctcattacatcctgtggtctccttcccttgtttctctattcctcatatttcctatatttggcagttagcacttgtgacttgtttagagtcatggtcattgcctttgtcaagaacacttcctggaggcgctgtgagcctcccattgcttcactacacggggcgtagcctgttgtcctacttttagtgctaagaccgatcagtgtgttaaggttttagtgctaagattgatcagtggtttcaggtggagctgccgactcctccatggtgaagttccctcgacatcctttcatcgcgtgttctcagtcccccaacccctgtttaaacactaggtgtcttctgtagtttttttgattatcgtcatagtctttgcatcaagatacatagcaatgatggcaggtttccatttggggcaaattgtgagaccctgcctctagaaaagaagaaaataatacacttctactgttcttgattatcagctttaaacactagtacactttaaaaaaaaataaacatttaggctgggtgcagtggctcacacctataatctgagcactttgagatgccaagacaggaggattagttgagcccaggagttcaagaccagcctgggcaacataatgagactccatctctacaaaaaatttaaaaattagccaagtacagtagcatgtgcctatagtcccagctacttgggaggctgaggtgggaggatcgattgaatcgaggaggttgagactgtagtgagctgtgattatatcactgtgcccggcctatttttatttttatttcttatttatattttgagacggagtctcactctgtcgcccaggctggaatgcagtggcgcaatcttggctcactgaagcctctccctccccagttcaagcaattctcctacctcagcctcccgagtacccgggactataggcacgcaccgccatgcccggctaattttttgtattttttagtagcgacgaggtttcaccgtgtcagccaggctggtctcgaactcctgacctcgagtgatctgccagtctcggcctcgcaaagtgctgggattacaggcatgaggcaccgcacctggcctacaatacatgtttttacaatatttagtatgtttgtaacattcatatatgctaatcatatataccatattactcatgaaatatacaatataatttatattaaatatgcttacatatttgtataaaattattatatagcatatgttctattgtatgcatagttcagattgctgcattttatgtggtacaaaatataaaatatatgtaaatacaaaatgtataagaagtatagacataatattttctttatagtggctctcctgttatgtatataggtcagaatcctacatttgaaatgtttgtatcataagagattgtccatgtagttaataagattaaattattaagtgcttatcatgtagtaagtgccatataaatggtagctattattactattagttattatcactaaaagactattgaatgttccgtgtcagatgccactctctgtgctttaggtgcactgtttcattgaatggttgtgttagtcctaggtgtaggtattttattatttttttgagacagaatctcgctgtcacctaggctggagtgcagtggcgtgatctcagctcattgcagcctccgccccccacctcccccaccataggttcaagcaattcctctgcctcagccgccctagtagctgtgattacaggcgtgcactaccaagcccagctaatttttatatttctagtagagacggggtttcgccctgttggccaggctggctcgaactcctgacctcaagtgatccactcgcttctgcctcccaaagtgctaagattacaggcttgagccactgcgcccggccctggtgtaggtatttttgttgttcccattttcctgatgaaccaaccgaggcctagaaaaattaaggccccacgtttgtggcatgagttcactatggagtgccctgtgcatgtaggaaatcgaatccttctccatttcttgggggttttacttctttctggaatccttgcatttattcttacgatgtccggtcggttttctgagcattttttgcagctctggaggtgagtggggcgcgtgcgttggctctcgcagctctgcagctcacgcaagggcgtttctacccttcttcccacagaaggacttactcctcagtgaaattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgagcctcgcccgcagcggcctcgctgcctgggccacgcgtgggtccacctcatcggggacggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 750 - DNA, 47915 bp, Human
tggaccatattctctcattggtacagctgcaggagcagccccttgctaaagctgatcccaactctctaagatgaacttctagaggacataaacatttcttatgtgttctatgaatttggaaaaaaatcatacaatttggcatactggaaaatctatagggaatgcataaggtgacagaaatgcaaagttacaaagatcaggtctggtggaaggacaaggagagccagggaggaagaaaaaatgaatgtggacggataataataagtatctttttttggtgccttatcgcaaacactttatttgattatctcacatcatctttaaaacaaccctttgaagtcatttttaaccccatttgactgacagagaaattaaagcccagaggtaatcttcccaaaattacttgttggttaagaagcagagcaagagtcctacttgggtctcccaataccagggcccaagattttaaccactagtccggacaaggacagctggaaggcagattgtaaagccagagaagggaaaaaaggtagctacagagaaagggagtgaatcgcaaacatagccacagaaagagagggtctgagaaagaatggatcatgaagtacgtagagaaagaaaagagactggataaataaaggagtaggaaaaagaacagtggcagagttgggaagaaatcagccagggaaagagagaggcagtaaagtcattttaggttggaagtaaaacactgtggccaaatcacatgttcacttacctcagaacaacaagcaaaggaccaccagctcacattggatattttcattagtggaatcaccattgttgacagttcctcctttgctctctgacacttcaccatcaaaaggcttccccctgaagggagagatgatttcttgagctacatggacagtgaaaggggcaagtccacctccaggtaggggcagctacagagggcccactgtcctggcagcatctgggcaatactaggagaggcatggccttaaaggctatggtaagaacatctgagaaccatggggacccacacactgatgtgcccctgacctggctgagcttcagtcatcttccgggatcttcaacctgatgattttgttctgaatccctttccaaaatttgaagttactttcctttttccattcactggttgagaccatttacttctgaaataaatgatggagaagaatcttaagagaaacccagcactagccatgcaagggaatagcatgcagaaagccaagggtctggggtattgtggatgggagagaaagctgggtgtgaccagatcacagggtacaatagaaggcacagaagctgactctgcagaaatgagcagaaaccagaatataaatgtcctaatacaccctgctaaggaatttttattttctcttatttgcttcggggaagtatgatctgtttatttattaaaacagagacctcttttaaaactatagcatgttcattattgactaaattatatgacaccaagattaaagaaaagttaaacccctgggtacaaacccaaactcaacttttatgtgtgaaaccattttggtattagatcagggcttagatgcacttattgtagcactcaatgcccaaaccagataaataaaatattaaggggccacaaatggataatgatgacaatgaatcagttctctgcacctgggggacaatgaatagctccatgcccccatcctattggaaggcatgtattaagaaatccccttccccaagtaattctgagtctccagggtactgatgtgtgtcccttcaccaatcccagttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcaggtgagaaacagatcccatccaacacctgtatatcctcagcctaaggtgcctgtgccatgttgccgccaatcccagcatcttgacttttattgtcctagttcttctcttgcacccacctacccaaacacaacccttttcaagagggattatgagcactgccggggggtgggtaagacctagagtccagaacacctgcttcccactcccgggacattccaaccctctgcccttgtgccttgatgctctatctgccccaggcacttttaacattcactcttctccctgacatccagtccctgcaatctgtaataatttcctttcctccttcagtgaccaatgacaagttaacatccaaaatgaatgcggaagaagactcagaagagatgcccagcctcctcactagcactgtgcaaggtaacactgactggggctgataccgcttagctcaaggtgactgtgaagggagaacatgcgtctgccaaccaagaggctatggtgggaaccctgggaaaaagaactgagcaatacaaaggaaaagaaacagaaggggccaattcaccaacgcagcaatgcaaaacaaaccaacaaccaaaacaccattctgaattgacaagtaacctgcgtaacactcacactagtgacccttagctgattcctcacccccacctgattatgggggccttagagtttcaacattcttcatttttatatggtttggattctaagaacaatgttatcaaaattactagaaaagatgataaaatgtttaaaggtctgctagacctaatatttagcttctcaaattgtatcacttgtcctccccaaaccatcatcataatggagtttgattacattaaacgtaagaatggtatgatattgggcattgtcaaaaatgataccatggattctgagctctccagtactgagaagaggggtcctcttcgatccaaataatattgcatccactcctctaatacctaccatccaaaaaggttaacataatcaggaagctaacagcaatggaagaacaagtggctaattgagagtgaatggttgcttactttcccactctatgccatcctttcccaggccttggttgctgttaccccgtcatttttacttgttggaatagagcattctcttttctcctcattctggtccctgcttgctgttcctgagatctaaaactttttcttcctccattcagtggccagtgacaacctgatcccccaaataagagataaagaagaccctcaagagatgccccactctcccttgggctctatgccaggtaatcttggtttggtcaacctaaaagcttgcctttgtttctgtgtttactaagaggaaaagccattcggatcttctagagagggggctctcctcctgcctctcagcaatcttggcccagcttccagttcacccagcacttgggagcttgaacaggcaggagacccgacctctgaatggatacagagtccctgggggagggcaaaggaggcaagtctggaaaaggtagacttggatagggccacggatgatgatggacagagccccaccagtgcctgtaggtttggactccaaatgccacaaagcgcctgaaagggaaacattcacctgccacaaagggttgtggcaggaaccccaggggaaagcaagggaactgagtcaggctggactgtttgacagagccactcttctgaggccacttcaataaagtagtgctcaaaacggctctgtcaaaatgcaaagcaaatgaacaaaaacactgtgtggccctaatagtgaattgctgcagcagacatggatggtcctccttccaagcccccacctgactgtggggaattttcactttcaaccctggtcatttctatatcacttggagtttaagagttgatattatgaatataacttgaaaggtaataaattattccaaagatctaatgactgcttgccacctgcctcagtcacctattcctaagcaggccagcatttgagaccaatctcaatgcagtgtgtaaagaaaaaggtgacagcttcatgtgagatgagcctttatttgttatggcttcaagttctctgtctttctttgtgcagcaaaaactagcagagctttatatgtctttgctgttaacaggtgctagcaagcacaggctagctcctgctttcttcaaacaatccttatatacagaaatatataaggcatttagccttctccactatttctccaagtaaaataaccacagatagagcagttaaagaatatccacacatagacgtcaaagcaataagatgtatttttcatacagcaaagacattccccttcatcatggacatcagatttcaatatcaccactttccgctctcagcttcattccttgagcaggggctgctgggagcagaaaccatgtgactatagtcatgatacccagcacagtttattcctgcaatttccattcattgcaccttcttcactcacttctcttccatccataagataatctctctaaaaggatcagactgagcctctgctgtggggcagttgtgccctagttccctgtgatggtcgcacaggtaacaataaccacaagttggcaaaaatcaagacagagccagggaattcttagggcaagcagattcccggccctgggctgcatgtactttctacttttctagttcttgcattgacttccctcagcactttctcttcactggatctgagctctgaaatgacttatatttcttttgtcagagataagagataattctccagaaccaaatgacccagaagagccccaggaggtgtccagcacaccttcagacaagaaaggtaagaaaagcctttcttctgtagaggtcagaagggtgaattcagagttgctttctgtttttctgactgtatcttgtcaagagcaccactatgtgaccacagtcctgatgccacacacagttcgtttctgcagtttccatttgctgcatcttccaaaaaggcctttatgaaaattatcaggaaaccagaaggcatttgggggtattgaaatatgccattggaattgcctgttctgaaaaaatcaatctcctatattcacaacttcttagagtgttaattgcacttccctctttaactgaaagttggttccccagagaggaacccacttcctcttaagacatggctaggcattctctgccatccatcactcacacctcatggtgagagacaggttagatgtctgtcctttgctgcctactggccccatccagccccttcctccctgatcctctcctttgagtcttaaccattcaattaaaatgttcactcactcatcatcaatatcatccaataatttccccaataatcctttcaaaagctgcttttctgtcatttcaagtcccagcatcatcctagatgccttcagggtacacacggataacagacaactctgttatccaatactctggcccctcaaatccttcatcttctcattttccatgactttttcctccaccaattcttggcctcccatacccaaaggcaagctatagaccctatcgtcattcaaacctggctcgatttcccaacagttaatttcagaattccttttttgatacctgtccttgagcttttctccttttatagctatcattcaacctctgatcactctttcccagcccaatcctaacaaaagaaaaagaatcaaaaatatatttttctgtgcttatttatttgttgtttcctctgaagttgtccttcaacctcatttggatcaccagtccactggcctttcctccttccaagccatcatctgcttttctttgcttcccagctttttaacattgacactaactcacagtccaagattcatcatttcagtaatctattgccattatcttaaacctgcctttcctctctgccttttcctagaactctctggcaagtcttggaagaccctacttacctacttcctgtacactgcatctgaaagccagcagtgctggagagagttccacagcagggcagagtgcactcactggtcttcatggttccagcacaaatcatctctccttactgtgtgacaatgctacttcctgcaataatcctttcaaacctcaagccctatttttcaaacctctgaccccctcacctcctgctttttgctcaatcagtgactttccctcctgcaccataaggagatatcagatgagaatccccttatttgtgctgctagtcctacaaaccctaactacatctgtctccctcctctccgagttccctccttctcttctaagacaatccttctgcctcatcttatagtatccatgatcccttctctctcaagtattcattaaagcagtatgtctcacacaagaatctgcattacatgtatcacagctcattaaaaaatgctttttcttgattctcatctcacttcaactacttccatatctctctccttcatttcacaaccaaacttctagaaatgagctacctaaactccctgtctctatttcttcgtttctccttttcctctgtcattttagagtccttcttcccctattactccctgaagtaccatcacctaaggtcaccaatgaacttctagcaatgtggtttgaagaccaaaagtaaaagctgaatatcattgacatacaagattgggagatcaatgtttgtaactataaaacattatcctttctttttaggaaagaaaagaaaaagatgtatctggtcaactccaaaaaggagacataagaaaaaaagcctcccaggaggtaagatgagagtacaagaggaagctggaggctggaaacagctcatgcagggcttgtaggtcaagctgtggagggttgaattttattctaaatgcaatgggaagccattgaagagatttagtcagtgaagtgacacaatgtaagctcaattttgctacggtgtaaagaatgagttggagctgggaaagaatggaggcagggcagccattttggggcagatgccatgagagttcttggtggcttggattcagatctgacagtggagatgcagagaagagtgccaattcaagatcagttttgcaggtattgttgacaggatttgacatattattagctacagatgagaaagagaaaaatcaaggcccactcttcaatttctggcttgaacaagtaagtggtaatgcccattgctgagggaagatgcaaatatattgggggataactcttagagttcaattattgacctgttcctttagaggtttctgctagccatctatgcagctgtgtatagatgtgtgttttgtcaagaactgtaaagggtctaagatgttactccacttgcattggtatctccttatatatatgagtgctgcaggaacacaaggtatctggtcagggaaaataattctttactgatattcacaaccagcttatcagccagagcaatattgcagcgtctgtctcccatacacaaacccaaaggcaatgctaagagagctaatggaatctttctattcaaaatagactacaactcatgtataagggatgtagaatgatggatttttctgtttagatacatgagagggatagccatcatcctttcctcctgaaaggaaaagaaaaaactttgctgctttgagataaaatggaaaagatcctcgttccaaagctctccatcctaacctttggaatttaaatgcatctttccaaaggccagagaaactctaggtgttgctggcttttacaacctaaagatgtctccaagttctgggctttaccccttgtgatatataaatacctagggaaagaccactccagttttcctggtactttaggatttaacctaggaagctagtcctgggtgaacccatttggccatctcaggagataagagaggttctattctccctctagatcagagtaattaactagaaaaatagctatagctctaattctcatggtgtgggaagaggaaaatgtttctggggaagtgaaagcaagtatttcctatatttatattgcatacatttctgtgtctccgggactagggctttttacaggaacactgagaaatcaggaagttatattccccacaatatggcaatttggcactcactgaaaaagtgtggtccatatatatatatatatatatatatatatatatatatatatataaaatctggaccagataatatataatatctggaccagatatatgtatatatatgagttatcaataaaataaaggtattctgatctatgggagaagaaaagagaaccacagacctagccctgctctaagtaatcccagtggaagaggaatctagcaagacagactgagggaacgagaccagtgaagacagaggagcaccaagaaagaacatgttagcaagccaagagggaatggttgactatactgagagactaagataaattcagagaagagggccttgagtttggtcacaaagaatcactggaaaatttaagaaaaattttggtgatggaggcaggagccagttgtgtgggaaggataatgaatgggaggtgataacatatgtagacaactctagctgtaaaaggaaacagagcaatagatggcagcctaagccagtggcttaaagctcctcttccctgacttagtttatcattagtatgatcccagtgtccaaaatcacagggctggtgtccttttaagacacttaacagaaatgattccattctaagaaaagtaagtgaccttcctgggcaggaaggagagacaagctgctttctcccccattctacttattagtcaatgccctctcaccatgttatgtgtattctctatgggcctccttggttcattgtaaactagtcagattattcaactcacacttctgagctttgtcaatcactctcacaacttcaattaccacctttatactgatggctcccaactctacgtcttcaactcaggtttgtcttcaagaaacacatagccagctgcacactgggcgtctttgtttgcaagtctcccattgacactacagtctcaatatgcctgaaattaacttcaccttctttaccaaaaacctagtcttctaagtaccattcagacatttattccaacaaatatgcagtgagcactaactgtatatacccattctgaaagctgaagacagattttttttttaaagagagaaagtaagaaagtaagcaaaaaacaaaggggaaagctcatggaggttacatcctggctgggggaaggaaagaatataaactagaaagcacataaacaagataatttcaagtactgatgacaggatgaaagaaaataatggataggattacaatagtgacttgcaggttggggtgggagtcactttggattggatggtccaggcagagggactcaaaagtgcaaagaacctgaggcagagaggaaagaccagtgttgttggtgatgatgaagaaagaaggtggtaggaagtgaaaaagtaaacaagaatcagattatgtagggtttcacaggcccttgggagcctgttgtagtttaacttgaaatgaggaacttaatctacccaggtgccaagcaaaaaccttagtcatccgtgactaactgaactctattagcatattgacaaggtctattggttcaccctcttcttttctacattaaaatctaatttagtttatttgccatgcttaaatcttgtccatggcctcctattgccccttagggtaatgtcactgtcccttaatgtgattgttaaagttctatccagtctaactcatgccttaccctccaactattaatatatctctttccactcaaaactccagtcaaccactctgaacttcattgtcttcccatttcatttctctcccctttgatccttggcatgtgctattctctttggatgctatattctgaacctacactactccccataaatgtttagttatctccttttcatcagtcgtgttgacttatgtctatctcaggaatacatactctgacccctaaattagccaagctggtcccataatttctacagcacccagcactggctcttttggaaggttccaaatactctattgtaattacttacataatgtgtctcttctaggctagatggtaatgtcctggcacaaattagctattaatttttttttaatgaaaaaaaaatgaaagaaaccatactttctgtaacccaaaatttgaataatgatctgacaaaggatagtttatgaattcattattgtgttatgaaaaggggtcatagacattatgggcaccacgtggtgtagatacaaactaaaggttattggagggaaatttccaatacaattctccaaattcttattatcccatatttagggcagacatacgtactctgcacaccccgtggccagcagcccagtagtgagatgcccactctcacaatgctctacacgttataggattagggagacagggaatgtctatgcaactatacaattatgaacactccctggtcagagaagtgactttgttagagaggggaaacctctggagtcagtgtcagatggtcagttctgttgaggtaactctgaccttttgacatctctctgccaagctaccgaaaggagtagactccagtcccttccagatttgcctttcttcatattgtatttaaatgaaatttttcaggttttttaaaagaatcgttttattttaaatgtgacagatgatgtgcttttaattttcttttttccaattttccaattttttacctgggtaaaatacacatgacataaaatttatcatctcaaccatttttaggtgcatagctcaatggtattaaaatacattcacaatgttgtgcaaccatcaccaccatccatctccaggactcttttatcttgtaaaactaaaaccctgtacccattaaacaactccccattcctccctgcccgcagcccaacagagatatttttaagagtcatattattttacatttaattaatcagctttattttttacaaaacaaaacacataaaaagatgtttcaaaattgtaagagaaaaatatatatagtagtgctgaaaatatacataccacactctcatattttctgtaagtgttctcatctccgaaaccctcctttagttatgcagaaaaaaaaccctaaacttggcaatgaaaggcaagttttaggctctatcaggctgccccacctcttctggataaatattcagtaacttccgtgtttgaacttcccgccagccctgggtcccaccgggctttcgcttccgccccctcttaagggttcacccatgccttttcctccggaagtggcctgcggatatcaccgcacttgcgtgcgggaagcatggctgcacactctgtgtcctttctaacctgcagagaaacgttcttgttcaacaggacagcggtcatcctgtgggatcagcttctaaagtcaacagccggtgaaaattgtgttctttttccacaatgaagcaaactcacctctgcaccctctggcattgcacctcctctgggtctcagcctcaccttccatctctccctcatggtagccgccttcttggcagggtccttccctctcagtttttttaataccttgcactttgcccactgaaggcacctagaaacttttggaaatctcttgtaccacacacaggccgtgggggaacctggagaggtgctttataagacacctcctctccacctagacgagactgtgtggccacctcgtggtgcaggccgacacaaacgaaaatcaggaaataagctctaggatttccccagctttatctagttgattgcaacaggtcataccaggagtgaaagcagatggtaatttggggaggcaaagaaaggtacacataagaagaaggatataattatagagaagtaggaggagaaaagtgaggtacaggggtacagagatctgaaagagtgggagttaggggcatgagaagggaagtcactgattgggactgtaggaggctcactgaagaccccaatttaaactattaacaagtcattatttggtccagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagagggtaaggctgatgatggaatctgccatttgaatggctcagtgtgggagggtctctcctgaagcaggtacagagttaagtagatatgtaaagtcaatagtaaaaggaaaaagtacagagaatgaggatggggtataacaagaggaacaaagagagcaagcatctgttgcatctgaaaagttttgtggaagaaacagacgtgttcacagggacagctgtggcctggggcagcagctctcaaattttttggtctcaggactcctttatgctctcaaaaattattgaggaccctaaggagcttctgtttatgttgtttatgtctatctacatgtacctgattagaaattaaaactaataattttaaaatattaattcatgtaaaagtaacaataataaaccaattgcctgttaacataaatagcattattttatgaaaagtaaatatattttctaaaacaaaaaaaattagtgaaaagagtgacatcattttatgtttgtgcaaatctctttgattgtgagtgagctttataaaaagacagctggattcctacaactgtttctgcattcagttgtgatatgttgctttgattgaaggatagaaagaaaatctggccttacacagatatctagtttaaaagggtgaggtaatttaacagtcttttgagatatctgtggatattcacctttaatactacaccaacactcaacaagtgatagtttcttaaatattagttgtaatgtaaaatttgaaaccatatcaattaacttcatactctgttacaataaaatacattaatccaccttgcattttgaatggaccttctactaatgcaagattttataatagtacagctgtttggaaaatatacatttggaattatacagtgagcttgtatctcaatcacacaagtgttttcttgaggccactgtggtacttcaggatgcaatagaagtgctttatatgtgctcttcagtttttcacatagaatattaagatgtcagatatgtactcaagggtagaaatttaataaaattaataatttttactggctcaccaaaaacattctcaagtgaatcttgcttttatttttattttttttggtacagtgagtaggtggcaataaaggatgcagtgattcctgctgagatttggggacactgctttgatgtgtcttaaggcaccagcagttttatctgccattgctcttgctcaatctgtacaaaggttgaaatagtgaaaaaggcaaataacatcatattatgaaaacaatttgaccttgcaaattttctgaaacggtttgacagaccccctaggggctcacagaccttactttgagagactctggccaaggggttcagatggctgcaccccactgtggatgtctccattggtagagtaaccactgctaaccaactgcggtctgctcctcccctgagtggcagacaggcacagtgtcatgagcagcaccaaatctcttggtagatgcattgttaggagggtaagacctggagcctccaagactcaacttcagagtgtgcaagggccttcctgggtctctgggagattctccatggtgtttcccaaggggcatttactaagatctttcattttccagagatcattgatggcacttcagaaatgaatgaaggaaagaggtcccagaagacgcctagtacaccacgaagggtcacacaaggtaaaacttggagattgctggtctcagagtacagtcaccaggaatctaaattcagagctgtcttacactgaggcaatatttcttaacttttttttttcattattactgtgctagagagcccttctggatttttttttcttaatcaagacccttcccatgatatttactactacaaatatatgtccattttatgtaatgtgtccatatgtatgtatgtatatctgcactatataagatttttctcagcactcaagaatgagtttttccactactggcagcaatatcaccattactgagaatgagtgtcctaagtatattcatggtactatactgaaagtacagcttgtccaaagtgcagcttgatccaacccatggatcaagctttttcctagaattccaatctccatatttctcatgtggcctttctgagaaaattgagaagcgaaaaactcattaaaacacacatgtgacactatgactgagcatgtacaactggtggagttgtgggcatgtgctggtaaaattgtgcatgttaattcacccctcactatcgctaccattattcacatttctggagtaagttgataacactatccttagaggggaaaaaacagctagatattcgtctgtttgctggtgatatggtcattgtcacaaaaatcacagaactctcacatgacaaatgtgattttcaaacaacaaatatctaattattgtcaggaaaaatggattaaattttaccaccttaaaatctaaattatcattttaacagtttctcctatattgcactggcttatctagtagtatttcaacttttctcatggataattttattttattttcacaaccacccttggagaagattgaatgacctattccaatttagcagatgaggaaattaagatatggaaaggattaatggatttttttcaggatcccctgggtaagggctggctgccaccgggttaacaacctggtccccaggaactcttttcaggagccatcgttctccatagaaaggaaggggcagaaagaatactgtcaaacctttgtcaattcactattgcccaaaatagaaaactgcttattcaaaaattactttctcattacttccaagatcctatggataatggaaataaactctctctgggaaaatctcccagggcagagcataagtgtgaagaagaaactatttggtctctgtggtgtggattgatgttaccttactgttattatgccattctaggccataaaagacatccaagccagaaaaagcgttatgctttttaaaatcatgatttcactttttttcaacatagaaaagttcctggacttttctaaaagcagtgtgctgtcaccattaggattatgttgctggcccagcacagtggctcatgcctataatcccagcactttgggaagctgaggtaggtgaatcacttgaggccaggagttcgagaccagcctggccagcatgatgaaaccctgtctctactaaaaatacaaaaactagccaggcgtggtggtgggcgcctgtaatcccagctacatgggaggctgaggaaggagaatcgcttgaacccaggaggcagaggttgcagcgagccaagatcacaccactacactctagcctaggtgacagagtgagactctgtctcaaaaaaaaaaaaaaaaaaaaagaggattatgttgctgtgtgtgacagcaaacctcaccccactaaaaaaaaaaaaaaataataataataataataatagtagctaaagcaagagaggtaggtggtcaagagctggtgtcatacactgtagggtcctgggcttattcttgcttgttgctccatcatcctcagcatgtggctccatcatcctcagcatgtggcatcccctttattgaggtccagccagcatgtctatgttccagctaaagagaaaatggcaaagtcaaagaagggcacacctcctccactgaaggactctaaatgcttccggtcacagatagtaatttgctatcattaataatttgctattgggaggccgaggtgggtggatcacttcaggttggaagttcaagaccagtctggccaacatggtgaaaccccatctctgctaaaaatacaaaaaaaattagctgagcctggtggtgtgcacctgtaatcccagctactcaggaggctgagacaggagaattgcttgaacccaggaggcagaggttgcagtgagccaagatcatgccactgcactccagcctgggcaacagagcaagactccatctcaaaaaagaaaaaaaaattctatcattttattgccaggactggttgcacggccacacctgacttcaaaggaggctgggaaatgtaatctttaatctataagaataaggggctcagaatcaggggctttattactaaagaaaaagggagaccagagaaagaggaacaactagcagtgctcaccctgcccatgtttatggtgggcattatgactgccctcctctagttccaattcttctccccttcccagacacttggaaagctccattatcatcccccttgcaggaggcagctctgctatactagctctggcaaataagccagagagatgggtgtcacttctgggtcacagcatgtaagagcccattgcagctctccacattcttttcccgcctgtggaagtgtgtggaagagggaggcgccagaaggccaaagcagcatgacctaccacatagaggacagcagccctggagggccctacagaggacttccagtcctacagagggtcctattgtcctacagagaacttcatgtgatagagaaatacacttttcaatgttaaaccaccaaaatttggtttcatttgttactgcagcacagcctaccctgtcttgtgtgatacaatattcctaataaaatcttcagtgtagaaaattgtaaatcaggctaggcatggtagctcacacctgtaatcccagcactttgggaggccaacgtgggagaattgcttgagcccaggagtttgaaaccagcttgacaatgtagtaagaccctgtctcaaaacaaagaaaaagaaaattatatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaagcaataccattcaggatataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaattaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtacactagttcaaccattgtggaaatcggtgtggtgattcctcagggatctgggactagaaataccatttgacccagccatcccattaccgggtatatacccaaaggattataaatcatgctgctataaagacacatgcacacgtatgtttattgtggcactattcacaatagcaaagacttggaaccaacccaaatgtccaacaacgatagactggattaagaaaatgtggcatatatacaccatggaatactatgcagccataaaaaatgatgagttcatgtcctttgtagggacatggatgaaactggaaaccatcattctctgcaaactattgcaaggacaaaaaaccaaacactgcatgttctcactcataggtgggaattgaacaatgagagcacatggacacaggaaggggaacatcacactctggggactgttgtggggtgcggggaggagggagggatagcattaggagatatacctaatgctaaatgacgagttaatgggtgcagcataccaacatggcacatgtatacatatgtaacaaacctgcacattgtgcacatgtaccctaaaacttaaaatataataataaaattttaaaaaaaagaaaattataaatcataaagttaaacatctatttaatctgcttcccccactttatttttgtataagtatgcatacatttttctttttatatataagctcatactatatagtctattctataaatcacttttttcattgtgtatcatctctgtatcaatgttatctatttttttaactgcatggcacgttacgtatgattcaccgcaatttgtttaaataatcacctactagtggacagtttatttcttatttttatatgaaaatagaaatcaggtttgtgtgtatttgtatctttgcacacttgtccaataatttccttagaattgattcttaaacacaagcttacttggttaaaatctatatcttaattatacatgttaccaatttgctgtccagaaaacataatgatttatattccctttaacaatatatgagtattcatttcctacatcctcaatgctggatgtaataaaactttttaaatgtttaggtatccttaacatccaaacaatgagtttctttgattagtagtaatatagagatgatttctaaataaatttgtcatcttcatttcctccttgagcatttttaacttatattttttgcttattttcctagattaccattcatcttttgctttatctaataaggatattaaccttctatatgctatgtatatttaaattttgtttttgctttaatagtgtcggggtgttttttgaactgtgaacagtttttttcagtcctgctccttctgtatatttttaattttttaaacattcaaatctgtttatctcataactgtgtaatttctggccctgaattttggctaggaaaccttttaatatccatggtttataacaatctttgtctagtcttgaaaaactgcttattaattttaaaattaataaggcatgccggctcatgcctgtaatcccagcaccttgggaggctgaggcaggaggttcacttgagtccaggagttcaagaccagcctggccaacatggtgaaaccccgtctctactaaaaatacaaaagttagcctgggggtgcatacctgttatgccagctactcaggaggctgaggtgcgataatcacttggacccaggatgtggagattgcagtgagctgagattatgccactgcactccagcctgcataacagaacaagactctgtccccaaaaaattttttaaatgacatatattaaatgttagtcctctagtatattcctgatccatctttattcaatccccaaattcaatttccagctaaaatggagtacttttttcacataggtcacatggttttcttgccttctcaaagtcagggaaaacaggaaaaaaattacttaaaaaagtaatgacattgcaggtttgtagatcaatatttgtagccataaaagatgtgggttttttcttttttagaaaaaaggagaaaagaatatggccaagttcaaaaagaaaacagaaaaaaaaaatgcccaagacataaggaagaaaagtgaaattgttactctcttggtgtttatcaggcccctcacctgaccagctggcatgacctcctctccagccacatgtgcctggagcatagccagccccaaccttgtcccctaggccaccccatcagtagactccccaacaaaggaagagcaaacctaacaccaacttggtttatacctagtcttcttttctcttatcatagggagggaatggggttgaggtggacatgaggcatcagacaattttgagattagaattgtttcctgtctagggtcagagcccagaagaatagacacaagtaacctaaatccccaggcaggattcagactttcagttccaaactggattagatttggagtcatagagtgttcagaactacctcagtcaacccatgcttgcttgcatgcctgcatgcatgtgtctactccagtgcacaaactgtgttacttgcagaataagaaacaaaaaagctgcatttttctggttcctctgcttcatcccacttttctttttctcctctgtattctctccctcttccctttctctgttcctttctttttccctttttctttttttaatttattttgtaaattttttgtatagaccaggtcttgctatgttgtccaggctggtcttgaaatcctggcctcaagtgatcctcttgccctagcctcccaaagttctcggatacaggtgtgagcccctgcacctggcccctttttctttattcttttactcaaaattattcacaaagggcctaagatatgccggtcagtggggattctcttggattctatacctttatgggagccagcctgggaagagatcttgtcccagctcccaaacatgaattaggacatgaggctcactgctttggaaatccctctaatttttctgcttgttcccagcatgcctcaatcttggggtttggcctagaaggaaagtcatatctgcctgcttgcacttcccctccctggcctcttcttcctagttccccaccccactgcctccctaggctggaggaaacatactctctgtcatttgctgagtgttcactaccaatgacttataggaaaacttgacattcagacctccaaagttttcttttgataggtacaggtaatttttggaatttataaattcctctttgctcccaacaaatactgtgcttcaagattttgtctaagcttgccaaaatggccccaactgagcagtggcttctcaattctagcaagcatctgccctccccctgaaacctattgatgtaatagtcagggaaatctttactatttgcaaggatgaaaaatacatgattcctcagcagaaaccttacaagctggaagggattggagtcttatctttagtctccttaaacagaataactctcagccaagaattttgtatctggcaaagctaagttttatgaatgaaggagaaataaagtcatttttagacaaacaaatgctgagggaatttgtcactaccagaccagctttataagaaatgccaaaaggagttctaactcttgaaacaaaagattgatatgcaccagaatacaaactcttgaaagcataaaactcacaaggtctataaaacaataacacaatgaagaaaacaacgtatgtaggtaacaattaacatgatgactgaaacagtacctcacatcttgatattaatgttcaacataaatgggcctaaatgctccacttaaaagatacagattggcagaatggatacaaaatcacaaaccaaatatctgctatcttcaagagactcacttaacacacaaggacccatataaattcaaggtataagggtgaaaaaagatattccatgcaaatggaaaccaaaagtaaacaggagtagcttttctcatatcagataaagcagactttaaagcaacaacagtaaaaaaaggcaaagaaggtcattatataatgataaaaggatcaatctaacaggaagatattacagtcctaaatttagatgtagctaacactggagctcccagattcataagacatttactactagacctaagaaaagagataagacaacaacacaataatagtggggaacttcagtattccactgtcagcaccagagagatcattgagacagaaagtcaaaaaagaaacaatagatgtaaactacactctagaacaaatggacctaatagatatttacagaagattacattcttctcatcagcacatggaacattctccaagatagaccatatgatagccacaaaacaagtctcaataaatttttataaattgaaattatagtttgatgggaataacattgaatctataaattactttgggcagtatggccatttccaagatattgattcttcttatccatgaagatggaatgtttttccatttgtgtcctctcttatttccttgaggagtggtttgtagttctccttgaagaggtccttcccatcctctgttagctgtattcctaggtattttattctctttgtagtgattgtgaatggtagttcatcatgatttggctctctgcttgcctattgttggtgtaaaggcatgcttgtgatttttgcacattgattttgtatcctgagactttgttgaagttgcttatcagttcgagaagtttttgggctgagatgatggggttttctaagtatataatcatgtcatctgcaaacagaaacaacttgacttcctctcttcctatttgaatacgctttatttctttctcttgcctgattgtgctggccagaacttctaatactatgttgaataggaatggtgagagagggcatccttgtcttgtactggttttcaaagggaatgcttccagcttttgcccattttatatgatattggctgtgggtttgtcataaatagctcttattattttgagatatgttccatcaatacctagtttattgagagtttttaacatgaagggatgtagaattttatcaaaggccttttctgcatctatcaagataatcatgtggtttttgtcttggttctgtttatgtgatggattatgcttattgatttgtgtacgttgaaccaaccttgcatctcagagatgaaaccgacttgatcatggtgaataagttttttgatgtgctgctggatttggcttgccattattttattgaggattttcgtattgatgttcatcagggatattggcctgaaattttctttttttttgttgtgtgtcttcccagttttggtatcaggatgatgctggcttcataaaatgagttaaggaggagttccctccttttcaattgtttggaatagtttcagaagtaatggtaccagctcctctttgtatttctggtagaatcagctgtgaatccatctggtcctgggttttgtgttgttggtaggctattaattactgcctcaatttcagagcttgttattggtctattcagggatttaacttcttcctggtttagtcttgatagggtgtatgtgtccaggaatttatccatttcttctagattttctagttcatttgtgtagaggtgtttatagtattctctgatggtagtttgtatttctgtgggatcagtgatgatattcccccttatcatttttattctgtctatttgattcttctctctcttctttattaatatggctagtgatctattttgttaattttttcaaaaaaccagctcctggattcattgattttttgagggttttttgtgtctctatctccttcaatttttctctgatcttacttatttcttgtcttctgctagcttttggattagcttgctcttgcctctctagctcttttaattgtgatgttagggtgtccatttgagatctttctagcttcctgatgtgggcatttagtgctacaagttttcctcttaacactgctttagctgtgtcccagagattctggtatattgtctctacattcttcacagaattagaaaaaaaaactattttaaatttcatatggaatcgaagaagatcccatatagctaggacaatcctaagcaaaaaggataaaacgggatgcatcccactacctgactttgaacaatacgacaaggctacagtaaccaaaacagcacggtactggtaccaaaacagacatatagaccatggagcagaacagagacctcagaaataacacgacacatctacaaccatctgttcttcaacaaacctgacaaaaacaagcaatggcaaaaggattccccatttaataaatggtgccaggaaaactggctatccatatgcagaaaactgaaactggaccccttcctcacatcttatacaaaaaataactgaagatggattaaagacttaaatgtaaaacccaaaaccataaaaaccctagaagaaaactgaagcaatatcattcaagacataggcatgggcaaagtcttcatgataaaaaagccaaaagctattacaacaaaagccaagattgacaaatgggaattaattaaactaaacagctacagcacagcaaaagaaactagaaatagagtgaacaggcaacctacagaatgggagaaaaattttgcaatccacccatctgacaaaggtttaatatccagaatttacaaggaacttaaacatatttacaagaaaaaaacaaacaactccatcaaaaaatgggcaaaggatatgaacagacacttctcaaaaaaaaaaaaatttacgtagccaacaaacatatggaaaaacgctcaacatcactgatcatcagagaattgcaaatcaaaactgcaatgagagaccatctcatgccagtcagaatgacaattattaagaagtcagaaaacaatagatgctggtgaggctgtggagaaataggaatacttttacactgttggtgggagtgtaaattagttcaaccattgtggaagacagtgtggtgattcctcaaggatgtagaaccagaaataccatttgacacagcaatcccattactgggtatatatccaaaggaatataaatcattctactgtaaagacacatgcacatgtatgtttatcgcagcagtatttaccatagcaaagacgtggaaccaacccaaatgctggataaagaatccagcatttagactggataaagaatatgtggtacatatacatcatggaacactatgcagccataaaaagtaataagatcatgtcctttgcaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtcccattttggggggttttttagaagaaaaaaattgaaattatattaagtatctcctcagatcacagtggaataaaactagaaatcaactccaaaaggaactttcaaaaccataacaaataaatggaaattaaataatctgctcctgaatgatttatgggttaacactgaaattaagacggaaattagaaaattatttgaaatgaatggtaacagtgacataaattatcaaaacttctaggatacagcaaaagcagtgcttttaagaggaaagttcatagcgctaaatgcctacatcaaaaagtctgaaagatcacaaattgacaacctaatgtcatgcctcaaggaactagagaaacccaaagctagcagaaaaaaagaaagatgagagaagaatgaaataaaattgaaacaaaaaataaaaaagatcaattaaacaaaaagctggttctttgaaaagataaacaaaattgatagaacattagccagagtaaccaaaaaaaaagagagaagtttcaaataaactcaactagaaatgaaactggagacattacaactgacaccacagaaatacaaaagatcattcaggactactatgaacacctctatgcacaaaaactagaaaaatctagaggaaataaataaattcctggagacatacacccctcctagattaaattgggaataaatagaaaccatgaacagaccaataacaaacagtgagattgaatccagcagcccatcaaaaatataatacaccatgatcaagtggatttaatcccagggatttagggatggtttaacacatgcaagtcaataatgtggtacatcacaaaaacagaattaaaaaccatagatcatttcaatagatgcagaaaaaacatttgataaaatccagcatccctttagataaagatcctcaacaaactaggcatagaaggggcttacctcaaagttataaaagtcatatatgacaaacccacagccaatgtgatactaaatgggaaaaaatctaatgcattcccctggagaactggaataagacaaggatgcccactttcaccacttctattcaacatagtactagaagtcctagccagaacaatcagaaaagagaaagaaataaatgacatccaaattggaaaagaaatcaaagtatcactgttccctgattatatgatcatatacctagaaaaccctaaagactccttcagaagactcctagatttgataaatgaatccagtaaagtctcaggttacaaaatcaaatgtacacaaattagcactgctatacacctacagtgaccaagctgagaatcaaagcaagaactcaatcccttttaaaacaacttcaacaaaataaaataaaatacctaggaatatacttatccaaggagatgaaagatttctacagggagaactacaaaacactgctgaaagaaatcatagatgacacaaacatatagaaacacatcccatgttcatggattggaagaatcaatatgaaaatgatcacactgcccaaggcaatctacagattgaatgcaattcttatcaaatatcaacatcatttttcacagaactggaaaaaaaatcttaaaattcatatggaaccaaaaaagagcctgcaaagccaaagcaatcctaagcaaaaagaacaaatctggaggcatcacattaccagacttaaaattatactacaaggctatagttaccaaaacagcatgatactgttataaaagtagatacatcgaccaatggaacagaatagagaactcagaaataaagccaaatacttaaaaccaactgatctttgacaaagcatacaaaaacataaattggggaaatgacaccatatttaataaatggtgctgggaaaactggttagccacatgtaaaagaataaaactggatccctatttcccaccttatacaaaaattaactcaagatggatcaaaaatttaaacctaagacctgaaaccagaaaaattctataagaaaacctaggaaaaactcttctggacattggcctaggcaaagaattcatgactgagaccccaaaagcaaatgcaacaaaaacaaaaataaataaatgggacttaattaaactgaaacgcttcttcgtagcaaaggaaataaacatcagagtaaacagacaacccacagaatgggagaaaatatttgcaaattatgcatccaatgaagaattaatatccagcgtctacaagaaactcaaacattatagaaaaaaatcccacaaaaagtgggcaaatgacattaatagacatatttcaaaagaagatattcaaatggccaagaaacatctgaaaaaatgctcaacatcactaatcatcagggaaatgaagattaaaaccacaatgagataccaccttactcctgcaagaatggccattattaagaagtcaaaaaaaaatagatgttaacatggacgtggtgaaaagggaatgtttatacactgctggtgggagtgcaaattagtacaacctctatggaaaacagtatggagatttcttaaataactaaaagtagatctaccattccatccagcaaccccactactaggtatcaacccaaaggaaaataagtcattatatcaagaagacacctacacacatgtttattgctgcataattcacaattgtaaagatagggaaccaacctcagtgcccattgaccaatgaatgtgtaaagaaaatgtagtatatatacaccatggtgtattactcagccataaaaaaagaatgaaataatgtcttttgcagcaacttaaatggagctggaggccattattctaagtgaggtgatggaatggaaaaccaaatactgtatgttctcacttataggtgggagctaagatattagtactcaaaggcatacagagtgatataacggattatggagactcagaaaggagagggacggaggagggggagtaaaaacctatgtattgggtacaatgtacactactcagacgaagagtgcactaaagtctcagattttgccattatataattcatccatgtaaccaaaaaccacttgtaccccaaaagctattgaaataaaaacaaattaaaaagaaaaatacatttaatattttcaaaactttagtgcctattaaacattcattcagcagtggagtgtaaggtgtgggccaggtatctgtcctaggtcctgggaactcagcagtgagcaagacagacacaaatccctacactagtggagcttgcattctaattgatacacctgtaattactaaacaaaatgaggacttgaaaaagagaaatagaaggaagtattatgagtctggggggaagaaagatacacacaagaaaagagagaattatagagaaatggcaagataactcctgaaagggtaggggctgggaacatgagaagggagctcactaaactattcacaagtctatttggtccaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaaggtaaggctaatgatggaatctgctatttgaatagctcaatgtaggagggcctcttggagcagtacagggtcagatagatatgtaaagtcaatagtagaaggagggagacgtacagaaaagagggacatgaagacagagcacggatctgttgatgtgacagtggttgttggaagaagtgttctcagggtgcagttcaccttggctttgccatgtggatttacatgactactccccagtgtctgctgttttcatttctgttattagagtcaccactactctcttgagtttgggagactcctttctggttctggccaacccagtcttggaagtggcaccaatcctcaaagtggacacatttgcaggattgttttttaatgtttcatttctagaagtgaagttgcttggtcaagtctgcatttttaagttaggacatatttgttgtcaaattgcctaaattgtctgtttatactcccattacatcatacagacaccctttccctccactttcaccaacactagaaataacaagatgtgtctatgatgacggccaaaggtgaagggtgatattccaccggtgtttccctttgaatttcttttcacttggcaggtgatcaaacatgctgtggtagcttgtattacggttctccagtgttccagtgccccacctcctcagaagtctacagccctgcctgtggactcaggaatgcccatgtgataacttagcgaaagaaatgtggacccaagttagagagccactttcaggccaaggctttaagagcccctttgtcttctttctctctgcccaagaccagggatgttctagacagaggctgctctgtctgcagaagccatgagtgtcagtgatgtagggctgagcctcatctaatttatgatgaacaaacagcatgagagagaagtaaacctttgccattgtaaaccagagcttggcaaattttttccaaaaaggaccagaagatgcaactactcgactctgcctttgtagcgtgacagcagccagaggcaaatacgtaaacaaatgggcgtggctgtattccaataaaactttatttacataaacaggcagtaggccaatttggcccttagaccatagtttgctgacacctgtaataaaccactgagatttgggaggatcgtgaattaccacagcattacctagcctatcgttaccaatttacctgttttttaaataaatttgacattggaattttttcttttgagggtcatctgtttgaatttgcccatttttctataagactggccattttttttttgttaaatccgttagggaaattaaccctttgttataattattagtttttctgatttggtttctgtctttgaacttaagaagcttttggttgtggagccatttgcttagttagatagacaaatcagtttacctttagcagtatggtttatgccagagtttctcaatcttggcattattgacattttggactgaataattctttgcttcggaggctgtcgtgtgtgtcatgggatgtttagcgacatctctggcctctacccattagatgccagtagcacctgcttcccagtcctgacaaacaaatagatttccaaacattgccagatatcccctgagagcaaaatcacccagtgttaaccactgctttatgcccattacttcctccttaaaaagcccttcctatgtgatatttataaggccatacagtagcccccctttataagcagttttttgatccatgatttcagttacctgaagtcaactgcagtttgaaaatattaaatggaaagttccagaaataaacaatttataagttaaaaatgatgcgctgttctgagtagcgtgacaaagtcttgcaccatcctgctgtatcccactcggggatgcgaatcatcccttggtccagtgtgtcctgctgtatacgcagcccacccatcagtcacttagtagctgtcttggttatcagattgaagaaacatagtatctacaggggtgggcactacccatggtttcaggcatccactggagggcttgaaacatatgccgtgtggataaggggggactcctgtacatccctttattctagtatttgtagtaaatgtattgacatatattaattagtggaaatttggcttctgtagtatttttagcttttctgcctattaacatgagcttgctgtatttccttagtcaatgctacaaggaagtcctttcataaggactcatatgtaacttgtctctccaaactggtagaaaaacaggaaaaaatgcttgaagattgttaacctatgaggcttataaatctatgtttgtagctataagtgattattaattctgtgtttagaaaagaaaaaggagaaagatatctgttcaagctcaaaaaggagatttcagaaaaatattcaccgaagaggtaagcaagcaagccacagcgcctccccactgggctccccagagccctggcctctgctggaagctccacccgccctctccttcttctctctcccttctcctccaaagttgttctccaccgtcatgggtaccagctgaattgggtgcatcaggagtgctgccagcctaacccacccccttgtgcatggtggccatttccatacttggaaggattctttaacacagagctatacaaagacccaaaaatgattaaggatgatcactaaacctttaagtcaaattctaaaatgaacttctatgtcttccattctaggaattaaaggaaacccttattcaagcacagcctaacagtgttctcattccttttcctgtgttggttgggaccctgggcttgcttcagcctctctgcaccctcggccctctttgcatctctgtcctctccctcccactcctcttcttgcatttatttttcttctgcttttataccttgcttcttcagcatcatttcttgtcaccctctcttccttttttaggcgccagccacactggccctttttattcattatcaaagtataataggtgctacccaaggtggggtccccagactggtgccatctacaagcatgttggttggcaggtctacgagaataaggagcttgtaaaccaactgtgacgctaagcacactgttttcatagcaagattcctcagtggagacagcagtgcattgattctgatcaagcccctgtcgcatcgtaggctggagcactgagtagcactggtgtatgtgcttgcagaaaatggcatgtatcctaagagtacagcttgatggattcacacacacagaaaatgcacccgcacacccagcacgcagctcaagacacaggatgtcaccaacacccataaaccacccctacccgtgtctctagggtcacaccagcctgattcctcacagcataggtcatcagataccgaatgctcccaccttgttcctgctcagggcctcctcacatgggcctcccagctcacccacccaaccccaaagtgaatccccctatcttcctccctttctttgctatacaccctcagacctcaccttttttaaaaatatttattttaagttccaggatacatgtgcaggatgtgcaggcttgttacataggtaaatgtgtgccatggtggtttgctgcacctatcaacccatcccctaggtattaagcccaacatgcattagctatttatcctggtgctctccctcctgctcccctgataggccccagtgtgtgctgttctcctccctgtgtccatgtgttctcattgtttaacccccacttataagtgagaacatgtggtgtttagttttccgttcctgcattagtttgctgaggataatggcttccagctctaatcatgcccctgcaaaggacatgaccttgttcctttttatggctgcatagtattccgtggtgtatatgtaccacatattctttatccagtctataattgatggatatttaggttgagcccatgtctttgctattgtgaatagtgctgcggtgaacatacacatgcaggtatatttataatagaatgatttatattcctttgggtgtatacccagtaatgggattgcttgctgagtcaaatggtatttctggttctaggtctttgaggaattgcttcgaggtctttcacaatggttaaactaatttacattcccaccaatagtataaaagtgttcctatttctccacagccttgccagcatctgttgtttcttaactttttaataatcgccattctgactggcatgagatggtatctcattgtggttttgatttgcagctctctaatgctcagtgatgtggagctttttttcatatctttattggccgcataaatgtcttcttttgagaagtgtctgttcatgtcctttgcccactttttaaaggtgttgtttgtttttttcttgtaaatttgtttaagttccttgtaaattctggatattagacctttgccctcagacctcaccttaaatgtcacttccacagggaagcattctctctcccagcaggtaggggtgggtctccctgacatgcccttgtggagacctgcattttgtcttcatggcacttatcttaactgtgatgaatgatctgtgcacagcctgttcactgcgtgaaagtcacgtgaggtcagtaagtggatgggtcttgtgtgttgctgtatgtccagctccccatgcctcacacagctggtacttcttcaagtatgaataccagtatctgggcctatctgatgcatgtgtgtgagttagaaaaaggtgccccttcctcaattcactacgtcatctgtcagagccaattcttgaaaccaaacccttttctgccttctgctggaagattgttgtactaagcaggtaaactgattctgtttctaatatgaattagagcaccccttaaaggtggagtccttgctcagggcacaacccatacaacttcatgcagtggtcctgataaccatataaatgtgtacattacttcacagttggcaaagcactttgatctacattttgccatttaattaccataataagtgagtgttatcagcccattttacagattcaattaaagggcaaaagacttgaatgagctaaaatcaacctatgtgttccaatttcaagccctttttcctttacactaaaaatgtaaatgaacctagaaagcacctactctcaaacactggtggaggcaggagccccggcaaacgttgacagttgtccctcagcatcagtttcttctcccttctgcactgtctgtaacttctcattaaatgcagagtatctgtgctgttgttgcttgtatgatgtgcagtctcgtggcatttctgatgatgtggaaagagcgctagatactgggtctggcatgtgtaaattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccgctgctgcagctcacctttcaaacaagccagctgccgttagagagccccaagcatcccccaccgggttcctggggctgcagggttccatccttcaaggcctggttggtaagatgagtaggtgaggctgagccagacttagcactattaggaacaggctgccctcaggcataggacagttggctttggaagtcctcgggtctaaaggccccacctcacttgatggcctgcctccactgggtaaggaagggactgatgtttgtcctcacaactctgcacatcagcttgctacccgtggcccccaaagccaccccctgctccctcatctgcttgtgaatgtgtttgggacatttgtgttccctaaagctatattcaccacagggaattagagaagacatttctgtggagacagagaactgtagaagggaaggtccccagagctgtgctaatctccctcaaggtttgcaatagtggtccagagtcacctggagctctgcctttccctcacattaggaacctgcggcagcaaatttcccactcaaatttgataacagtaatgcacgcttaggtaatccttctagtaagttgcagagccaggattacaagcccctcccacccccacccctccctgccccccagtctggctcccaaggccacgctctcatctgctgttccatatttactgagttgagtctagagacaaatggtggagctggccactccatgcaagagggctggctgttgaaacaaagtttttcccaccgtaagttcccacacccccactaccctccacccccatgcctagccttgctgccagcccctgctcctgtgaggccaggcatcctgtagggttctgtcggggggatcacatcctcacttctcagggtccctcctctctcagtctcactctatctgccttgtgtctttccagagaaatgaatggcttcttcgccgctgatactgttccttcacctttccgtcaatgctcttgttttgccatttgttttcctttagctctttcaataactgtttgaggcaagggagagagttggaccaggtgttctcctagattcattttaggtgtaacatcctctgtaactcaacataagacatggacagccccttcatttctccccagagaaacagcccctgctgtctctctttaatgaattcacccatagtgaggttggaggggaaggcagcaggaattgctgagatttattttaaaccctcttgcaactgcttcccctgaatctaaactctggatttctacccaggggttctgagttgccagactgctccatgagcaactgggaaattagttcaaagctctccagggttttcttttattcatcgaggaagaagcagggaagcaataaaatgaaaagaaacagcaaataattaagactgacaccatcccctcagtgccagccacctcactcacccaagtcttcatttgagtcaggaaataagattataaatgaagatttttttttcctctggcaacatgaatgcaaagaaacatttccatcagcacagagagatcagcaggatgcttatagaatagaagactattcagtgacagccaattcacttgcaaattaagacacattcactgaagatgccctatatgttccactaaaatgttttttttttttgatatagtgttggtggcagtggtggtttgttgcaggccactgtgtacacatagcttatctgtcactcgagatgaaagagttcctgcaaactaaccagagaacgttccccaataccctgtacattattggaattcatggaggggagaattcaaaaggaagatggagtgaagactgaataacacaaaactgttctcttctactttaaggaaaacccaaaagtgacactgtggattttcactgttctaagctccccgtgacctgtggtgaggcgaaagggattttatataagaagaaaatgaaacacggtgagttccttggtcttctgctctttggaatccctagatgaaggactcactagaagggaggaaaatacccgtgtgtgtaattgatcaggaaatggaccctgctagctagactgcagaagaaacgcttcttaggaaggaatttccaaactcttccacatcatggtatttctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaaaggtagaaggccacaattaggatgaagaggttcagggtgaattcacagaggatgggggtagatccaagaatgggctttttcttacaggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctgatggtggagaactttaaatgcaagtaaaggagtacaggaactttaaatgccggcaaagggctttgaggtgaagagagatgtaagaacctaaaaagaaactagctgaagacagatgcctgcaaccactcccctgcatcctctacctgacatctactcaaggcccagctcatctggcccccctgcagcatttccaggctgcccagtccgtggtctgtctctccgctgcatgtccacagcacactattcctgtcctgagaacaactagtgtctatgatgacaggacccaacacaaggcctctctcagcaacactcaagaaattatcactaggatgaaatcctaaagattttaatctagagagggagaaatggaaggagaaaggaatggatgggaaaggttaagaaagaagaactagggtcgtgggtttgagtgacaggggaaaaagtgattttatcactaagtgaggtccagaagaaaaactgactgggggagggagctaatttttctttttgacttcttgggtttgagatccagtgtgatgtctgggtacagacattcactaggaagtgggaaggccagtatctacaaaagaaaaacctccagaataacctcattcattgactccttctgtctttcagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagctcatcatgtccatgtgttttagaaaaagatctggatatttggatggctataaaccaaaggtgtcagaaataaaatgctctaagcctaggcaacatagcaagaccccatctctaacaaatttttttttaatcaactaggaatggtggtgtgcacctgtagtcccagctaaggctgaggtaggaggattgcttgagcccaggagttcaagaccagcctgagtgatatagtgagactctgtattgctatacagagcgatgtaatcccagcactttgggagaccaaggtgggtggatcccttgagcccaggagtttgagaccagcctgggcaacaggacaaaaccccttctttacaaaacatacaaaaattagccaggcatggtggcatgcacctgtagtcccagctactcaggaggctgaggtgggaggatcacttgagctctggaggcagaggttgcagtgaggcgagatcatgccactgcactccagctggggcaacagagcaagaccctgtctcagaaaaaaaaaaaaaagaatgctgcagcatgaaaagcaaaagaaaaggcattgaaatagacaggaacagtatatgaaaggacaagaggatcatccatgattgcatactgagtattgctgaatcctccatgcttcttattggtagcaccaggatggaatgacgcctttgaactgagctttgtctctacagggcatccctacagctggaaatggcagtcatctattggctgcactaactccccctcctcaacctcctctacttgcttagatgtgttctccagacacatcagctccactcatgagcttcccgttagttgtgaacttccagcagagacaatggtgcctcccccatcttgccctggaggctggcctgaccaggctggattcattcaaagtttaaggcactggtctcccaatgccatctattatataaatcatctttcccatgctggtctgaaataccctgagaatcaggggtgctcagtgtaacatcataatagcaaaaaattagggacgaacacaagttctatcagtattgcagaataaactgatacagctacagaatggtttttttttaaacttttcttatagaatattagacctttgatataggtatttgtttaaatacatggattcataagtatggagttatccttcaatcaatggaaagccaccaaatggttttgtggtcaggagagcttcaggacacttaatgctagttgtgacgtgtggggaaggaacccattgttgcttatgtgaacgtgtaggtaggtctatgagtgaaaaaatagccaaaagaatcaactgcacttattttgagatgagatcacagggacatatgccttctgtattatacctttatgtacaattggaattactataatgaccatttgttacttttgcaaccagaaaaaaaaaaatctttaaaatccagatcattaattaatagccccaacatggtaataccctctaactctcctaatgccacatgtcagctcataatagccaggggcatgcttgacccagcctctcagtcccaccttccagggccaggttgggagaataagatgaaggtttacctgactgagaatgagccagtgtgggccttgccctcagccccatcatccagtgtcactgctgctcggcagcacgtccgtctgtctccactgcagtctcacttatgtatgtgtacaacaaagagaccgatgctggtactcccaaaatgtgttttgtggttgccctgcagcgtgctgcctccatgacccacacatgatgggcagctggtgtaaagagccacagacttggcctgtgagagcctccgtctccagaagggcttggatgcagccagcagttgccactctatcagcatatagtgtgaggctgaggagaacagcttttggggttttggtttttttttgtatcagaagcccatggccatcatgggtggtccagagatgccaggaggcatgagaggaggttgccaaagcttccacagtgaatgagactcaggagggcactaatgtctgctgtattgcaatttgacagattctagaaccttttgttagaaggggccccattcaaagtgggcttattttgcaagtaacagcgtaaatgggcttacctaaaatctacaaatgaaggatgtgtttccttgaactcaagaggcctgaaggatgctgggaggtttattagaacactgtgagtactcagagggtcaataattattttttgacagtgtcagggatggagcatccctcaactgaccagacaatggccagaaattggtgtggatccctgtactatgcctggggcagtggcccatacttttttgttttagtttaatcccaccatgtggaaacacaaaccccatccttttctatgagttctttgtgagtaatgtcctgagtgtgtcaaatgaatttgctgaaagaagggtgtcttcagggtgatgttacacctgtactcctagagaatgtcagatgcagttcaaatcctgcctgcaaagattgtgtatggtggcagaactgtcgaggtaccccgtggtagccagataacggtctattgtgtcccttcgggggtgaaagcaacctgcagctgagatctgttgaaataggcgctgaacagaacacattagtcaaatctatgcctgcagagtatttaccacttgctaagtggatggagtcagtaatttcaataacattgggccatcacaggtggggtcacaggattcaggttgtagtaattcaccgagaggcaccattcattctttccaagcctaagaacagaccaaattgggctgttaaatggagaaacagtggggataatcaccctttctctaaatagatcttccataatgagtttcaatccttgaaagccgtgttttaattcatattgatcagtattaaatattttaacagagaaggtccatagagttccattttgtaaagccaattgtaagtgccaaaggtaacttaattttaattattttaatgtgttatttactgggtcacagcatccacgcccactgtggaacattttagggccatgttatgttacgaccatggggcagttaggcaaggcaccaggaacaacagttcccatactcctgcacccaaatgccagttatcatcatttcttactttggtcagttagatctattaatagaggcctggtgggctcagcaaatgcgcccagagtggcccagctcaaagcacaagcttgccagcaggcagcagcacagctcaaaacgcagcagaacctgttggcaagccacagccagagaagaaaagtcctggtggcggcggtcaccacccagactctctgcttgttgtgccatttgtcttgcaatttcccccagggaggtggcatcagctccccccatcaaaaattgggtttggatatccactctggcacacacaaaaatgatgtgttctagaaccccacagggtcagcattcgtgggtctccatggtcctagcggtgcccacgttatctgcccttgcagcggaaaaactcggatgaatgcgaggtgtgctgtcaagggggacaacttctctgctgcggtacttgtccacgagtcttccatgaggactgtcacatcccccctgtggaagccaagaggtgagtgggatgcagccccgcctcgggcacacagcactcacctccagatggaaagggcaggacctgtgagcgtcggggccgagggtgtgacgcagagcagtctggtgccagagactctgggcctctctgggtctctgagactgccagtgagcctcttggccccacactgcttctgcccctggaagtgccctttcctagtatgctattccctggacagcagggactcctgtccaaaaggagtaggggacgggaaaagccagcttatgttctgtgcctgttgaggaaagacaggaagcacggcttgtcacacatttcaccatagtctcacctggctgatggaggcctgaggtccctgcaggtgaaagcccagattctgacactcaagcctggcaggcagggttcctttgtgctcccagcagctcagacagggaaaagagagcccacacttaacagtgacaccaccttcctcaggctgcccgcctgccgctaccactgatgcgagggaagggccaatgctggagaccccatgtggggatcttggacactctgggaggtgtcccaccctcatggctgagcccatccttcctgagggaagacagtggcagccacaggaatggtggccatttccaggggctttgccctctgctcaccttgtgtccaacctctcaggatgctgtggagttgcaccttctgtaggatgaagaggtcttcaggaagccaacagtgccatcatgtatctaagaccctggagaggcagatgcagcctcaggaccagctggtgagttggatgcaaaccccaaacctatacttttcccttctcacacgagaagcacaaacaggcacagggtcagggcaatgtaccaaagggagccttcaatgtctccctttaaaggatgacgatttaatgcccaaactcagagtctaaacaaaatcccacacaccctgtgcgccttgggaagcatggctggaatgctgactgggcttggctgccccatccgtgtgcatgtctagacactcgcctggcttcactgtttctaagctgcatttcactttcaagccctcttcacattttacagaaatgtgagttcctcctcttgaaggcctactgtcatccacaaagctccttttttacgggcatcccatttaatgtaagtcacattttacggttctcttgcataaaatgcatttggagaaatttgggggctgatctggcaggtgctgcagtttgctcaggaagctggagaacaggagagaagggcagcgtggcagcagtggagcggggcagcagggattttgctgcacactctggagagggactacctggttcaaactccaccccactgctcacgggctctgggataccgggcaagttgcttctcctcctgtgtatctgtttcatcttctctttaggaagaatgtctttcctactagagattaagagtcacagatgccagctgggctcagcggctcacgcctgtaatcccagcactttgggaggccaaggcgggcagatcacttgaagtcaggagtttgagaccagcttggccaacatggcaaaaccccatctctactaaaaatacaaaattagccaggcatggtggcaggcacctctaatcccagctactcaggaggctgaggcaggagaatcgcttgaacccaggaggcagaggttgcggtgagccaagatcgcaccactgcactccagcctgggtgacaaagcaagactccatctcaaaagaaaaaaaagagtcatagatgccaaactgtgtgggttcccatctcagctctaccactttcttgctgagacatcttgggtaggttccttgacctctccatccctcggtttcctcatctatgaaatgggcattattatttatggtacccataaatgtggagattacatattcatatacttggcttagaatttagtttatctagtgcctagaacaatagctggcttaaagaggtcaaatggtattatcattatgaccctggaaatgaaggcttggattgtatttaagttggatccattccagtgatgacagctgtgctaacgtcacctctggtggctttgtccccaagattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggtaaagagcatttcctgcttcctttttgcgtcttttctactttcccctaatttctgggacagcagaattttgcaagtattacactcagtttcagcctggggagagctcaaacaagacaaggattacagaaaaaaaaccacctcggcattcctggaggcaaggagtgagtggcaaaaagaacagcaagcaggacaggggagggatctctggaacagaagctgaaaaaaaccatgctctgttcccagatcggcagctcgctcccaacgagagcagtaaatggcatccagcctctttgttcaaactggaaggaaaggcagtttatgcctacattgttcttcctgcctcagaaatatgaaaataaataagtaaacaacataaaatcaattaaacttcctggataatcaggcttgcatatttttacacataaatttctcattggactcaaacatctggaattgccttcagatccaatgttggtttcatcctcctttactagggagggacagctggttgagctatcctgcaatcccagacatttgtaactttggtttttcctgatttttatcctcacttgtacagatatttcttgggaggtacctaaggaagattttcatctccacccagcttccttcccttcttccatgccaggagttggcatgttcacaaaccacagattgtaaactggtatccactcatggagctgcagggagaaagggttgaccagagagccactcagtgcctggcatatccgtagtcctggagaacagagggtcatccttcctcagcgagtgggcttccaagaaatgcatttacaaaaattgttaagctattttgcatcatgctcagatttgccatgatcaaaactaacccttcagtctaaatcgcctgtcaggtggaaattaacaaccagctggagtctcatgcttttcaacattttagtagcagcatctccccatccattctgccttactgctgggctcctaaaaaaataagagtgaggctgggcatggtgactcacatctgtaatcccagctttttgggagtccgaggtgagggaatcatctgaggccaggagtttgagaccagcctgagcaacatagcaaggcctcctcaccccgatctctgaaagagaaaaaaatgttttaaaactttgggcatagtggcatgtgcctgtagtttcagcttctcaggagctgaggtgggaggatcacatgagcccaggaattcaaggctgcagtgagccatgacggtgccactgcaccacagcctgggtgacggggaaagaccctgactcaaaaacaaaaacacaaaaaaaagtatgagtgatttgatggctgtaatccttcatccttcaatgtgtttgtttgcttttttctctttcaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaaaaaaaaataattaatacttccttaataccatcagataccccatcatagttcacattctccccactgtctcataagtctttttagagttgatttgttcaaatcaggatctaaacaagttccacacactgcatttggctctcctgtccctatgtctcttttaagctataaattgtcatgtatttattgaagaactcagggttttggtcctattacattttttgcaatctggaattttctggttgcattttcttagtggtatagtcctctcttcctctcattttttgtaagctagaagttagatctagaagcttgctttaactcaggttttgaggggtttgttttgatttgggggtttgggggcacatgcaggcttcacaggggaatttagtattattttttatgttaaggttggcagcaggtgcacgtgttatcagcctgatcatctatcacctgatggttttagcaatacctaaatccgtgatatcatcagaggttgcaaaatgatgagattcaggttttttttttacataattattggtcagaattattctgcaaatagcttctctttaacagtattcggttaccttgaaatacaggttgtacaaaaaataggataaatgcttgtttttttatttagcaatgtccaaaataatgaattgatttcccagtatcctctaaaggtaaccagggattttttttatttaattatcttgaacccacatatttaaatatacgtagtatgctacaaaccattgcagttaatacctttattgatgcttgagttgcccactttttctttttttttttttttttttttttttgagacagagtctcactctgtcacccaggctggagtacagtagcgtcatcttgactcactgcaacctcctcctcctgggtgcaagcgattctcctgcctcagcctccgagtagctgggattacaggcatgtgcaagttccccacttttagtgagaaactcctcaatttgcctcctgagttgttttgaaatgaccccagaactctttgatggtgtattagctatctattgctgtgtaacaaatgacctcaaagcttagctgcttaaaaagaaaaaaacattttattgctcactattctgtggatcaagaattcaggcatcatccatgaggatgcttccctttgctccacatggtactggcagaccccattcatacttgcacactgtcacttctgccacaatctattggtgaaagcaagtcacagggacagattcagaaggagggagaatagaccctacctcttgatgcgatgggtggcaaagtcacatttcaaaggagaatgttgcttgggaagaaacattgctgctcccatctttagaagcaatctaccatagttcaccctctggccacagtagttcacatctttcccaaatgcaaaggacactcctctccccacagaagtctcactctctgcagcattggaacaaagtccaggacctccttatctaaatcaggttcagatcagataaagcttcttcgggctgggcacagtggctcacacctgaaatcccagcactttaggaggccgaggcaggtggatcgcttgagtccaggagttcaagaccagcctgggtaacatggcaaaacctcatctctacaaaaaaaaaaaaaaatctttttaattagctgggcaaggtggcacacacctgtagtcccagctactcaggaggctgaggtggaaggatgagcctgggaggcagaggtcgcagtgagccaagaatgcaccactgcactccagcctggacaacagagaccctgcctcaaaaaaaaaaaaaaaaaaaggaaagaaaagaaaagaaataggctcctcaggtatggttcattgggtgcagctccttgggtgcacctcctcttgaactagaggcctgtgagctgaaaaattgtttcttccctgctgccaacagtcagtgatgaaacagggactgaacaactactatagacacttccattcaaacggggaaa

SEQ ID NO: 751 - DNA, 47915 bp, Human; identical to SEQ ID NO: 750

SEQ ID NO: 752 - DNA, 51810 bp, Human
tactagctagttaacatgcttatcgtattattcattgcacatttggcttattcttttatcactctctgttcatgtattttgcttttttattttctagttggatgtttgtcttttgcttattcgtttgcaaaatctctttacataataaaaatctgaacagtcatatatgagatgtagtatcttgcatagaaagaaacagggctttagagtcagacaagctctgctttgccactgaataccttgggtgagttactaaacctctctgtgcctccctttcatctttgggactcatgacagatgaagaatgaggaagctctagacttcctgttctgagcgctgctgtataatgaattgttctaaaaggagcctccaagaccccttcctcttcttagtatatgtttactctgcctttctctgactttgcactgatctttgcactatctccttcccctgtgcatattgtggatagtagatttctctcctatctgttctctatcttccaagacttctttaccaccacagactctcaatggcatcttttcttgttttcctatgcgattgcggattattcttttcatgagtatttttttctgccaagttaaaaaaattggggaatgaggagaaagagactagggtgcttaatctgccactgggattaaatccctgtaaacagttgttaattacgatttacttttctgttcaacacaaaatgaagttggaaaagtggaatccatgtttgttctgtttgttaaaaactgtcaagttgattgaatgttttgttagtgcttttccttttcttgacaatttgtcaagaatgtcatttgtaaactttcttcccattataacctattgatatctcctcacagtccataaatggccaatctttaatacatgctgcatgggcatgggaaaaggcgcatgtctgagacatgaaatggttgcagtgaacaagtcagttaagtcacttttactaagtatgcctttctcagccctcatgcttttatttatgcttggcccatttgtgttgaagattgggagtggttcgttaaagtttccaaatattaccaggtttccagctgaactctacccattttagggtggtccctgttgcatgagcattgctagttaatggcttcagccgtagcccaggtcatcttgtttaacccagatcagtgtggccatagaacacatagttagcactgtaagcctggaatcaggatttgctcccagctcttccactctctagttgtgcaaccctggggcaagttattaaacatttctgtgtctcagttcctcaacagtataaacaggtgcagtcataggaaccacctcgcaagggttttatgaaaatcagataagttactgcatatgaaacccttagaacaaagtctggcacacaggaaacactccataaatattagctacttttaataccttccttatgtttacctgcagcgccttgggattctgtcattatattttcagtcactctcagcctccattgttgctgggaattgtccttgtttcctatacccatgagccttttaggcagacattgctttgcaggctactaaggatgcctttgggaccagaatgcttacctttagatctgcccatttaatgcagagagaagcttcccacattcctcaaggttttgcttctattttttttttttttttttttgagatggagtctcactctgtcacccaggctggagtgcagtggcacaatcttggcttactgcaacctccacctccccggttcaagcaattttcccgcctcagcctcccaagtagctgggactacaggcgtgcgccaccacacccagctaatttttgtatttttagtagagacagagtttcaccatgttggccaggatggtctcaatctcttgacctcaggtgatccacccacctcggcctcccaaagtgccgggattacaggcatgagccaccgcgcccagcctttgcttctattttttatcatgcctctttccataggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggtgagtcatgttgaacccttccatggcagcccagcccccaccaatatgcctgattattaaagtctcaaaccacaaaccaccagggcttccagagtttggaaggcccagcccaggcatgttcattatcacagaaggtgggggtagttaggagagagggtgtcataggggctatgttggtttctagggtgtcataaggactgctgtaacaatgactacaaaccaggtagcttaaaacaacagaaatatattctctcaggtgtggaggccagaagtccaaaatcaaggtgttgacagggttggttccttctagaggccctgaggagaatccgatagctgcctatctcctagcttctggtagctgttggaaatccttagtgttccttgccttgtagatgcatcactctgatatgttttcatctctacatcacctctcttttgagtcttctacctaatcttctgaggacacttggatttagggtcaccctaatcaaagatgattttatctcaagatccttaacttaattacaactgcaaagacactttttccaaataagttcacattcacagattctagatggatatatcttggctgagatatatccatccaacattcaactcactacaggcatcatcccaatttataacagctaatattgctcacagtgcattctgatgtgagacaggcaggcactgggagatatgctatgtggacaaaagtggacctatttttatataattttggtttttaaaagcattaattgagccctagactcaaggaagtgccaataatcttcccttagtcttagtctggttggccccaactccctcttcagatcacagcccagagagcactcctcagagacatctccttggccaactcatctcatgaagaccccttagttattcagttccatagcaatctatgctttccctccgtaacactactctcaattgtaaatgggtatttatttgtgtttattaatgctcatcttctccacttgacagtgcctaccctgacccccaaatataggcaactccatgttggtcttattcagtgctgtgtacccaaagactcgctgaccgagcctagtagatgttcaataattatttgcaatcagttctctcttgccgtatttctccttttgtccatcctctaggcaaggaaaattctcagggtgacttctctgtggctggaatccattcaggcttatctcaagtttgagagacacagagagagactgagcagaggctcacaagcaaccagcagaattgcctctgtgaccatcactagaaccattgctgaagtatcctgcccacagctttaaagaatcaattacatagtagcatcctttaaccccactttccttccttcaaatttctctcgtctcaaatgtgcctgaaagttggattcagaatatagacttactttaagaaagctaaattatttatttttgttgctagtcatccaaatatgtgtaaagtttcaaaaataagcatgtaaaactgtgaccgctctaccttagagaatgtgactatatattttatgttgaatttcttcttaaaagagtaaggtagctttcttaaaacttagaaaaccataaatgtataacttcccattcaattttatagtcatttataaaaaccttcactccatttttataggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtggtaatgagatttctcaagtgctttttgcatttaaaaagttgctatggtaaaagtctgggtttacttctagccctgtggaatatgcacgttaatcccccgccttctctctggggtggaatggaccatattctctcattggtacagctgcaggagcagccccttgctaaagctgatcccaactctctaagatgaacttctagaggacataaacatttcttatgtgttctatgaatttggaaaaaaatcatacaatttggcatactggaaaatctatagggaatgcataaggtgacagaaatgcaaagttacaaagatcaggtctggtggaaggacaaggagagccagggaggaagaaaaaatgaatgtggacggataataataagtatctttttttggtgccttatcgcaaacactttatttgattatctcacatcatctttaaaacaaccctttgaagtcatttttaaccccatttgactgacagagaaattaaagcccagaggtaatcttcccaaaattacttgttggttaagaagcagagcaagagtcctacttgggtctcccaataccagggcccaagattttaaccactagtccggacaaggacagctggaaggcagattgtaaagccagagaagggaaaaaaggtagctacagagaaagggagtgaatcgcaaacatagccacagaaagagagggtctgagaaagaatggatcatgaagtacgtagagaaagaaaagagactggataaataaaggagtaggaaaaagaacagtggcagagttgggaagaaatcagccagggaaagagagaggcagtaaagtcattttaggttggaagtaaaacactgtggccaaatcacatgttcacttacctcagaacaacaagcaaaggaccaccagctcacattggatattttcattagtggaatcaccattgttgacagttcctcctttgctctctgacacttcaccatcaaaaggcttccccctgaagggagagatgatttcttgagctacatggacagtgaaaggggcaagtccacctccaggtaggggcagctacagagggcccactgtcctggcagcatctgggcaatactaggagaggcatggccttaaaggctatggtaagaacatctgagaaccatggggacccacacactgatgtgcccctgacctggctgagcttcagtcatcttccgggatcttcaacctgatgattttgttctgaatccctttccaaaatttgaagttactttcctttttccattcactggttgagaccatttacttctgaaataaatgatggagaagaatcttaagagaaacccagcactagccatgcaagggaatagcatgcagaaagccaagggtctggggtattgtggatgggagagaaagctgggtgtgaccagatcacagggtacaatagaaggcacagaagctgactctgcagaaatgagcagaaaccagaatataaatgtcctaatacaccctgctaaggaatttttattttctcttatttgcttcggggaagtatgatctgtttatttattaaaacagagacctcttttaaaactatagcatgttcattattgactaaattatatgacaccaagattaaagaaaagttaaacccctgggtacaaacccaaactcaacttttatgtgtgaaaccattttggtattagatcagggcttagatgcacttattgtagcactcaatgcccaaaccagataaataaaatattaaggggccacaaatggataatgatgacaatgaatcagttctctgcacctgggggacaatgaatagctccatgcccccatcctattggaaggcatgtattaagaaatccccttccccaagtaattctgagtctccagggtactgatgtgtgtcccttcaccaatcccagttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcaggtgagaaacagatcccatccaacacctgtatatcctcagcctaaggtgcctgtgccatgttgccgccaatcccagcatcttgacttttattgtcctagttcttctcttgcacccacctacccaaacacaacccttttcaagagggattatgagcactgccggggggtgggtaagacctagagtccagaacacctgcttcccactcccgggacattccaaccctctgcccttgtgccttgatgctctatctgccccaggcacttttaacattcactcttctccctgacatccagtccctgcaatctgtaataatttcctttcctccttcagtgaccaatgacaagttaacatccaaaatgaatgcggaagaagactcagaagagatgcccagcctcctcactagcactgtgcaaggtaacactgactggggctgataccgcttagctcaaggtgactgtgaagggagaacatgcgtctgccaaccaagaggctatggtgggaaccctgggaaaaagaactgagcaatacaaaggaaaagaaacagaaggggccaattcaccaacgcagcaatgcaaaacaaaccaacaaccaaaacaccattctgaattgacaagtaacctgcgtaacactcacactagtgacccttagctgattcctcacccccacctgattatgggggccttagagtttcaacattcttcatttttatatggtttggattctaagaacaatgttatcaaaattactagaaaagatgataaaatgtttaaaggtctgctagacctaatatttagcttctcaaattgtatcacttgtcctccccaaaccatcatcataatggagtttgattacattaaacgtaagaatggtatgatattgggcattgtcaaaaatgataccatggattctgagctctccagtactgagaagaggggtcctcttcgatccaaataatattgcatccactcctctaatacctaccatccaaaaaggttaacataatcaggaagctaacagcaatggaagaacaagtggctaattgagagtgaatggttgcttactttcccactctatgccatcctttcccaggccttggttgctgttaccccgtcatttttacttgttggaatagagcattctcttttctcctcattctggtccctgcttgctgttcctgagatctaaaactttttcttcctccattcagtggccagtgacaacctgatcccccaaataagagataaagaagaccctcaagagatgccccactctcccttgggctctatgccaggtaatcttggtttggtcaacctaaaagcttgcctttgtttctgtgtttactaagaggaaaagccattcggatcttctagagagggggctctcctcctgcctctcagcaatcttggcccagcttccagttcacccagcacttgggagcttgaacaggcaggagacccgacctctgaatggatacagagtccctgggggagggcaaaggaggcaagtctggaaaaggtagacttggatagggccacggatgatgatggacagagccccaccagtgcctgtaggtttggactccaaatgccacaaagcgcctgaaagggaaacattcacctgccacaaagggttgtggcaggaaccccaggggaaagcaagggaactgagtcaggctggactgtttgacagagccactcttctgaggccacttcaataaagtagtgctcaaaacggctctgtcaaaatgcaaagcaaatgaacaaaaacactgtgtggccctaatagtgaattgctgcagcagacatggatggtcctccttccaagcccccacctgactgtggggaattttcactttcaaccctggtcatttctatatcacttggagtttaagagttgatattatgaatataacttgaaaggtaataaattattccaaagatctaatgactgcttgccacctgcctcagtcacctattcctaagcaggccagcatttgagaccaatctcaatgcagtgtgtaaagaaaaaggtgacagcttcatgtgagatgagcctttatttgttatggcttcaagttctctgtctttctttgtgcagcaaaaactagcagagctttatatgtctttgctgttaacaggtgctagcaagcacaggctagctcctgctttcttcaaacaatccttatatacagaaatatataaggcatttagccttctccactatttctccaagtaaaataaccacagatagagcagttaaagaatatccacacatagacgtcaaagcaataagatgtatttttcatacagcaaagacattccccttcatcatggacatcagatttcaatatcaccactttccgctctcagcttcattccttgagcaggggctgctgggagcagaaaccatgtgactatagtcatgatacccagcacagtttattcctgcaatttccattcattgcaccttcttcactcacttctcttccatccataagataatctctctaaaaggatcagactgagcctctgctgtggggcagttgtgccctagttccctgtgatggtcgcacaggtaacaataaccacaagttggcaaaaatcaagacagagccagggaattcttagggcaagcagattcccggccctgggctgcatgtactttctacttttctagttcttgcattgacttccctcagcactttctcttcactggatctgagctctgaaatgacttatatttcttttgtcagagataagagataattctccagaaccaaatgacccagaagagccccaggaggtgtccagcacaccttcagacaagaaaggtaagaaaagcctttcttctgtagaggtcagaagggtgaattcagagttgctttctgtttttctgactgtatcttgtcaagagcaccactatgtgaccacagtcctgatgccacacacagttcgtttctgcagtttccatttgctgcatcttccaaaaaggcctttatgaaaattatcaggaaaccagaaggcatttgggggtattgaaatatgccattggaattgcctgttctgaaaaaatcaatctcctatattcacaacttcttagagtgttaattgcacttccctctttaactgaaagttggttccccagagaggaacccacttcctcttaagacatggctaggcattctctgccatccatcactcacacctcatggtgagagacaggttagatgtctgtcctttgctgcctactggccccatccagccccttcctccctgatcctctcctttgagtcttaaccattcaattaaaatgttcactcactcatcatcaatatcatccaataatttccccaataatcctttcaaaagctgcttttctgtcatttcaagtcccagcatcatcctagatgccttcagggtacacacggataacagacaactctgttatccaatactctggcccctcaaatccttcatcttctcattttccatgactttttcctccaccaattcttggcctcccatacccaaaggcaagctatagaccctatcgtcattcaaacctggctcgatttcccaacagttaatttcagaattccttttttgatacctgtccttgagcttttctccttttatagctatcattcaacctctgatcactctttcccagcccaatcctaacaaaagaaaaagaatcaaaaatatatttttctgtgcttatttatttgttgtttcctctgaagttgtccttcaacctcatttggatcaccagtccactggcctttcctccttccaagccatcatctgcttttctttgcttcccagctttttaacattgacactaactcacagtccaagattcatcatttcagtaatctattgccattatcttaaacctgcctttcctctctgccttttcctagaactctctggcaagtcttggaagaccctacttacctacttcctgtacactgcatctgaaagccagcagtgctggagagagttccacagcagggcagagtgcactcactggtcttcatggttccagcacaaatcatctctccttactgtgtgacaatgctacttcctgcaataatcctttcaaacctcaagccctatttttcaaacctctgaccccctcacctcctgctttttgctcaatcagtgactttccctcctgcaccataaggagatatcagatgagaatccccttatttgtgctgctagtcctacaaaccctaactacatctgtctccctcctctccgagttccctccttctcttctaagacaatccttctgcctcatcttatagtatccatgatcccttctctctcaagtattcattaaagcagtatgtctcacacaagaatctgcattacatgtatcacagctcattaaaaaatgctttttcttgattctcatctcacttcaactacttccatatctctctccttcatttcacaaccaaacttctagaaatgagctacctaaactccctgtctctatttcttcgtttctccttttcctctgtcattttagagtccttcttcccctattactccctgaagtaccatcacctaaggtcaccaatgaacttctagcaatgtggtttgaagaccaaaagtaaaagctgaatatcattgacatacaagattgggagatcaatgtttgtaactataaaacattatcctttctttttaggaaagaaaagaaaaagatgtatctggtcaactccaaaaaggagacataagaaaaaaagcctcccaggaggtaagatgagagtacaagaggaagctggaggctggaaacagctcatgcagggcttgtaggtcaagctgtggagggttgaattttattctaaatgcaatgggaagccattgaagagatttagtcagtgaagtgacacaatgtaagctcaattttgctacggtgtaaagaatgagttggagctgggaaagaatggaggcagggcagccattttggggcagatgccatgagagttcttggtggcttggattcagatctgacagtggagatgcagagaagagtgccaattcaagatcagttttgcaggtattgttgacaggatttgacatattattagctacagatgagaaagagaaaaatcaaggcccactcttcaatttctggcttgaacaagtaagtggtaatgcccattgctgagggaagatgcaaatatattgggggataactcttagagttcaattattgacctgttcctttagaggtttctgctagccatctatgcagctgtgtatagatgtgtgttttgtcaagaactgtaaagggtctaagatgttactccacttgcattggtatctccttatatatatgagtgctgcaggaacacaaggtatctggtcagggaaaataattctttactgatattcacaaccagcttatcagccagagcaatattgcagcgtctgtctcccatacacaaacccaaaggcaatgctaagagagctaatggaatctttctattcaaaatagactacaactcatgtataagggatgtagaatgatggatttttctgtttagatacatgagagggatagccatcatcctttcctcctgaaaggaaaagaaaaaactttgctgctttgagataaaatggaaaagatcctcgttccaaagctctccatcctaacctttggaatttaaatgcatctttccaaaggccagagaaactctaggtgttgctggcttttacaacctaaagatgtctccaagttctgggctttaccccttgtgatatataaatacctagggaaagaccactccagttttcctggtactttaggatttaacctaggaagctagtcctgggtgaacccatttggccatctcaggagataagagaggttctattctccctctagatcagagtaattaactagaaaaatagctatagctctaattctcatggtgtgggaagaggaaaatgtttctggggaagtgaaagcaagtatttcctatatttatattgcatacatttctgtgtctccgggactagggctttttacaggaacactgagaaatcaggaagttatattccccacaatatggcaatttggcactcactgaaaaagtgtggtccatatatatatatatatatatatatatatatatatatatatataaaatctggaccagataatatataatatctggaccagatatatgtatatatatgagttatcaataaaataaaggtattctgatctatgggagaagaaaagagaaccacagacctagccctgctctaagtaatcccagtggaagaggaatctagcaagacagactgagggaacgagaccagtgaagacagaggagcaccaagaaagaacatgttagcaagccaagagggaatggttgactatactgagagactaagataaattcagagaagagggccttgagtttggtcacaaagaatcactggaaaatttaagaaaaattttggtgatggaggcaggagccagttgtgtgggaaggataatgaatgggaggtgataacatatgtagacaactctagctgtaaaaggaaacagagcaatagatggcagcctaagccagtggcttaaagctcctcttccctgacttagtttatcattagtatgatcccagtgtccaaaatcacagggctggtgtccttttaagacacttaacagaaatgattccattctaagaaaagtaagtgaccttcctgggcaggaaggagagacaagctgctttctcccccattctacttattagtcaatgccctctcaccatgttatgtgtattctctatgggcctccttggttcattgtaaactagtcagattattcaactcacacttctgagctttgtcaatcactctcacaacttcaattaccacctttatactgatggctcccaactctacgtcttcaactcaggtttgtcttcaagaaacacatagccagctgcacactgggcgtctttgtttgcaagtctcccattgacactacagtctcaatatgcctgaaattaacttcaccttctttaccaaaaacctagtcttctaagtaccattcagacatttattccaacaaatatgcagtgagcactaactgtatatacccattctgaaagctgaagacagattttttttttaaagagagaaagtaagaaagtaagcaaaaaacaaaggggaaagctcatggaggttacatcctggctgggggaaggaaagaatataaactagaaagcacataaacaagataatttcaagtactgatgacaggatgaaagaaaataatggataggattacaatagtgacttgcaggttggggtgggagtcactttggattggatggtccaggcagagggactcaaaagtgcaaagaacctgaggcagagaggaaagaccagtgttgttggtgatgatgaagaaagaaggtggtaggaagtgaaaaagtaaacaagaatcagattatgtagggtttcacaggcccttgggagcctgttgtagtttaacttgaaatgaggaacttaatctacccaggtgccaagcaaaaaccttagtcatccgtgactaactgaactctattagcatattgacaaggtctattggttcaccctcttcttttctacattaaaatctaatttagtttatttgccatgcttaaatcttgtccatggcctcctattgccccttagggtaatgtcactgtcccttaatgtgattgttaaagttctatccagtctaactcatgccttaccctccaactattaatatatctctttccactcaaaactccagtcaaccactctgaacttcattgtcttcccatttcatttctctcccctttgatccttggcatgtgctattctctttggatgctatattctgaacctacactactccccataaatgtttagttatctccttttcatcagtcgtgttgacttatgtctatctcaggaatacatactctgacccctaaattagccaagctggtcccataatttctacagcacccagcactggctcttttggaaggttccaaatactctattgtaattacttacataatgtgtctcttctaggctagatggtaatgtcctggcacaaattagctattaatttttttttaatgaaaaaaaaatgaaagaaaccatactttctgtaacccaaaatttgaataatgatctgacaaaggatagtttatgaattcattattgtgttatgaaaaggggtcatagacattatgggcaccacgtggtgtagatacaaactaaaggttattggagggaaatttccaatacaattctccaaattcttattatcccatatttagggcagacatacgtactctgcacaccccgtggccagcagcccagtagtgagatgcccactctcacaatgctctacacgttataggattagggagacagggaatgtctatgcaactatacaattatgaacactccctggtcagagaagtgactttgttagagaggggaaacctctggagtcagtgtcagatggtcagttctgttgaggtaactctgaccttttgacatctctctgccaagctaccgaaaggagtagactccagtcccttccagatttgcctttcttcatattgtatttaaatgaaatttttcaggttttttaaaagaatcgttttattttaaatgtgacagatgatgtgcttttaattttcttttttccaattttccaattttttacctgggtaaaatacacatgacataaaatttatcatctcaaccatttttaggtgcatagctcaatggtattaaaatacattcacaatgttgtgcaaccatcaccaccatccatctccaggactcttttatcttgtaaaactaaaaccctgtacccattaaacaactccccattcctccctgcccgcagcccaacagagatatttttaagagtcatattattttacatttaattaatcagctttattttttacaaaacaaaacacataaaaagatgtttcaaaattgtaagagaaaaatatatatagtagtgctgaaaatatacataccacactctcatattttctgtaagtgttctcatctccgaaaccctcctttagttatgcagaaaaaaaaccctaaacttggcaatgaaaggcaagttttaggctctatcaggctgccccacctcttctggataaatattcagtaacttccgtgtttgaacttcccgccagccctgggtcccaccgggctttcgcttccgccccctcttaagggttcacccatgccttttcctccggaagtggcctgcggatatcaccgcacttgcgtgcgggaagcatggctgcacactctgtgtcctttctaacctgcagagaaacgttcttgttcaacaggacagcggtcatcctgtgggatcagcttctaaagtcaacagccggtgaaaattgtgttctttttccacaatgaagcaaactcacctctgcaccctctggcattgcacctcctctgggtctcagcctcaccttccatctctccctcatggtagccgccttcttggcagggtccttccctctcagtttttttaataccttgcactttgcccactgaaggcacctagaaacttttggaaatctcttgtaccacacacaggccgtgggggaacctggagaggtgctttataagacacctcctctccacctagacgagactgtgtggccacctcgtggtgcaggccgacacaaacgaaaatcaggaaataagctctaggatttccccagctttatctagttgattgcaacaggtcataccaggagtgaaagcagatggtaatttggggaggcaaagaaaggtacacataagaagaaggatataattatagagaagtaggaggagaaaagtgaggtacaggggtacagagatctgaaagagtgggagttaggggcatgagaagggaagtcactgattgggactgtaggaggctcactgaagaccccaatttaaactattaacaagtcattatttggtccagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagagggtaaggctgatgatggaatctgccatttgaatggctcagtgtgggagggtctctcctgaagcaggtacagagttaagtagatatgtaaagtcaatagtaaaaggaaaaagtacagagaatgaggatggggtataacaagaggaacaaagagagcaagcatctgttgcatctgaaaagttttgtggaagaaacagacgtgttcacagggacagctgtggcctggggcagcagctctcaaattttttggtctcaggactcctttatgctctcaaaaattattgaggaccctaaggagcttctgtttatgttgtttatgtctatctacatgtacctgattagaaattaaaactaataattttaaaatattaattcatgtaaaagtaacaataataaaccaattgcctgttaacataaatagcattattttatgaaaagtaaatatattttctaaaacaaaaaaaattagtgaaaagagtgacatcattttatgtttgtgcaaatctctttgattgtgagtgagctttataaaaagacagctggattcctacaactgtttctgcattcagttgtgatatgttgctttgattgaaggatagaaagaaaatctggccttacacagatatctagtttaaaagggtgaggtaatttaacagtcttttgagatatctgtggatattcacctttaatactacaccaacactcaacaagtgatagtttcttaaatattagttgtaatgtaaaatttgaaaccatatcaattaacttcatactctgttacaataaaatacattaatccaccttgcattttgaatggaccttctactaatgcaagattttataatagtacagctgtttggaaaatatacatttggaattatacagtgagcttgtatctcaatcacacaagtgttttcttgaggccactgtggtacttcaggatgcaatagaagtgctttatatgtgctcttcagtttttcacatagaatattaagatgtcagatatgtactcaagggtagaaatttaataaaattaataatttttactggctcaccaaaaacattctcaagtgaatcttgcttttatttttattttttttggtacagtgagtaggtggcaataaaggatgcagtgattcctgctgagatttggggacactgctttgatgtgtcttaaggcaccagcagttttatctgccattgctcttgctcaatctgtacaaaggttgaaatagtgaaaaaggcaaataacatcatattatgaaaacaatttgaccttgcaaattttctgaaacggtttgacagaccccctaggggctcacagaccttactttgagagactctggccaaggggttcagatggctgcaccccactgtggatgtctccattggtagagtaaccactgctaaccaactgcggtctgctcctcccctgagtggcagacaggcacagtgtcatgagcagcaccaaatctcttggtagatgcattgttaggagggtaagacctggagcctccaagactcaacttcagagtgtgcaagggccttcctgggtctctgggagattctccatggtgtttcccaaggggcatttactaagatctttcattttccagagatcattgatggcacttcagaaatgaatgaaggaaagaggtcccagaagacgcctagtacaccacgaagggtcacacaaggtaaaacttggagattgctggtctcagagtacagtcaccaggaatctaaattcagagctgtcttacactgaggcaatatttcttaacttttttttttcattattactgtgctagagagcccttctggatttttttttcttaatcaagacccttcccatgatatttactactacaaatatatgtccattttatgtaatgtgtccatatgtatgtatgtatatctgcactatataagatttttctcagcactcaagaatgagtttttccactactggcagcaatatcaccattactgagaatgagtgtcctaagtatattcatggtactatactgaaagtacagcttgtccaaagtgcagcttgatccaacccatggatcaagctttttcctagaattccaatctccatatttctcatgtggcctttctgagaaaattgagaagcgaaaaactcattaaaacacacatgtgacactatgactgagcatgtacaactggtggagttgtgggcatgtgctggtaaaattgtgcatgttaattcacccctcactatcgctaccattattcacatttctggagtaagttgataacactatccttagaggggaaaaaacagctagatattcgtctgtttgctggtgatatggtcattgtcacaaaaatcacagaactctcacatgacaaatgtgattttcaaacaacaaatatctaattattgtcaggaaaaatggattaaattttaccaccttaaaatctaaattatcattttaacagtttctcctatattgcactggcttatctagtagtatttcaacttttctcatggataattttattttattttcacaaccacccttggagaagattgaatgacctattccaatttagcagatgaggaaattaagatatggaaaggattaatggatttttttcaggatcccctgggtaagggctggctgccaccgggttaacaacctggtccccaggaactcttttcaggagccatcgttctccatagaaaggaaggggcagaaagaatactgtcaaacctttgtcaattcactattgcccaaaatagaaaactgcttattcaaaaattactttctcattacttccaagatcctatggataatggaaataaactctctctgggaaaatctcccagggcagagcataagtgtgaagaagaaactatttggtctctgtggtgtggattgatgttaccttactgttattatgccattctaggccataaaagacatccaagccagaaaaagcgttatgctttttaaaatcatgatttcactttttttcaacatagaaaagttcctggacttttctaaaagcagtgtgctgtcaccattaggattatgttgctggcccagcacagtggctcatgcctataatcccagcactttgggaagctgaggtaggtgaatcacttgaggccaggagttcgagaccagcctggccagcatgatgaaaccctgtctctactaaaaatacaaaaactagccaggcgtggtggtgggcgcctgtaatcccagctacatgggaggctgaggaaggagaatcgcttgaacccaggaggcagaggttgcagcgagccaagatcacaccactacactctagcctaggtgacagagtgagactctgtctcaaaaaaaaaaaaaaaaaaaaagaggattatgttgctgtgtgtgacagcaaacctcaccccactaaaaaaaaaaaaaaataataataataataataatagtagctaaagcaagagaggtaggtggtcaagagctggtgtcatacactgtagggtcctgggcttattcttgcttgttgctccatcatcctcagcatgtggctccatcatcctcagcatgtggcatcccctttattgaggtccagccagcatgtctatgttccagctaaagagaaaatggcaaagtcaaagaagggcacacctcctccactgaaggactctaaatgcttccggtcacagatagtaatttgctatcattaataatttgctattgggaggccgaggtgggtggatcacttcaggttggaagttcaagaccagtctggccaacatggtgaaaccccatctctgctaaaaatacaaaaaaaattagctgagcctggtggtgtgcacctgtaatcccagctactcaggaggctgagacaggagaattgcttgaacccaggaggcagaggttgcagtgagccaagatcatgccactgcactccagcctgggcaacagagcaagactccatctcaaaaaagaaaaaaaaattctatcattttattgccaggactggttgcacggccacacctgacttcaaaggaggctgggaaatgtaatctttaatctataagaataaggggctcagaatcaggggctttattactaaagaaaaagggagaccagagaaagaggaacaactagcagtgctcaccctgcccatgtttatggtgggcattatgactgccctcctctagttccaattcttctccccttcccagacacttggaaagctccattatcatcccccttgcaggaggcagctctgctatactagctctggcaaataagccagagagatgggtgtcacttctgggtcacagcatgtaagagcccattgcagctctccacattcttttcccgcctgtggaagtgtgtggaagagggaggcgccagaaggccaaagcagcatgacctaccacatagaggacagcagccctggagggccctacagaggacttccagtcctacagagggtcctattgtcctacagagaacttcatgtgatagagaaatacacttttcaatgttaaaccaccaaaatttggtttcatttgttactgcagcacagcctaccctgtcttgtgtgatacaatattcctaataaaatcttcagtgtagaaaattgtaaatcaggctaggcatggtagctcacacctgtaatcccagcactttgggaggccaacgtgggagaattgcttgagcccaggagtttgaaaccagcttgacaatgtagtaagaccctgtctcaaaacaaagaaaaagaaaattatatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaagcaataccattcaggatataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaattaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtacactagttcaaccattgtggaaatcggtgtggtgattcctcagggatctgggactagaaataccatttgacccagccatcccattaccgggtatatacccaaaggattataaatcatgctgctataaagacacatgcacacgtatgtttattgtggcactattcacaatagcaaagacttggaaccaacccaaatgtccaacaacgatagactggattaagaaaatgtggcatatatacaccatggaatactatgcagccataaaaaatgatgagttcatgtcctttgtagggacatggatgaaactggaaaccatcattctctgcaaactattgcaaggacaaaaaaccaaacactgcatgttctcactcataggtgggaattgaacaatgagagcacatggacacaggaaggggaacatcacactctggggactgttgtggggtgcggggaggagggagggatagcattaggagatatacctaatgctaaatgacgagttaatgggtgcagcataccaacatggcacatgtatacatatgtaacaaacctgcacattgtgcacatgtaccctaaaacttaaaatataataataaaattttaaaaaaaagaaaattataaatcataaagttaaacatctatttaatctgcttcccccactttatttttgtataagtatgcatacatttttctttttatatataagctcatactatatagtctattctataaatcacttttttcattgtgtatcatctctgtatcaatgttatctatttttttaactgcatggcacgttacgtatgattcaccgcaatttgtttaaataatcacctactagtggacagtttatttcttatttttatatgaaaatagaaatcaggtttgtgtgtatttgtatctttgcacacttgtccaataatttccttagaattgattcttaaacacaagcttacttggttaaaatctatatcttaattatacatgttaccaatttgctgtccagaaaacataatgatttatattccctttaacaatatatgagtattcatttcctacatcctcaatgctggatgtaataaaactttttaaatgtttaggtatccttaacatccaaacaatgagtttctttgattagtagtaatatagagatgatttctaaataaatttgtcatcttcatttcctccttgagcatttttaacttatattttttgcttattttcctagattaccattcatcttttgctttatctaataaggatattaaccttctatatgctatgtatatttaaattttgtttttgctttaatagtgtcggggtgttttttgaactgtgaacagtttttttcagtcctgctccttctgtatatttttaattttttaaacattcaaatctgtttatctcataactgtgtaatttctggccctgaattttggctaggaaaccttttaatatccatggtttataacaatctttgtctagtcttgaaaaactgcttattaattttaaaattaataaggcatgccggctcatgcctgtaatcccagcaccttgggaggctgaggcaggaggttcacttgagtccaggagttcaagaccagcctggccaacatggtgaaaccccgtctctactaaaaatacaaaagttagcctgggggtgcatacctgttatgccagctactcaggaggctgaggtgcgataatcacttggacccaggatgtggagattgcagtgagctgagattatgccactgcactccagcctgcataacagaacaagactctgtccccaaaaaattttttaaatgacatatattaaatgttagtcctctagtatattcctgatccatctttattcaatccccaaattcaatttccagctaaaatggagtacttttttcacataggtcacatggttttcttgccttctcaaagtcagggaaaacaggaaaaaaattacttaaaaaagtaatgacattgcaggtttgtagatcaatatttgtagccataaaagatgtgggttttttcttttttagaaaaaaggagaaaagaatatggccaagttcaaaaagaaaacagaaaaaaaaaatgcccaagacataaggaagaaaagtgaaattgttactctcttggtgtttatcaggcccctcacctgaccagctggcatgacctcctctccagccacatgtgcctggagcatagccagccccaaccttgtcccctaggccaccccatcagtagactccccaacaaaggaagagcaaacctaacaccaacttggtttatacctagtcttcttttctcttatcatagggagggaatggggttgaggtggacatgaggcatcagacaattttgagattagaattgtttcctgtctagggtcagagcccagaagaatagacacaagtaacctaaatccccaggcaggattcagactttcagttccaaactggattagatttggagtcatagagtgttcagaactacctcagtcaacccatgcttgcttgcatgcctgcatgcatgtgtctactccagtgcacaaactgtgttacttgcagaataagaaacaaaaaagctgcatttttctggttcctctgcttcatcccacttttctttttctcctctgtattctctccctcttccctttctctgttcctttctttttccctttttctttttttaatttattttgtaaattttttgtatagaccaggtcttgctatgttgtccaggctggtcttgaaatcctggcctcaagtgatcctcttgccctagcctcccaaagttctcggatacaggtgtgagcccctgcacctggcccctttttctttattcttttactcaaaattattcacaaagggcctaagatatgccggtcagtggggattctcttggattctatacctttatgggagccagcctgggaagagatcttgtcccagctcccaaacatgaattaggacatgaggctcactgctttggaaatccctctaatttttctgcttgttcccagcatgcctcaatcttggggtttggcctagaaggaaagtcatatctgcctgcttgcacttcccctccctggcctcttcttcctagttccccaccccactgcctccctaggctggaggaaacatactctctgtcatttgctgagtgttcactaccaatgacttataggaaaacttgacattcagacctccaaagttttcttttgataggtacaggtaatttttggaatttataaattcctctttgctcccaacaaatactgtgcttcaagattttgtctaagcttgccaaaatggccccaactgagcagtggcttctcaattctagcaagcatctgccctccccctgaaacctattgatgtaatagtcagggaaatctttactatttgcaaggatgaaaaatacatgattcctcagcagaaaccttacaagctggaagggattggagtcttatctttagtctccttaaacagaataactctcagccaagaattttgtatctggcaaagctaagttttatgaatgaaggagaaataaagtcatttttagacaaacaaatgctgagggaatttgtcactaccagaccagctttataagaaatgccaaaaggagttctaactcttgaaacaaaagattgatatgcaccagaatacaaactcttgaaagcataaaactcacaaggtctataaaacaataacacaatgaagaaaacaacgtatgtaggtaacaattaacatgatgactgaaacagtacctcacatcttgatattaatgttcaacataaatgggcctaaatgctccacttaaaagatacagattggcagaatggatacaaaatcacaaaccaaatatctgctatcttcaagagactcacttaacacacaaggacccatataaattcaaggtataagggtgaaaaaagatattccatgcaaatggaaaccaaaagtaaacaggagtagcttttctcatatcagataaagcagactttaaagcaacaacagtaaaaaaaggcaaagaaggtcattatataatgataaaaggatcaatctaacaggaagatattacagtcctaaatttagatgtagctaacactggagctcccagattcataagacatttactactagacctaagaaaagagataagacaacaacacaataatagtggggaacttcagtattccactgtcagcaccagagagatcattgagacagaaagtcaaaaaagaaacaatagatgtaaactacactctagaacaaatggacctaatagatatttacagaagattacattcttctcatcagcacatggaacattctccaagatagaccatatgatagccacaaaacaagtctcaataaatttttataaattgaaattatagtttgatgggaataacattgaatctataaattactttgggcagtatggccatttccaagatattgattcttcttatccatgaagatggaatgtttttccatttgtgtcctctcttatttccttgaggagtggtttgtagttctccttgaagaggtccttcccatcctctgttagctgtattcctaggtattttattctctttgtagtgattgtgaatggtagttcatcatgatttggctctctgcttgcctattgttggtgtaaaggcatgcttgtgatttttgcacattgattttgtatcctgagactttgttgaagttgcttatcagttcgagaagtttttgggctgagatgatggggttttctaagtatataatcatgtcatctgcaaacagaaacaacttgacttcctctcttcctatttgaatacgctttatttctttctcttgcctgattgtgctggccagaacttctaatactatgttgaataggaatggtgagagagggcatccttgtcttgtactggttttcaaagggaatgcttccagcttttgcccattttatatgatattggctgtgggtttgtcataaatagctcttattattttgagatatgttccatcaatacctagtttattgagagtttttaacatgaagggatgtagaattttatcaaaggccttttctgcatctatcaagataatcatgtggtttttgtcttggttctgtttatgtgatggattatgcttattgatttgtgtacgttgaaccaaccttgcatctcagagatgaaaccgacttgatcatggtgaataagttttttgatgtgctgctggatttggcttgccattattttattgaggattttcgtattgatgttcatcagggatattggcctgaaattttctttttttttgttgtgtgtcttcccagttttggtatcaggatgatgctggcttcataaaatgagttaaggaggagttccctccttttcaattgtttggaatagtttcagaagtaatggtaccagctcctctttgtatttctggtagaatcagctgtgaatccatctggtcctgggttttgtgttgttggtaggctattaattactgcctcaatttcagagcttgttattggtctattcagggatttaacttcttcctggtttagtcttgatagggtgtatgtgtccaggaatttatccatttcttctagattttctagttcatttgtgtagaggtgtttatagtattctctgatggtagtttgtatttctgtgggatcagtgatgatattcccccttatcatttttattctgtctatttgattcttctctctcttctttattaatatggctagtgatctattttgttaattttttcaaaaaaccagctcctggattcattgattttttgagggttttttgtgtctctatctccttcaatttttctctgatcttacttatttcttgtcttctgctagcttttggattagcttgctcttgcctctctagctcttttaattgtgatgttagggtgtccatttgagatctttctagcttcctgatgtgggcatttagtgctacaagttttcctcttaacactgctttagctgtgtcccagagattctggtatattgtctctacattcttcacagaattagaaaaaaaaactattttaaatttcatatggaatcgaagaagatcccatatagctaggacaatcctaagcaaaaaggataaaacgggatgcatcccactacctgactttgaacaatacgacaaggctacagtaaccaaaacagcacggtactggtaccaaaacagacatatagaccatggagcagaacagagacctcagaaataacacgacacatctacaaccatctgttcttcaacaaacctgacaaaaacaagcaatggcaaaaggattccccatttaataaatggtgccaggaaaactggctatccatatgcagaaaactgaaactggaccccttcctcacatcttatacaaaaaataactgaagatggattaaagacttaaatgtaaaacccaaaaccataaaaaccctagaagaaaactgaagcaatatcattcaagacataggcatgggcaaagtcttcatgataaaaaagccaaaagctattacaacaaaagccaagattgacaaatgggaattaattaaactaaacagctacagcacagcaaaagaaactagaaatagagtgaacaggcaacctacagaatgggagaaaaattttgcaatccacccatctgacaaaggtttaatatccagaatttacaaggaacttaaacatatttacaagaaaaaaacaaacaactccatcaaaaaatgggcaaaggatatgaacagacacttctcaaaaaaaaaaaaatttacgtagccaacaaacatatggaaaaacgctcaacatcactgatcatcagagaattgcaaatcaaaactgcaatgagagaccatctcatgccagtcagaatgacaattattaagaagtcagaaaacaatagatgctggtgaggctgtggagaaataggaatacttttacactgttggtgggagtgtaaattagttcaaccattgtggaagacagtgtggtgattcctcaaggatgtagaaccagaaataccatttgacacagcaatcccattactgggtatatatccaaaggaatataaatcattctactgtaaagacacatgcacatgtatgtttatcgcagcagtatttaccatagcaaagacgtggaaccaacccaaatgctggataaagaatccagcatttagactggataaagaatatgtggtacatatacatcatggaacactatgcagccataaaaagtaataagatcatgtcctttgcaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtcccattttggggggttttttagaagaaaaaaattgaaattatattaagtatctcctcagatcacagtggaataaaactagaaatcaactccaaaaggaactttcaaaaccataacaaataaatggaaattaaataatctgctcctgaatgatttatgggttaacactgaaattaagacggaaattagaaaattatttgaaatgaatggtaacagtgacataaattatcaaaacttctaggatacagcaaaagcagtgcttttaagaggaaagttcatagcgctaaatgcctacatcaaaaagtctgaaagatcacaaattgacaacctaatgtcatgcctcaaggaactagagaaacccaaagctagcagaaaaaaagaaagatgagagaagaatgaaataaaattgaaacaaaaaataaaaaagatcaattaaacaaaaagctggttctttgaaaagataaacaaaattgatagaacattagccagagtaaccaaaaaaaaagagagaagtttcaaataaactcaactagaaatgaaactggagacattacaactgacaccacagaaatacaaaagatcattcaggactactatgaacacctctatgcacaaaaactagaaaaatctagaggaaataaataaattcctggagacatacacccctcctagattaaattgggaataaatagaaaccatgaacagaccaataacaaacagtgagattgaatccagcagcccatcaaaaatataatacaccatgatcaagtggatttaatcccagggatttagggatggtttaacacatgcaagtcaataatgtggtacatcacaaaaacagaattaaaaaccatagatcatttcaatagatgcagaaaaaacatttgataaaatccagcatccctttagataaagatcctcaacaaactaggcatagaaggggcttacctcaaagttataaaagtcatatatgacaaacccacagccaatgtgatactaaatgggaaaaaatctaatgcattcccctggagaactggaataagacaaggatgcccactttcaccacttctattcaacatagtactagaagtcctagccagaacaatcagaaaagagaaagaaataaatgacatccaaattggaaaagaaatcaaagtatcactgttccctgattatatgatcatatacctagaaaaccctaaagactccttcagaagactcctagatttgataaatgaatccagtaaagtctcaggttacaaaatcaaatgtacacaaattagcactgctatacacctacagtgaccaagctgagaatcaaagcaagaactcaatcccttttaaaacaacttcaacaaaataaaataaaatacctaggaatatacttatccaaggagatgaaagatttctacagggagaactacaaaacactgctgaaagaaatcatagatgacacaaacatatagaaacacatcccatgttcatggattggaagaatcaatatgaaaatgatcacactgcccaaggcaatctacagattgaatgcaattcttatcaaatatcaacatcatttttcacagaactggaaaaaaaatcttaaaattcatatggaaccaaaaaagagcctgcaaagccaaagcaatcctaagcaaaaagaacaaatctggaggcatcacattaccagacttaaaattatactacaaggctatagttaccaaaacagcatgatactgttataaaagtagatacatcgaccaatggaacagaatagagaactcagaaataaagccaaatacttaaaaccaactgatctttgacaaagcatacaaaaacataaattggggaaatgacaccatatttaataaatggtgctgggaaaactggttagccacatgtaaaagaataaaactggatccctatttcccaccttatacaaaaattaactcaagatggatcaaaaatttaaacctaagacctgaaaccagaaaaattctataagaaaacctaggaaaaactcttctggacattggcctaggcaaagaattcatgactgagaccccaaaagcaaatgcaacaaaaacaaaaataaataaatgggacttaattaaactgaaacgcttcttcgtagcaaaggaaataaacatcagagtaaacagacaacccacagaatgggagaaaatatttgcaaattatgcatccaatgaagaattaatatccagcgtctacaagaaactcaaacattatagaaaaaaatcccacaaaaagtgggcaaatgacattaatagacatatttcaaaagaagatattcaaatggccaagaaacatctgaaaaaatgctcaacatcactaatcatcagggaaatgaagattaaaaccacaatgagataccaccttactcctgcaagaatggccattattaagaagtcaaaaaaaaatagatgttaacatggacgtggtgaaaagggaatgtttatacactgctggtgggagtgcaaattagtacaacctctatggaaaacagtatggagatttcttaaataactaaaagtagatctaccattccatccagcaaccccactactaggtatcaacccaaaggaaaataagtcattatatcaagaagacacctacacacatgtttattgctgcataattcacaattgtaaagatagggaaccaacctcagtgcccattgaccaatgaatgtgtaaagaaaatgtagtatatatacaccatggtgtattactcagccataaaaaaagaatgaaataatgtcttttgcagcaacttaaatggagctggaggccattattctaagtgaggtgatggaatggaaaaccaaatactgtatgttctcacttataggtgggagctaagatattagtactcaaaggcatacagagtgatataacggattatggagactcagaaaggagagggacggaggagggggagtaaaaacctatgtattgggtacaatgtacactactcagacgaagagtgcactaaagtctcagattttgccattatataattcatccatgtaaccaaaaaccacttgtaccccaaaagctattgaaataaaaacaaattaaaaagaaaaatacatttaatattttcaaaactttagtgcctattaaacattcattcagcagtggagtgtaaggtgtgggccaggtatctgtcctaggtcctgggaactcagcagtgagcaagacagacacaaatccctacactagtggagcttgcattctaattgatacacctgtaattactaaacaaaatgaggacttgaaaaagagaaatagaaggaagtattatgagtctggggggaagaaagatacacacaagaaaagagagaattatagagaaatggcaagataactcctgaaagggtaggggctgggaacatgagaagggagctcactaaactattcacaagtctatttggtccaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaaggtaaggctaatgatggaatctgctatttgaatagctcaatgtaggagggcctcttggagcagtacagggtcagatagatatgtaaagtcaatagtagaaggagggagacgtacagaaaagagggacatgaagacagagcacggatctgttgatgtgacagtggttgttggaagaagtgttctcagggtgcagttcaccttggctttgccatgtggatttacatgactactccccagtgtctgctgttttcatttctgttattagagtcaccactactctcttgagtttgggagactcctttctggttctggccaacccagtcttggaagtggcaccaatcctcaaagtggacacatttgcaggattgttttttaatgtttcatttctagaagtgaagttgcttggtcaagtctgcatttttaagttaggacatatttgttgtcaaattgcctaaattgtctgtttatactcccattacatcatacagacaccctttccctccactttcaccaacactagaaataacaagatgtgtctatgatgacggccaaaggtgaagggtgatattccaccggtgtttccctttgaatttcttttcacttggcaggtgatcaaacatgctgtggtagcttgtattacggttctccagtgttccagtgccccacctcctcagaagtctacagccctgcctgtggactcaggaatgcccatgtgataacttagcgaaagaaatgtggacccaagttagagagccactttcaggccaaggctttaagagcccctttgtcttctttctctctgcccaagaccagggatgttctagacagaggctgctctgtctgcagaagccatgagtgtcagtgatgtagggctgagcctcatctaatttatgatgaacaaacagcatgagagagaagtaaacctttgccattgtaaaccagagcttggcaaattttttccaaaaaggaccagaagatgcaactactcgactctgcctttgtagcgtgacagcagccagaggcaaatacgtaaacaaatgggcgtggctgtattccaataaaactttatttacataaacaggcagtaggccaatttggcccttagaccatagtttgctgacacctgtaataaaccactgagatttgggaggatcgtgaattaccacagcattacctagcctatcgttaccaatttacctgttttttaaataaatttgacattggaattttttcttttgagggtcatctgtttgaatttgcccatttttctataagactggccattttttttttgttaaatccgttagggaaattaaccctttgttataattattagtttttctgatttggtttctgtctttgaacttaagaagcttttggttgtggagccatttgcttagttagatagacaaatcagtttacctttagcagtatggtttatgccagagtttctcaatcttggcattattgacattttggactgaataattctttgcttcggaggctgtcgtgtgtgtcatgggatgtttagcgacatctctggcctctacccattagatgccagtagcacctgcttcccagtcctgacaaacaaatagatttccaaacattgccagatatcccctgagagcaaaatcacccagtgttaaccactgctttatgcccattacttcctccttaaaaagcccttcctatgtgatatttataaggccatacagtagcccccctttataagcagttttttgatccatgatttcagttacctgaagtcaactgcagtttgaaaatattaaatggaaagttccagaaataaacaatttataagttaaaaatgatgcgctgttctgagtagcgtgacaaagtcttgcaccatcctgctgtatcccactcggggatgcgaatcatcccttggtccagtgtgtcctgctgtatacgcagcccacccatcagtcacttagtagctgtcttggttatcagattgaagaaacatagtatctacaggggtgggcactacccatggtttcaggcatccactggagggcttgaaacatatgccgtgtggataaggggggactcctgtacatccctttattctagtatttgtagtaaatgtattgacatatattaattagtggaaatttggcttctgtagtatttttagcttttctgcctattaacatgagcttgctgtatttccttagtcaatgctacaaggaagtcctttcataaggactcatatgtaacttgtctctccaaactggtagaaaaacaggaaaaaatgcttgaagattgttaacctatgaggcttataaatctatgtttgtagctataagtgattattaattctgtgtttagaaaagaaaaaggagaaagatatctgttcaagctcaaaaaggagatttcagaaaaatattcaccgaagaggtaagcaagcaagccacagcgcctccccactgggctccccagagccctggcctctgctggaagctccacccgccctctccttcttctctctcccttctcctccaaagttgttctccaccgtcatgggtaccagctgaattgggtgcatcaggagtgctgccagcctaacccacccccttgtgcatggtggccatttccatacttggaaggattctttaacacagagctatacaaagacccaaaaatgattaaggatgatcactaaacctttaagtcaaattctaaaatgaacttctatgtcttccattctaggaattaaaggaaacccttattcaagcacagcctaacagtgttctcattccttttcctgtgttggttgggaccctgggcttgcttcagcctctctgcaccctcggccctctttgcatctctgtcctctccctcccactcctcttcttgcatttatttttcttctgcttttataccttgcttcttcagcatcatttcttgtcaccctctcttccttttttaggcgccagccacactggccctttttattcattatcaaagtataataggtgctacccaaggtggggtccccagactggtgccatctacaagcatgttggttggcaggtctacgagaataaggagcttgtaaaccaactgtgacgctaagcacactgttttcatagcaagattcctcagtggagacagcagtgcattgattctgatcaagcccctgtcgcatcgtaggctggagcactgagtagcactggtgtatgtgcttgcagaaaatggcatgtatcctaagagtacagcttgatggattcacacacacagaaaatgcacccgcacacccagcacgcagctcaagacacaggatgtcaccaacacccataaaccacccctacccgtgtctctagggtcacaccagcctgattcctcacagcataggtcatcagataccgaatgctcccaccttgttcctgctcagggcctcctcacatgggcctcccagctcacccacccaaccccaaagtgaatccccctatcttcctccctttctttgctatacaccctcagacctcaccttttttaaaaatatttattttaagttccaggatacatgtgcaggatgtgcaggcttgttacataggtaaatgtgtgccatggtggtttgctgcacctatcaacccatcccctaggtattaagcccaacatgcattagctatttatcctggtgctctccctcctgctcccctgataggccccagtgtgtgctgttctcctccctgtgtccatgtgttctcattgtttaacccccacttataagtgagaacatgtggtgtttagttttccgttcctgcattagtttgctgaggataatggcttccagctctaatcatgcccctgcaaaggacatgaccttgttcctttttatggctgcatagtattccgtggtgtatatgtaccacatattctttatccagtctataattgatggatatttaggttgagcccatgtctttgctattgtgaatagtgctgcggtgaacatacacatgcaggtatatttataatagaatgatttatattcctttgggtgtatacccagtaatgggattgcttgctgagtcaaatggtatttctggttctaggtctttgaggaattgcttcgaggtctttcacaatggttaaactaatttacattcccaccaatagtataaaagtgttcctatttctccacagccttgccagcatctgttgtttcttaactttttaataatcgccattctgactggcatgagatggtatctcattgtggttttgatttgcagctctctaatgctcagtgatgtggagctttttttcatatctttattggccgcataaatgtcttcttttgagaagtgtctgttcatgtcctttgcccactttttaaaggtgttgtttgtttttttcttgtaaatttgtttaagttccttgtaaattctggatattagacctttgccctcagacctcaccttaaatgtcacttccacagggaagcattctctctcccagcaggtaggggtgggtctccctgacatgcccttgtggagacctgcattttgtcttcatggcacttatcttaactgtgatgaatgatctgtgcacagcctgttcactgcgtgaaagtcacgtgaggtcagtaagtggatgggtcttgtgtgttgctgtatgtccagctccccatgcctcacacagctggtacttcttcaagtatgaataccagtatctgggcctatctgatgcatgtgtgtgagttagaaaaaggtgccccttcctcaattcactacgtcatctgtcagagccaattcttgaaaccaaacccttttctgccttctgctggaagattgttgtactaagcaggtaaactgattctgtttctaatatgaattagagcaccccttaaaggtggagtccttgctcagggcacaacccatacaacttcatgcagtggtcctgataaccatataaatgtgtacattacttcacagttggcaaagcactttgatctacattttgccatttaattaccataataagtgagtgttatcagcccattttacagattcaattaaagggcaaaagacttgaatgagctaaaatcaacctatgtgttccaatttcaagccctttttcctttacactaaaaatgtaaatgaacctagaaagcacctactctcaaacactggtggaggcaggagccccggcaaacgttgacagttgtccctcagcatcagtttcttctcccttctgcactgtctgtaacttctcattaaatgcagagtatctgtgctgttgttgcttgtatgatgtgcagtctcgtggcatttctgatgatgtggaaagagcgctagatactgggtctggcatgtgtaaattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccgctgctgcagctcacctttcaaacaagccagctgccgttagagagccccaagcatcccccaccgggttcctggggctgcagggttccatccttcaaggcctggttggtaagatgagtaggtgaggctgagccagacttagcactattaggaacaggctgccctcaggcataggacagttggctttggaagtcctcgggtctaaaggccccacctcacttgatggcctgcctccactgggtaaggaagggactgatgtttgtcctcacaactctgcacatcagcttgctacccgtggcccccaaagccaccccctgctccctcatctgcttgtgaatgtgtttgggacatttgtgttccctaaagctatattcaccacagggaattagagaagacatttctgtggagacagagaactgtagaagggaaggtccccagagctgtgctaatctccctcaaggtttgcaatagtggtccagagtcacctggagctctgcctttccctcacattaggaacctgcggcagcaaatttcccactcaaatttgataacagtaatgcacgcttaggtaatccttctagtaagttgcagagccaggattacaagcccctcccacccccacccctccctgccccccagtctggctcccaaggccacgctctcatctgctgttccatatttactgagttgagtctagagacaaatggtggagctggccactccatgcaagagggctggctgttgaaacaaagtttttcccaccgtaagttcccacacccccactaccctccacccccatgcctagccttgctgccagcccctgctcctgtgaggccaggcatcctgtagggttctgtcggggggatcacatcctcacttctcagggtccctcctctctcagtctcactctatctgccttgtgtctttccagagaaatgaatggcttcttcgccgctgatactgttccttcacctttccgtcaatgctcttgttttgccatttgttttcctttagctctttcaataactgtttgaggcaagggagagagttggaccaggtgttctcctagattcattttaggtgtaacatcctctgtaactcaacataagacatggacagccccttcatttctccccagagaaacagcccctgctgtctctctttaatgaattcacccatagtgaggttggaggggaaggcagcaggaattgctgagatttattttaaaccctcttgcaactgcttcccctgaatctaaactctggatttctacccaggggttctgagttgccagactgctccatgagcaactgggaaattagttcaaagctctccagggttttcttttattcatcgaggaagaagcagggaagcaataaaatgaaaagaaacagcaaataattaagactgacaccatcccctcagtgccagccacctcactcacccaagtcttcatttgagtcaggaaataagattataaatgaagatttttttttcctctggcaacatgaatgcaaagaaacatttccatcagcacagagagatcagcaggatgcttatagaatagaagactattcagtgacagccaattcacttgcaaattaagacacattcactgaagatgccctatatgttccactaaaatgttttttttttttgatatagtgttggtggcagtggtggtttgttgcaggccactgtgtacacatagcttatctgtcactcgagatgaaagagttcctgcaaactaaccagagaacgttccccaataccctgtacattattggaattcatggaggggagaattcaaaaggaagatggagtgaagactgaataacacaaaactgttctcttctactttaaggaaaacccaaaagtgacactgtggattttcactgttctaagctccccgtgacctgtggtgaggcgaaagggattttatataagaagaaaatgaaacacggtgagttccttggtcttctgctctttggaatccctagatgaaggactcactagaagggaggaaaatacccgtgtgtgtaattgatcaggaaatggaccctgctagctagactgcagaagaaacgcttcttaggaaggaatttccaaactcttccacatcatggtatttctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaaaggtagaaggccacaattaggatgaagaggttcagggtgaattcacagaggatgggggtagatccaagaatgggctttttcttacaggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctgatggtggagaactttaaatgcaagtaaaggagtacaggaactttaaatgccggcaaagggctttgaggtgaagagagatgtaagaacctaaaaagaaactagctgaagacagatgcctgcaaccactcccctgcatcctctacctgacatctactcaaggcccagctcatctggcccccctgcagcatttccaggctgcccagtccgtggtctgtctctccgctgcatgtccacagcacactattcctgtcctgagaacaactagtgtctatgatgacaggacccaacacaaggcctctctcagcaacactcaagaaattatcactaggatgaaatcctaaagattttaatctagagagggagaaatggaaggagaaaggaatggatgggaaaggttaagaaagaagaactagggtcgtgggtttgagtgacaggggaaaaagtgattttatcactaagtgaggtccagaagaaaaactgactgggggagggagctaatttttctttttgacttcttgggtttgagatccagtgtgatgtctgggtacagacattcactaggaagtgggaaggccagtatctacaaaagaaaaacctccagaataacctcattcattgactccttctgtctttcagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagctcatcatgtccatgtgttttagaaaaagatctggatatttggatggctataaaccaaaggtgtcagaaataaaatgctctaagcctaggcaacatagcaagaccccatctctaacaaatttttttttaatcaactaggaatggtggtgtgcacctgtagtcccagctaaggctgaggtaggaggattgcttgagcccaggagttcaagaccagcctgagtgatatagtgagactctgtattgctatacagagcgatgtaatcccagcactttgggagaccaaggtgggtggatcccttgagcccaggagtttgagaccagcctgggcaacaggacaaaaccccttctttacaaaacatacaaaaattagccaggcatggtggcatgcacctgtagtcccagctactcaggaggctgaggtgggaggatcacttgagctctggaggcagaggttgcagtgaggcgagatcatgccactgcactccagctggggcaacagagcaagaccctgtctcagaaaaaaaaaaaaaagaatgctgcagcatgaaaagcaaaagaaaaggcattgaaatagacaggaacagtatatgaaaggacaagaggatcatccatgattgcatactgagtattgctgaatcctccatgcttcttattggtagcaccaggatggaatgacgcctttgaactgagctttgtctctacagggcatccctacagctggaaatggcagtcatctattggctgcactaactccccctcctcaacctcctctacttgcttagatgtgttctccagacacatcagctccactcatgagcttcccgttagttgtgaacttccagcagagacaatggtgcctcccccatcttgccctggaggctggcctgaccaggctggattcattcaaagtttaaggcactggtctcccaatgccatctattatataaatcatctttcccatgctggtctgaaataccctgagaatcaggggtgctcagtgtaacatcataatagcaaaaaattagggacgaacacaagttctatcagtattgcagaataaactgatacagctacagaatggtttttttttaaacttttcttatagaatattagacctttgatataggtatttgtttaaatacatggattcataagtatggagttatccttcaatcaatggaaagccaccaaatggttttgtggtcaggagagcttcaggacacttaatgctagttgtgacgtgtggggaaggaacccattgttgcttatgtgaacgtgtaggtaggtctatgagtgaaaaaatagccaaaagaatcaactgcacttattttgagatgagatcacagggacatatgccttctgtattatacctttatgtacaattggaattactataatgaccatttgttacttttgcaaccagaaaaaaaaaaatctttaaaatccagatcattaattaatagccccaacatggtaataccctctaactctcctaatgccacatgtcagctcataatagccaggggcatgcttgacccagcctctcagtcccaccttccagggccaggttgggagaataagatgaaggtttacctgactgagaatgagccagtgtgggccttgccctcagccccatcatccagtgtcactgctgctcggcagcacgtccgtctgtctccactgcagtctcacttatgtatgtgtacaacaaagagaccgatgctggtactcccaaaatgtgttttgtggttgccctgcagcgtgctgcctccatgacccacacatgatgggcagctggtgtaaagagccacagacttggcctgtgagagcctccgtctccagaagggcttggatgcagccagcagttgccactctatcagcatatagtgtgaggctgaggagaacagcttttggggttttggtttttttttgtatcagaagcccatggccatcatgggtggtccagagatgccaggaggcatgagaggaggttgccaaagcttccacagtgaatgagactcaggagggcactaatgtctgctgtattgcaatttgacagattctagaaccttttgttagaaggggccccattcaaagtgggcttattttgcaagtaacagcgtaaatgggcttacctaaaatctacaaatgaaggatgtgtttccttgaactcaagaggcctgaaggatgctgggaggtttattagaacactgtgagtactcagagggtcaataattattttttgacagtgtcagggatggagcatccctcaactgaccagacaatggccagaaattggtgtggatccctgtactatgcctggggcagtggcccatacttttttgttttagtttaatcccaccatgtggaaacacaaaccccatccttttctatgagttctttgtgagtaatgtcctgagtgtgtcaaatgaatttgctgaaagaagggtgtcttcagggtgatgttacacctgtactcctagagaatgtcagatgcagttcaaatcctgcctgcaaagattgtgtatggtggcagaactgtcgaggtaccccgtggtagccagataacggtctattgtgtcccttcgggggtgaaagcaacctgcagctgagatctgttgaaataggcgctgaacagaacacattagtcaaatctatgcctgcagagtatttaccacttgctaagtggatggagtcagtaatttcaataacattgggccatcacaggtggggtcacaggattcaggttgtagtaattcaccgagaggcaccattcattctttccaagcctaagaacagaccaaattgggctgttaaatggagaaacagtggggataatcaccctttctctaaatagatcttccataatgagtttcaatccttgaaagccgtgttttaattcatattgatcagtattaaatattttaacagagaaggtccatagagttccattttgtaaagccaattgtaagtgccaaaggtaacttaattttaattattttaatgtgttatttactgggtcacagcatccacgcccactgtggaacattttagggccatgttatgttacgaccatggggcagttaggcaaggcaccaggaacaacagttcccatactcctgcacccaaatgccagttatcatcatttcttactttggtcagttagatctattaatagaggcctggtgggctcagcaaatgcgcccagagtggcccagctcaaagcacaagcttgccagcaggcagcagcacagctcaaaacgcagcagaacctgttggcaagccacagccagagaagaaaagtcctggtggcggcggtcaccacccagactctctgcttgttgtgccatttgtcttgcaatttcccccagggaggtggcatcagctccccccatcaaaaattgggtttggatatccactctggcacacacaaaaatgatgtgttctagaaccccacagggtcagcattcgtgggtctccatggtcctagcggtgcccacgttatctgcccttgcagcggaaaaactcggatgaatgcgaggtgtgctgtcaagggggacaacttctctgctgcggtacttgtccacgagtcttccatgaggactgtcacatcccccctgtggaagccaagaggtgagtgggatgcagccccgcctcgggcacacagcactcacctccagatggaaagggcaggacctgtgagcgtcggggccgagggtgtgacgcagagcagtctggtgccagagactctgggcctctctgggtctctgagactgccagtgagcctcttggccccacactgcttctgcccctggaagtgccctttcctagtatgctattccctggacagcagggactcctgtccaaaaggagtaggggacgggaaaagccagcttatgttctgtgcctgttgaggaaagacaggaagcacggcttgtcacacatttcaccatagtctcacctggctgatggaggcctgaggtccctgcaggtgaaagcccagattctgacactcaagcctggcaggcagggttcctttgtgctcccagcagctcagacagggaaaagagagcccacacttaacagtgacaccaccttcctcaggctgcccgcctgccgctaccactgatgcgagggaagggccaatgctggagaccccatgtggggatcttggacactctgggaggtgtcccaccctcatggctgagcccatccttcctgagggaagacagtggcagccacaggaatggtggccatttccaggggctttgccctctgctcaccttgtgtccaacctctcaggatgctgtggagttgcaccttctgtaggatgaagaggtcttcaggaagccaacagtgccatcatgtatctaagaccctggagaggcagatgcagcctcaggaccagctggtgagttggatgcaaaccccaaacctatacttttcccttctcacacgagaagcacaaacaggcacagggtcagggcaatgtaccaaagggagccttcaatgtctccctttaaaggatgacgatttaatgcccaaactcagagtctaaacaaaatcccacacaccctgtgcgccttgggaagcatggctggaatgctgactgggcttggctgccccatccgtgtgcatgtctagacactcgcctggcttcactgtttctaagctgcatttcactttcaagccctcttcacattttacagaaatgtgagttcctcctcttgaaggcctactgtcatccacaaagctccttttttacgggcatcccatttaatgtaagtcacattttacggttctcttgcataaaatgcatttggagaaatttgggggctgatctggcaggtgctgcagtttgctcaggaagctggagaacaggagagaagggcagcgtggcagcagtggagcggggcagcagggattttgctgcacactctggagagggactacctggttcaaactccaccccactgctcacgggctctgggataccgggcaagttgcttctcctcctgtgtatctgtttcatcttctctttaggaagaatgtctttcctactagagattaagagtcacagatgccagctgggctcagcggctcacgcctgtaatcccagcactttgggaggccaaggcgggcagatcacttgaagtcaggagtttgagaccagcttggccaacatggcaaaaccccatctctactaaaaatacaaaattagccaggcatggtggcaggcacctctaatcccagctactcaggaggctgaggcaggagaatcgcttgaacccaggaggcagaggttgcggtgagccaagatcgcaccactgcactccagcctgggtgacaaagcaagactccatctcaaaagaaaaaaaagagtcatagatgccaaactgtgtgggttcccatctcagctctaccactttcttgctgagacatcttgggtaggttccttgacctctccatccctcggtttcctcatctatgaaatgggcattattatttatggtacccataaatgtggagattacatattcatatacttggcttagaatttagtttatctagtgcctagaacaatagctggcttaaagaggtcaaatggtattatcattatgaccctggaaatgaaggcttggattgtatttaagttggatccattccagtgatgacagctgtgctaacgtcacctctggtggctttgtccccaagattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggtaaagagcatttcctgcttcctttttgcgtcttttctactttcccctaatttctgggacagcagaattttgcaagtattacactcagtttcagcctggggagagctcaaacaagacaaggattacagaaaaaaaaccacctcggcattcctggaggcaaggagtgagtggcaaaaagaacagcaagcaggacaggggagggatctctggaacagaagctgaaaaaaaccatgctctgttcccagatcggcagctcgctcccaacgagagcagtaaatggcatccagcctctttgttcaaactggaaggaaaggcagtttatgcctacattgttcttcctgcctcagaaatatgaaaataaataagtaaacaacataaaatcaattaaacttcctggataatcaggcttgcatatttttacacataaatttctcattggactcaaacatctggaattgccttcagatccaatgttggtttcatcctcctttactagggagggacagctggttgagctatcctgcaatcccagacatttgtaactttggtttttcctgatttttatcctcacttgtacagatatttcttgggaggtacctaaggaagattttcatctccacccagcttccttcccttcttccatgccaggagttggcatgttcacaaaccacagattgtaaactggtatccactcatggagctgcagggagaaagggttgaccagagagccactcagtgcctggcatatccgtagtcctggagaacagagggtcatccttcctcagcgagtgggcttccaagaaatgcatttacaaaaattgttaagctattttgcatcatgctcagatttgccatgatcaaaactaacccttcagtctaaatcgcctgtcaggtggaaattaacaaccagctggagtctcatgcttttcaacattttagtagcagcatctccccatccattctgccttactgctgggctcctaaaaaaataagagtgaggctgggcatggtgactcacatctgtaatcccagctttttgggagtccgaggtgagggaatcatctgaggccaggagtttgagaccagcctgagcaacatagcaaggcctcctcaccccgatctctgaaagagaaaaaaatgttttaaaactttgggcatagtggcatgtgcctgtagtttcagcttctcaggagctgaggtgggaggatcacatgagcccaggaattcaaggctgcagtgagccatgacggtgccactgcaccacagcctgggtgacggggaaagaccctgactcaaaaacaaaaacacaaaaaaaagtatgagtgatttgatggctgtaatccttcatccttcaatgtgtttgtttgcttttttctctttcaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaaaaaaaaataattaatacttccttaataccatcagataccccatcatagttcacattctccccactgtctcataagtctttttagagttgatttgttcaaatcaggatctaaacaagttccacacactgcatttggctctcctgtccctatgtctcttttaagctataaattgtcatgtatttattgaagaactcagggttttggtcctattacattttttgcaatctggaattttctggttgcattttcttagtggtatagtcctctcttcctctcattttttgtaagctagaagttagatctagaagcttgctttaactcaggttttgaggggtttgttttgatttgggggtttgggggcacatgcaggcttcacaggggaatttagtattattttttatgttaaggttggcagcaggtgcacgtgttatcagcctgatcatctatcacctgatggttttagcaatacctaaatccgtgatatcatcagaggttgcaaaatgatgagattcaggttttttttttacataattattggtcagaattattctgcaaatagcttctctttaacagtattcggttaccttgaaatacaggttgtacaaaaaataggataaatgcttgtttttttatttagcaatgtccaaaataatgaattgatttcccagtatcctctaaaggtaaccagggattttttttatttaattatcttgaacccacatatttaaatatacgtagtatgctacaaaccattgcagttaatacctttattgatgcttgagttgcccactttttctttttttttttttttttttttttttgagacagagtctcactctgtcacccaggctggagtacagtagcgtcatcttgactcactgcaacctcctcctcctgggtgcaagcgattctcctgcctcagcctccgagtagctgggattacaggcatgtgcaagttccccacttttagtgagaaactcctcaatttgcctcctgagttgttttgaaatgaccccagaactctttgatggtgtattagctatctattgctgtgtaacaaatgacctcaaagcttagctgcttaaaaagaaaaaaacattttattgctcactattctgtggatcaagaattcaggcatcatccatgaggatgcttccctttgctccacatggtactggcagaccccattcatacttgcacactgtcacttctgccacaatctattggtgaaagcaagtcacagggacagattcagaaggagggagaatagaccctacctcttgatgcgatgggtggcaaagtcacatttcaaaggagaatgttgcttgggaagaaacattgctgctcccatctttagaagcaatctaccatagttcaccctctggccacagtagttcacatctttcccaaatgcaaaggacactcctctccccacagaagtctcactctctgcagcattggaacaaagtccaggacctccttatctaaatcaggttcagatcagataaagcttcttcgggctgggcacagtggctcacacctgaaatcccagcactttaggaggccgaggcaggtggatcgcttgagtccaggagttcaagaccagcctgggtaacatggcaaaacctcatctctacaaaaaaaaaaaaaaatctttttaattagctgggcaaggtggcacacacctgtagtcccagctactcaggaggctgaggtggaaggatgagcctgggaggcagaggtcgcagtgagccaagaatgcaccactgcactccagcctggacaacagagaccctgcc

SEQ ID NO: 753 - DNA, 51810 bp, Human; identical to SEQ ID NO: 752

SEQ ID NO: 754 - DNA, 7066 bp, Human
gcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaaggatgaact

SEQ ID NO: 755 - DNA, 7066 bp, Human; identical to SEQ ID NO: 754

SEQ ID NO: 756 - DNA, 7066 bp, Human; identical to SEQ ID NO: 754

SEQ ID NO: 757 - DNA, 7104 bp, Human
cgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaaggatgaactggaccgtgggctggctgaccagtgcgca

SEQ ID NO: 758 - DNA, 7104 bp, Human; identical to SEQ ID NO: 757

SEQ ID NO: 759 - DNA, 7104 bp, Human; identical to SEQ ID NO: 757

SEQ ID NO: 760 - DNA, 33827 bp, Human
aaggtggagaaggtatagtcacagtctacctgacagcagttgctttccagagcctgatctagctcattcaggaaactgccagtagcacataacccatgatgagaagccatgattttttccctctcaggtctatgtggaatagtgaagccaatgagggttatgttgatcatctccaggcaagccttgtgtgtttctgtaactgcttgtgaatgattttagcacagttgtctcagtcatcatctaagaccatctcaccattatgatacacagaagggcagaaaccagagaaattgcactcttggaacataaaaccttcaagtttgattgtataaaggactttgagccctgaggatcactagagggacaccaagtagctggtactgcccagcattctcaactatatttcactatgacataattctcacaaatcgcaaaaggcaatcctgcagctctgtgctggctgggaacacatgtctcctctgcaaacagtcaagataatgctcaggaacggtttctatcagagcagcttgtgcctctcccctcctggagtggacagtttatttttatctggcaggctggggaacagtggtgagtaccacacccctgagagtgggagttcctacaacgatcagccattgtgccttcagagaagaaggcagcaggggccacttcaagcttccctgcttcctaagcttaggttgtcagaagcctttttagagatacatttttagaaaaagaaaaatagtgtggtaacagtttactacttgcttcttttttttttgtttgtttagagtattttatagtaatattactatagctttatgtctagcttaccaaataaggggtgaagtgtgccccagagaacgctgttactgtagaaacgtgtcttagccccaatttccactcattggtaagttctttttcctttctctcttttgcaaggtttcaaataaaattgcctttctagagcacttccccaatccatattcagtttataatctaaaatgtattttacaaagaagtaaatggattgttcgggctccagagatgtcttttttcatgcacaggattttttacttttaacaggatacaatgagtgatcaagcactcgaggctctgtcggcttcactgggcacccggcaagcagaacctgagctcgacctccgctcaattaaggaagtcgatgaggtactgaccttagagttgatttacaaagcttgttagtctgcacattacaaaaccgaatgcactctgcatgtttagaattctcgcacaacttttattggagagtaaaagtgagcattcttcattgtgccttatttattgctgagtggttagcaactaagggggatagttacatgactgacttgtgaaacagctagaattttaacatttgaaatgaacacgaatctcccttgctagagcttaaatgacccttgactaaacaaggtaacaaggaggcaatgcctggtgggaaatagtgaagtttggcaattggaaatttgtattttcagaagggttctgggtgcttctgtttataagagaaggagatgtctatacacggagtgggaagatccttcatttatcactatggggaaagatgttgaaaattttgtctcaaattaaaatcaagcaacaattaccctaactagagctcctgcatatttatagaataatgctgatgagtgtttatcccgccacactccaagatcttaacaagccttctgaaccaaaacaagcttacatctggtgtaggaaagttttaatattaaattataatttttgtggaatttttcaactcagtcctctggggtgaaagaggaaggaaaggagagagttgccggttcctgacaaggcagtgttgtggggagatggaaaggtagcctgggatccccaggagcccgccccacctccatcagctcaggctgggggtgctggcaggcattgctgtcacaatgccccatctctgctgtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagtaatgtattgggaagaagggaaacttgattacaacacaatgtgagatatacattacttagagtagccgacagaagcagtgtcatcttgaggaaagcggggtgttggcagaatcctggggggagtcaggaggccaagctgagttgtggctttaccacctgagggcgacagggccacaagtatattgcacttctgccccaagcttcttacagacacttaaggagagacaattaatgtgggaagggagggtataaacatgtcataaacctcaggatcaaaggagtcttaaaagtgactaaaagcagataagcagatgttaagaaaaaaagtgacataaaataagttatttaaacatgtgggtaactagtttgggaatgcatatgaatgtattaagttccctctagaaaacttcagagtcgcagcaaactaaaattccagcaaaaagaactcctcttttccactcttatgacataatagttgtattagtctgttctcatgctgctaataaagacataccagagactgggtaatgtataaaggaaagaagtttaattgactcacagttcctcatggctagggaggcctcataattacggtggaaagtgaatgaggagcaaagtcacgtcttacatggaggaaagtaaaagagcatgtgcaggggaactcccctttataaaaccatcagatctagtgagaattattcactatcatgagaacagtacaggagagctccgcccccatgattcaattacctcccactgggtccctcccacgacacgtgggaattatgggagctacaattcaagatgagatttgggtggggacacagccaaagcatatcactagttttcctttttaatcatatacaaagtatgaatgtttctaaagaggatctttcagtcctctagattattaacctgaattcttagtacccgacttagtgggtcctttacatcctagatagtctgatgtgatgagaaggctcaggaaggtcactgtcagcctgtaggagtgtccattgccaccccagcataccccagaatagagagctatctgtggaaaaccacacaatactccagagaggaaacccatgcctacttggtattcccatcatctaccataacataaaataaaagttttttattctctaatgatagcccattataagtctcccacatttttaggtgtggctgcctagtctagtgccatttcaattcagtaggctcttttttttcgatgcctactgtatacaaaccagagcaggcatttcaagactataaagatcaaagaggaaaataaaagctctggccgcatgtgtaactttcactgtccacagcctgagattagtggggaggaccgtcttaatacaggtgaccctggatgttcatgaaggccgctgtgccttgacctggggagtgctgctccatgacaggatttctccagatgccgaaatagagcgtgactggaaatgtttaaaagaaaaccatgacttcatcctttaatgagagcttctctataaaacagtgaaactaatcccaaagcatagaacagtgcctggtccattaaaagtgctcaataagtagtaattaatcaactaaccaatcagtgggtttagttacatttaatgtttaaatgttttcatttgttttgttttttatatttcctgtaaaacatgaccagctgactttctctattattgtgcgtatcctgtttaaatgttactaattacaattgtttaagaaccacactcttaggctaagatgcagatgggggccgtgggttgggttggaatatgccaagtgaacctcctaccttggttagtaaattaaatccacacctttatataggtacaaattcttacatattatggaacttcacactacccaccagcaggttaaattgcaagtgttgtgtcctagcagtcagtgatctactatagaactatgcttttatttgtaatgcagctagttgttcatggttcagtaagctagagaagtcctggcattattgaagagagtccttttaaaagaggtaaaacaagttatccatggatcagccaagatttgtgatgggccgcttctcccatatctgaactgggtttaatgtgaaaattagtcgtgtttcctctcccttccttagacagctgcctcgttgagtaagacagatgaaggccattaaaataattgcaactaactgctgcactgtgcttactgtcttcaaaggatcttttatttacttttctctggtgatcttcacaagtcagtgagctagataagggttattagtagccacattttacagctgaagaaactggaccaaataaaggctaagtggcttcccaaggtcacagcagctgggagcagaacagggcagttgcccaggatccctggctgggctacttttgctcagtcacccactgctccctttctcacagctgcccaccatcgtcttgtgctttgtagtttacaaggctcttccagatgcttttaccagatttggtcttctctataacactcgagaagtacacagaggaagtgatatcatctcattatgtgcattatccaactactttttttttcccctccattttcatcaggcaaaagctaaagaagaaaaactagagaagtgtggtgaggatgatgaaacaatcccatctgagtacagattaaaaccagccacggtaaatttttagccacagtgcatgacaacagcatcttgcctttgcatcttgttttgttgtatctgtacccttgacattgtcaaaggacatgtctgtcccccattcagatattaactctgaaaaccctgaacctttttttctctgctccctacagttagaccccttgagggatggtttgtccctgcctggcttcctaagtagtgaccatgtgttcatttaaattcccacagatttaaatgtttcgtttattaacagttcttacaatagatcctaaaactcagaaggaacaatttggggataatttcttttctaactgctatatggataaaagcaccataggtcttctgaggggtagatatgaatgtacgagggtttaccagtatcctaagtgaaggtggttttgttgctgttgtttttgattatggtgaggatggtagactaactcctgtcattacatttgtcatttacttttgaaatcatgcatataaacacatgttggaaaatagttacaattctaagttatgaaacctcatatccaaaaaaactaaaccgtgttataggaatgatatccacctcttcactctaggttggagaattggggttttttaaaagcttcgattaacatagctacatctttattgccaaagaacttttttttcctattactctacccaacagattaaaaacatttttaataacttaaagtaaatgtgcattctgcttggtaacatctcgatttttatagctcaactcctttttttatactttataaaaagtaaatctgaaacacaaactcatgtaaatctaagaaaaaaattagctgacatttcatatcctggaattcccagaaacaaacttgatgggacatgaaagcaaaattttctatttcatttccaatgaattttaatttcatttacaggataaagatggaaaaccactattgccagagcctgaagaaaaacccaaggttaggaaatacatttttttctgatacttaaagaacaatagacatgtaaagtatgaattaagataattttgacagtctggaattcactgtgcagacttgcatgctaacctagtacagaggaaaggggaacttctgatggtaacacttggctgatacctgtagctcctttccatatattttaaagatgatcttcctcataaatcattactagactataaatttctaggtaaaatttattgcacactagaaactgatgtcaagagggcccttaagtcagattaagctagcacttagagttccatcctgatcaaattctctaatgattctattttgccttaagttggtagtaacctgtcacatacaatcagcaacatttattaatcgcttgctatgcacctggcactgcaccaaatgctttttggatattatctttgtgagtcctcaatgaatgaggacggtactgttattattcccattttacagtgaggaaattgagacacagagggcctatgtaaatagcccaaggtcaaggggctataaaatagcaagccaagcccaggacttagaactcaggctgtctggtctgagtcccagcgtctgaatcacatgcccttctatcatgttactgttgttagtgacaatctccacatgccctaaactaataccactctcctgaaagaacaaggggtagcagaactttgctgccaaaatcctgcataatcatagaaacggagtatatcatccgtgttttgacttattcagaagagaagtcatgaggaaataggaaaataataatcacatttaaaaaaattatacagatcttcattgtagagaacaggcaattttatttgaacaaaattcttctgaaactgaaacatcaagggaatgtttgaccaaataaaccattaatactttggtcctgaggtgtttagtatttcttaattgtttcatgaaaattttatcttaacgttgataaatgaaaaaatatgccctttataaattagctttgggtgttaagtatggcctcatatgtgttaatcaggaaaaaaattgctccatgaaaactttttttttacaaaataaaaaagagtccccttgtaatatacagcacttcttatattacagcctcggagtgaatcagaactcattgatgaactttcagaagattttgaccggtctgaatgtaaagagaaaccatctaagccaactgaaaagacagaagtatgtttctaaacatataaatctctagttttgaggtttgtgatcttaaaaaaaaattgtgagacagactgttttagcatcaagcagtctgttagaaagcccaatatgccatcgttttttccatgtcatttttgtcttcctttttggatgtgctttctgccccaacctaaccctgatattcttgcaattgaagtcctgcaatgactccttcggaaagctctggaacccatgccttccttcttatcccagcttctgtaactgacctgattggaactgtcaccacccctcccctctgggttgcagtggcctttctgcagtctccttcatgtccgccggactcattctttctcaagcatgtctgtagttatgtcattcctctgcttctatccccaggagtttcccatccctacaaaaaaaagttcctattaccatattcttgacccagttttctttcctaccaaactgtgtccctgtgtcagtaaacagaacaataagtatgtgtgcatccctggcttttctcacttggttcctctgtcttgattgacctttctttctaatgctagatcaactaaagtcttactcatcttttcaaggctctgctgaaatatggctttatctgctgcttttccctccctaagctatatccatccaacctttattaagcagaacacaacatggcagaggatctgtagttctttttttatatatcactattaaagcctttgttacaaagaagagtttagctgttttagtccctctttaactctaacatttatgccaagtttaaatgggtagtaagttccttgaacgaagagatcatatcctattaatgaccatctgctgagcaccttgcatataggataggcttccataaaagtctagatttaaaacaatttgtttaaaggtttgcttctgttctttttgtttgtttgttttgttttgttttttcttgagatagggtctcactctctctcccagctgggagtgtagtggcacagtcttggctcactccagcctcaatcttccaggcccaagcaattctctcgcctcagcctcctgagtagctgagactacaggtgcatgccaccatgcctggctaatttttgtattttctgcagagctggggtttggccatgttgcccaggctgattcaaactcctggactccagtgatccaccctccttggcctcccaaagtgctgggatcacaggcatgagccaccacacccagccttgaaactttattcttgtgataaaataagatgggacagtggttctcaaactttagcatgcatcaggatcatctggagagtttttttttaaacacaggctgctagactctacccccaaagtttcttagtacatggggcaggggtctaagaatccgcatttctaggttcccttatggtgctgaggctgttagttcagggattacacttccaaaacttgtggcttattactactaccttccattcctacatagctgtatataaagtgctcttaggtttatataaatacaatattttacataatgctatattacataataggcatatttgttatacataatgacaaataaataatagaaataatagcaataattgctcaaatgtattgagctaactgtgttcccaggtactatgcatagcactttgcctgcattgtcttatataggcctcttaccaacccttcagatgtggatactgtcattgttctcattttacacatgtggaaactcagtttcacgagtttcagtaacctgcctaaggtgagaagtaaaaccaagttgaaaaaaatggcagctgaagagttttagcatgctttgacttatttactatttagcaatccttaggtattcaagagaatcatgttcacaccatataatgtagcggagtgtcttgttggtctaccattactcagtcttattaaccaaatatttctaaacttattgagagtacttgtgtctttcctcaggaatctaaggccgctgctccagctcctgtgtcggaggctgtgtgtcggacctccatgtgtagtatacagtcagcaccccctgagccggctaccttggtgagtgactccctgggcatttgagcagtggcttgagaaagttttctgcctcctcctgtcactctctgctgtgtattaccatcattttatcttatcctgacaaattaaaaataaaatctgatatcattatagtatctgttgtttctttgggcttcaggggtgtcgtagaaattcagactaagatttaaatttttaattaaattactcccaactgtatttttctctactcttctgaaattctagttcctcagctattgtggataatcctgccttttcacttctctgcatcttttaagcctatatagatttccaccgaaagcccaaagttacttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatcttccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccctgctctcagctgtcttcaagactagtgtggatatgagccctccccagttttttggggtttcagggtactcttcaggtactttttacagcatgtgtgctaggccacagtggtaaagaaccggagaggaggagggactctaggaggactctggtgaagaaagcaggcaaagaggctgtgattggagtcaaaacaacaatagccagcattccccagtagaactcttgtaaccaaaacctgcacctgcaccacctgcctcatctgccaagtgtgactgcccgggctttagagggctcaattccttttcaactttaccctgactgtagagctgagcattggattgttagaaagcagacaaaccagaacaaaacaaaaagctcttgttttccctttccccgtcctcctttccagggccttaaccccaccaactctggccatggttgcccaggttactgtcactgaggcagttggcatttctgggattgtgacaccctcgaacgccagaaagaatagctgtagagtgtaataaaggtcagaggactcaagaaaggcatgaagattagagagtaaaggaagacagaccagaggaaggagatgaatgcgttccctaggtggttcttgtgtgtataaaagaaaatttattaaggaaacccagagacctgagttgtagttgtgaatttgataatatcaaatactacagaaatagaagttttagtccttactcctgtttccagattcctttgttcttaagtctgcttcttctcctaggttttctttaactgtttcagtaatttcttaagcaagaggttggcaaagggcacaggtttggggaagcagtggtttccaaagattctgtagcatagagtatgagaaaacagaattgtagtgtgagcaggtgtcttaaatcatgtagcaactcacattgcttgcataagacttgggtaccagtgcaactcttgatatccttgattagagtgttgcaactcttaatacttaatacttaatttaggtataatcccaaacaggttagaaacctcagggatttttttttttttttttttttttttttttggtagctcttgggaataaaacccatgcagtattcagccactaggtggtgctaaatcacttttctttggtgatctttccttttgcagtgcagtttatcagaaaaacagcttttcttacttgaaatcatggctaaaatataaaacagaaatacagttttactctaaaattttaataggtgctcattgtgaggtcagagattttaataataagattaaactctgagattgtttgacccaaggccttttacatttttgtttgaccaagaccaacagtgggaaattcattgatattgcaaccccatccccatacactggaagcaacagtttaaagaatagtatttatcccttctatgtatgatgcattttatacacacacacacacacacacacacacacactcttacatttttttttttttgaggcagagtctcgttctgtcatccaggttggactgcaatggcatgatctcggctcactgcaacctcaacctcctgaggtcaagcaatcctcccacctcagcctcttgaggagatgggactacaggcatgcaccatcatgcctggctaatttttaaaaactttttgtaaagatgggatctcactgtgttgccccggctggtctcaaactcctgagctcaaacaatcttcctgccttggcctcccaaaatgctgtgatggattacaggtgtgagccactgtgcctggtcctgttctcttcattaaaaaagaaaagtcctggccatgaaccattaagttgattcttatgacctactaatgtacagacgattccctttattttcccttgacaccattcatcctctgtgttcaccagtgtgattttaaataccagcatggccagagttcattacatttgggggagtacatttcattttgaacaatcggaccacaggtagacagttctcactgtgccattcaggttagttggtcacaggcagagtcatcagaaccagccctgaaactcctttggtcagtagaagccctgtggagaaaacaggcttccgagcctcctcttctgagacaagccaggctgtcccacaggaaatggagaggaatggcctcttgtgggctctctgaaaatctttcctgtgccgtctatggaatgatctccataaagaccacgtctttcttttttcctggtatgcaacttatctgtgatacacctcagtccattgtctttcttatttctaaaccaactctgggtcaggtctcgtaagtttcacattatcaacatataatttgcacacaatgtttaatataagaaatttgctcgaatgttaaacgttttgttttttaaacatagattctaattcagttgataactcgagttattaaaagatagcatgtgccttttatctgaaataatgatatgcctttctgaattgatagcatatgttttaaagggagtgattaaccacctacttaatatatccactaatgcactttcagaagggcacagtgccagatgatgctgtagaagccttggctgatagcctggggaaaaaggaagcagatccagaagatggaaaacctgtgatggataaagtcaaggtaatggcaactgagatgcttctggaaaataaatatcattgatcaccttctccccctgcaaataagttagtcatttgttttgttttttatatttcctgtaaaacatgaccagctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttgtttacctcaaatctagtcactcaggcatgaattttatggagagaaaaaaacatgctaacaatgaaaatggtataatttttctcaggagaaggccaaagaagaagaccgtgaaaagcttggtgaaaaagaagaaacaattcctcctgattatagattagaagaggtcaaggtaaacaggctggagtctttttctattttattttaattcatactgaattcatacacagaacaaaggtacttgggaacagaactggaatataaagatcttgtttcttcatatttcaaacaccaaatagtattagtctactactaatagtgttagaacaccagatacaaagctaaaatattcctaagtagacttgatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcgaggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagagaacctatttaacattgagtatagtgttaagttgccccatttcttctattttgaaagtacagattgtacacaacaagggggaagaccccattatgagtcctgtggtttaagtgcagtcacttaaatgaggcggattcgtggacagttgaacaatgtcagtcatctttgtagcaggccaggatttgaaagagtattcaactaaacttcattaacaattctagaaaatcaaattcatgcttctcactcatccatgtgcactagcccatttatttagcagacacgggaactagactgaactatccgtgattgaaagtttattattctggaaacctttatatttgcttcctgagttttacaattcagttgcagccatagcgtttctattaatttgggctcatttgtacattgctttgcaaagttcctagagagcatgctaagggccacatgttctgtctccactgagtgcccattcagtagaggctggtcaagtgcaggtaaactctcttcatgataggtgattggttggtgatttgctctctccctttactgaatttagtagtagtgtttaaggaagcagttgattcacagtccctgatcactttattctgtagtcatttcatcctcctctgacttacctcacacgttattagttacctattaataacattttcaggcactagcttcatctcatttaaatcctatgttggtattcaccagctatgttcccatcaggtctcctcagtgagatttggctccccgagggcaggccacaacctccccttccagacgcagaatgacgcagtgatggaaaatcgatttcagtttgagtagggagcaaaagtgctcccagagtcccaggcatcacttaggaaattttctgcctttacagctaagagatggtggagaacaagcccaggttcagctttcccctgtacctgaagaatggtcagaaggcaaaagtcagtcatgagggaaacaggtgatccaagttgaatatccctcatctgacatgcctggggaccagaactgtttcagatttcagacttttctggattttggaatatttgcctcgtatctgttgagcagccctagtctgaaaatccaaaatgcccccgtgagcatttcctttgagttgtcaggtcagcactcaaaaagtttcaaattttggagcatttaaattgttttcagattttcagattagggatactcaacttgtacctctaaaccattgcacttcacattttcaatgaaacaaaaaccaaccttaaccagtttctcaggtgaaatattcatatatatgtatatctttgtatttacttatttttgtgtaggtggataaatgggatttactattagtatatagatctccttttactaaagagccccgcatgctttcttcattttgtcgtgttactcaaatgtggcacttggagtcataaacagcttgacctaatctgaaccataagttgcagagcgtttcactgacaggttaaactccctgagggcaaggcctttgtgcgattttctgttgtattgccaatgcttacttaggtcagggcttggcatgtagtccttgcatatgagttagatgtgtggcttacaaggttaaccagcattttccagacaacctctacaaagcccacccccatgtaggtaaagggcttatcccacactgtcctgcaaaccccagtcacagcaccacataccacactatgctgactttcacgttttcctgctgtgatagtctctaggcttctgaggtcacaagccatacctcatccagtgtgcagcccccgtgactcaggaatgcctggtgcttgtgagctgtttgttgccatgaactaattagagcgtattctctggtgagagaatccttcgtgacatgatggatctaatttaaaatgtacaacagcaagtataacctgtagaccctttgtaatgtttacaaggtttcatactttggataaaatgtaaaatgatttcatgccatgtgttttcccccccggataggataaagatggaaagccactcctgccaaaagagtctaaggaacagcttccagtaagcaaaccagttttctctgaggatatcttttccttttggccctgattgcaatggtgtttgttgatacatttcctggttcttgcagcccatgagtgaagacttccttctggatgctttgtctgaggacttctctggtccacaaaatgcttcatctcttgtaagtccaaaactcttggttttatttctttagttttttttttttttttcctttgagatggagtcttgctctgtcatccaggcgggagtacagtggtgccatcttcagtcaccgcaacctccaccttccagattcaagcgattctcctgccccagcctcctgagtagctgggactacaggggtgcaccaccacacccagctaatttttgtatttttagtagagacgggctttcaccatgctggccaggctggtgtcagtctcctaacctcatgatccgcccacctcggcctctgaaagtgcttggattacaggcatgagccaccgcgcctggcctatttctttagttttagagtggcagaaataaatggaaactggtgacttagaatctgacttgggaactcaggaacaatcataaaattaatggccctcaacccactgtagccattaaaaatgtgttgcaccatgaaatactgtcccaacatagtggatgcttttattagtgtaactaatatcaagtaccagtacccctatgaaaagagaatttaaatgtaagcttatccaaaattactcctcagacaactttacctattgatatttctacaatttatcatttcccaaattgcctcctaagggaacttagctccatgtggaatatagagtccctcaaagggaactctgttactcgaaaagtttggacaatattgggtaatgttaagcaggtttctctactgtaggattttcatggctttttatatgcaaatatatagtgagtctgttagagttcccaaacttaataactgcagaaccttttcttgtggggtctggtttatctgtttactgggaactcagtttttaaaccactgaatgtattattagcagtcagttggaaagggattaacagtttctatgacagtggcatggaaaatatatttatatcagttggagaatagacagaatgacaactagaagaaataatgattctttggaattgcctgaagttgttacttttgctgaatgaagcaataaagcccctcaaagaagagcttactaaccagagcatgttattctctgtacccctgtaaaagcaccgtgctgctcagtcacctcatcccgtgaccttcctctcatcgtcttccatacagaccacatcacagcaaagcactccagccttgatttagaaaccataagacatggggaagaatacaatgtgaggagtacgccaggaatgtggagtcatagcattacactgaggcagaacagatgaacaaatagtggggaacaagatctcaattcccttcctcctcctatcattattattattacaattgttaggggtgttttttcttttagaaattcaaagatttggaaaaagtaacaatggatttatatgcccccttcaaagatatgtagcagtgaaatggtgagatgaaacaacctttaaaaaaaatcttactcttagaaaattagcaaaggaaacattagtgccaacaatatagttaataaagtagaaataactaatcatcatgagaaccaaataatcaaaatagttatttagtggaaagtttcaagaaatttgggggagaagtatcacatatggctcataattagtgttcatctgtaaaagagtagctcctgtacgtaccatgctctttgatataatagaacagaaatgctatataaaaagaaacacttaaaactattcccctaataatactgagatcacattgataatagactattttaaaacatcaaagatattacaagaaaaagtctttgagaagcagtcaaagcagtattcctgtgatacattgtcataaacacctttatcaatagtagagaaagagaaaaagagaaacctgataaactaaatgcttattgaattttaaactgaaatttctaaaagttttaataaggtagccaccaaaaacaaagtagcaataagcataccaggaaatgaaaatagcggcatgaaagttaactggccaatagttgtttcttttgaaataacaaatactttataaaatactagcaaatataaaagaggaaaaaaaaccttacaaaaaatacaattaaattttaacagagtaatataataatatagagatcaactaaattattggtagtttaaagccaatagtcagttggcttttatgaatttttaacattttacaaaactgataaatagagaaaataatcttactaataaaatttaacataaatgtgagaaaatacaataatcagtacagagcacaaataaattattaggaaacactatgtacaacaattttctaagattaaacaaaaatattaaactgcgtaattcacaaaacctaaaaaaagactgaagaaaatattgcaatgattttcaaactgtccttctactgaaggtttaaagatgactctaactgttgaacactcagttcttatgtggcataaatatgtcatgaaaaagatggggtcacatagttgcttctatgagtaattatggtgctaatcttaaaatctgacaaatataacggtatcagctaaagttacttaaatgtgtagatgtaaaaattacatacagcatacatagaatataacaaacagttaaattatttgccattataagtattgattcagtagcaggaaaactgtcaatatattgtagtggtatatcaaatagaaacaaataatcatgtccatgtaaaagatctatttaaaattttacatatactcatattataaataaaaactttttaaaaagtaggcaatcccctaatctgttaaagagtctttagttttcagaatcaaatattcaatatcatgctggaggcattttccttaaaagcagaaactatgaaaagtttattgtcatttctgcttattatcacatggaagaatcattaacaacacatgaaaaaaatgacaaacattaaaagggaacatttgaatatatttgtggatagcactacttgtagataatacatttgtaagtaacattatgccatgtttattagtaacaacagatgagaaaatgtaattaatatgagatcagacttaatgtaaactataaaaggagaaatgatcagaaaaataaggacacaaaaaaattgaaggccatacattaagtcagtttaactaaatatcttaaaaagaatgatgacaattcaagtcattttatgtgttaattttttattaaatagcaataagatacttttataactcaataaaattattcaatgatacattcggaaaataaatgtataaaatatgaaaaagtactaaaaagcatttttcagtacttttaggtaagattaatccaactaaacactagcatatgttatacagtaataataagtggaaaatacaataatgttgagaaagcaaactcaaagcatagatcaatgaaaaaattgagaaatggacataaatgatttagtatttttaaagagagtgaaaaatcattattttatgcttttgtgtagcattagatgaattaaataacatatgcacatatagctttgcgatacaaatttccagaccataggttgtttcatacttagtattaaaaggcttaaataataagtcaataagatagtttaagaagagacaatacaaatgtttcaatgtcattcttttcatttgacaacttgttattcttttcatttgtcatataagcaaagatttctcataactaaaaatgaatttaatttagtacattttggattacctaaaatattacattctaaaacggctttacagggtataaatggacaataagtatcttatagttatctaaattagtttaaataatttccaataataacatgctgaaatgaatttctgaatgttggtatctttttaatgtgcttttctccatcttttggtaaaatttgcaattctcctttttcaaaataagctatccatagttggagtcaccaaagagttctggacttttttctggtttttcatcaacagttatacctaagtttttttgtcaaaagggagtatttgaaatgaagcaaatattcaatatttttaaacagaaattatttcagaaagtttctagaatatttaacgttgaaaaaaaaccctgaaacctgacaccgtataccacaatatacaagcaatagtagtatatcattttacactgattatcataataaaagtcaaattctggcaagcaaggccatgggaaaacaggcatgcttattcattgcttttcgcagtatgaattcctagcaacatttgagagggcagtttagcaaaatatagccagcaccataactcactcactagaacttattcagagcaattttaaaagagctgaaaactttgaataacctaaatgtacaacaggaaatgtgtaaacaaaccgtggaactctaagttatattattgcatagtatttagaataatcaatatgagaaggaaatagaaatagcaaattgtataaaataatacaatagagaagaaagaatttaaatttcttttaaaattatatgttattatgagtctatttggtcaagagaataaacagtcattaagctatctttaagagttatagttaagtgatggcattgtgctcataattttatatacaacatgttactaataaaatttttttcaataaaagaaatttgaagatgctaaacttgctgctgccatctctgaagtggtttcccaaaccccagcttcaacgacccaagctggagccccaccccgtgatacctcggtaagcagcacatcttatttgggagataaatgtttttgcgcagccacaactagaaagaaaatagggcgcctgtttaaagcaaatgaaaataggcagaattattaggaagatcaggcaccttctatttcagaagagccgagactgatgatttagcgagatggcagagattaactttgaaatgattaaatgaaactatatatgtgaaaacattgtacacatagtcaaggaccttaatattattgttgctttataagaattgaaagtgcaataaagtgcattgtgtctatattcaaattactagatttgaaaagttctttagctttcctgataattgattttctcctttatattttttcttatacattctataatttactacccattatttaacctcaagtttattttatggaatcgtcatgtttgagcttttacaaacattttacaaacgtcatggaatagcattgttttcttcccaattcacaccagtaaaaatttgtcactttcatactagcagtagaagaacctcagcatcaatattgttttaattatttacatgctgtgaggcaaggctgtgggaccaaagcttttccagacttccttgactaatcacctgtgcaataccaaattatacattaccaaggagaccacagcacatcaaattataaagggattgccctaaaccagatccccatctcctttggttgagaacagtgcctcatttgctagatggagatgaagtaactttagcgaagtcagctatgcttccattccgtttgatgtagcatcaaagcatatttagtgctgtagtctgagattctgatggattttcatcctgttgcgtcagcttcaggatcatctgaaaatatccagaggcacaaatgacaaagcccagacctggccccgggcagctctaccattagcagctataatcctggattataataaagcacttaaaaccagtaaaatgccccgtgtgtgtgtatgtgcatgtgcatgtgcatgtgtgtatgtaaacacacccacaatgaagaaagtccccatgcaacagaaaggaagaatcattaatagcctaggctgccgtttacacttcagttcttaatattcaggccagagattctgccctgatgaaggctatcagtaaacatttgcaatcaaaaacttttttgcctttaagaagtaggttttacaatgacacttctctgatcacatttcccatcagagaggcttgtttttagttaacattttatttgaagatgtcactaaaacaaggtataaagctttatttagataaaaatattaggaaatcgaagagtcaaataaaccatgataattcacgggagctttctttgctgtgattattagattgttactaacagtgttacatacactgaaagcatttgaagacatgatttcaaagatctgtgtaataaaatcactccaacaggaaaactgcttcaaagaaaatagaagatcatggatgtgactaagcatgacagggaaaagctttatcagtcccaagacctgggttctattcactttttaacaatttgttttcaagcaactgacttagcttccctgagctttttacctcaaaaaaaaaaagcctgcttagttcactgagaaccattgtgggcatcaaataaaactggatagtgtatgtgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatcatttacttttctcagcaacttaggagtataagtactactattattcacatttcacggccaaggaaactgaagctgaaaggggttaaataagctgcctgaatcatacagtaaataaatgttagaggaaataagctatcttagttacagtgatattgttgtccataatttttttcctctagaataccagctcccatttctgcaatttcacttccatgagcttcctgaagatgaaaagagaggtttccccaccagttcagaaattctctgaagtctttcagggcactcatcaccagtgtggcagacaagccccttccactctcctgaccccagattgtctctggggttttgtgctttaggaagtattaggatggcagtgccgagctccatggcttcccacaaactgcgggtcacgctgcactttctgaaatgcacccctcaagatcttagagttttagagaggacccacagaaccaaagaaacacttaccctctatagttgcagaatcttgcttcctaaccatctgacaacattagtagatgtttgttttcatatccagttttctaatggtgtttaatttctaaatgaaaggcacacatgattggttcatttgcttttggaccctttatgtgacctccaggtcacccactggatatggctcctgaggctgccactaagacctccttaacctggtgggatcttcaccaagagatgggcagggttgggtggaaggtgctggccctccaaccccagtagggtgacagatactgccgctcttctcctgatcttccattcctaggcttctcttctctgaccctgtctactcccctgccccagccccagatgtctttttcttccaaggaaacaggttccctcctgaaaagatggagttcctgggctaatttgcctctgatacagtttggctaatgagtgactaattcagcattatttacttttcagcagagtgacaaagacctcgatgatgccttggataaactctctgacagtctaggacaaaggcagcctgacccagatgagaacaaaccaatggaagataaagtaaaggtaaaaaaaaaaaaaaaaaaaaaaaattcactaatagtgaaattttaatccttgggtcttgactctgtcattgtcataggaatattgatgtgaacttaacctatattttaaacatgaaattataatgaaatagaaaaatcaatctgtactccactggaggggaaggtcactgaatctgtgacagagataccagcggagcctccctgaggggattctgggaggtaggtgtggggtatgcatggcttcctcccatgcaacacaagcagtcagcacatccattcaaattagctgttgtccttcagggttgcttataaataggcaaagttgtaaatgtgacctctctaaatggcaaggtacagtggcctgattttgtattagaaaagtgaaaccatacagaaaaaaagaaaaagatattttatacctttgggttctaatctcctaacatggtttctgaagataattatttaatcatttatttccatttaaaatatagctagaaaattcacagatatgaattgacatacagaagcatacgggattttatattttagccaactagcagtctgttgaagtcatctgtgttgttctgttgcttaaaaaataaaaacagaccatatgttttgcctcatgaaagtacaacaaatgctgaatgctgcatttgacaatgtattttctaagtgaaagaggaaatgaatattaattctatctgctcactgttgatataggaaaaagctaaagctgaacatagagacaagcttggagaaagagatgacactatcccacctgaatacagacatctcctggatgataatggacaggtaaactgaggcaaattgctagatcggatttatgctaccaagatctttaaattcaaacctcccttgaaataaatagtagctatactcctttacaatagcataaaacataccatgactgactgcttctaatgtgtcaccaaagccgaccagcaggtaaatatttatttgagccaatatcattatatatgcatatgctaggctctgtggtataaacagggttgaatactgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataaggcagctccaagacctggggtctccctatcttctcctgcatcatcatcagcactattgcaagtgaagacaggcaaagcaatattcccaatcacaaatcctgtttctctgccaaaaagtccctggccttttgtctcccacatgatagaggccagtctttcgtaggtcaaccaggcctgtcccccacctctttcctatttagtttctaatttttgagtcaattagatgataaataaccctttccatgcctgttcatcaaataagaaacaaggaagaccaaattacacccttctctttctgtactgattcattttggtgagtaagatgattcctggtttaaatagcagtgtcagcttcagggtctcctattacaggaaccaattctccttgcttgcattcagtattcctcaagatagcaattccacatcctgctagagcccttcccactttgatagtaccaactcaccctgcttgcgttctttgggaaatttattatttaaggcccttgcctttgaagctgggaaaaatccctgatgactttctaagtgtaataagctatagtaaataagatgtaaaaacacaagtaactttttataacactttaagtagaattataagtgataatacatgatggcagaaggttcacaaatagtgtttctttcacttccaggaccagaccctttcatatgtttcccccaagtctacacaaatgattataaagaatagtaattaagcaaagctggtaaagaaatagtggggactcaggtttattagttattgcaagtctacactccattttatccaagtcaagtcatgggacaatagattctctactgcctaaacctaagtaaacctttacagatatctatgcttaaccaatagtctgccttctttttaaggacaaaccagtgaagccacctacaaagaaatcagaggattcaaaggtaaagaccataggaacatatttccattaaattttgttttattctagccataggggtatttggcattttagaaaactaaaacatattgaatgcctactctgtgcctggtactttgtcaaagcatgcatataaatgtgtgtgactattgtttacctctcttttagtcttcacaaaagccctttagggtggaaaactgaggctcagagaatgctaagcaacgtgtattaaagagtagatggaaaaaaagccatcaagattttcttgtttttctatctcctttacaatacattattattaataaagaatgtcagtcagtttttttcttatagaaacatcttttatttgtaagtgatgtgggaaaagaccccatattgcattttgccttctgcttcttcactgatggttatttctactcatatctcagaaacctgcagatgaccaagaccccattgatgctctctcaggagatctggacagctgtccctccactacagaaacctcacagaacacagcaaaggtactgtgctttttcacatttcactctttgaaatgtgtgtgtgtgtatgtgtacatacatataagttttatttattgattgatctatctatcggtctgtcttgtaacagggtcttactctatagcccaggctggagtgcagtggtgtgatctcagcttactgcgatctctgcttcctgggctcaagcaatcctcctaccttagcttcctgagtagctgggactacaggcgtgcaccaccacacccagctaatttttgtatttttttgtagagagggggtttcgccatgttgccaggctggtctcgagctcttgggctcaagtgatctgccaacctctacctcccaaagtactgggattacaggcttgagccactgcgcctggcccttacaatttttaaactgtagaatgaatcaaacgatgatatagagaacctgaaaatgaagaaaagaaaaaatgcctataattccactgcccccaaaacagtattattttgtggatttccttttttttctatatgtatattttacataattatacttacagtccacttataaaacactgcttaacgttatttcttaactgctactttgtaatttccatagccaccattttttatctccacactatatggttgtgccacaataatgctatgtctgtgttcatttaaagtgagagcaggccctaactacatcaggcactctcatgctcatttgctctctggagcttcctccccttttctgtctgcttagcccaactggtctactcttcattcctcagggcacagctcaagcatcagctccttagggaagactttcttgtcttacatcttctcccttcccagtccaaagttagaggcctctcttccatgccctccttgctctctgttacctctctgtgcttgtgtatcacaccactgagctacgcatttcatacagtagtgatgtgtcttttacctctgtgctcctcattagcaaaatgcctggtacttagcaggtgctcaaaacgtgattaaaagtgaatgagaaacaactgtgtaattcaacaagtgtgaggcattttccctcaagctacaccctcttgtaaatcaaatagaaggaaacgtgaaatgagtacctccttgttattttcaggagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttcctcggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctattttgtatcctttgacctatatctctgtttcctcctcctgttccctaccatggtcgccatgttttattctctgtgtttttgagctttttcttttatatatattctacatataagtgaaatcacttttctttctgtgtctggcttatatcatctagtataaggtcttccaggtccatccatgttgtgacaaatagtaggatatcgttttttaaggctgaataatattccattatgtatatatacatgacattttctttatccattcatcaacaactaggttgttccatatcttggctattgtgagtaatgttgcagtgaatatgggagtgcagatatctttataaggtgataatttcatctcctttgggtatatacccagaagagggattactgggtcatacagtagttctacttttaatttctttaggaacctatatactgttttccatcatagcccataccaatctacatccccactgacagtgtactagggttcccttttctccacacccttgccgacatttattatctattgacaagctctgttttgattagcaaaataaggtctgggtgagtcaggcaccacgggaattagagcatcaatgtcacccacatttccctccttatttctatcctttttccctcctgctttaaacaattctctgacaccgttgttcaaaaaaaatcatgaaaaaacacccaaagtcttccattatttaattaaattggagatctcagaatggtctggattaatttaactgcagcctagttaattgctagatggattggtgatagccatagcctcattacatttcctttgctttaggataagtgcaagaaggctgcttccagctccaaagcacctaagaatggaggtaaagcgaaggattcagcaaaggtaaatggagcagtaaatatactacaaattagtttagcagttacacagagtagggtttatcatttcagtcatttagtttcctactggaatctatttagaataaaatttcttaaagtactatctatcccatagcatcgcttggtaaagtaattgaatttgtataaatacatatatttttaagtaactggtgctttaaaatcctaaatgaatgttcttgacacaacccaatttgcctgtgttttgcctgtctttcttgccctaattaaaataccaccatagtatgtggtttatatagattttagaacatggaagttggaaacttcctattattaaaattactcaagctgtgatgagaaatgaaaattggattagacaacttctaggtcccttccaattccaagaacatatgatttaaatgattattactatgatcccctggctataaggaggagttaaaggtgtagctttaaagacaatagtccagttacaccaaagcttttaaaacaatatattaaaatcttcctgtagtagattcccttaagggatataggaaacagcattgataattggcagttatgccattatatctcagtttaaatacttatttgcctattatttaatttcagttatacgaagtacttaatcagccctttaacaaataatagaaagcataataaccctttatgatgagtggatttactggacagccatgaccctatgtacaggaaaggaaggatcaccacagaatgaaacattgccatttaagaacacctatgcatattttataacctaccctagccttaaaaaaataaagctgagagtgatacatttaggatcaggatcacttaaggttatttttagcttataagcttgaggaggaagaactcacaatattttggccagatgaagaagagaaactgaaaggaccatcttatttttccccactgactgccatcttttgtcccctaattctgagaaggccatctcctcatacttaatacagaaaagaaagctcacggatggttttgctttcccttttagacaacagaggaaacttccaagccaaaagatgactaaagaaatacaagttaaggtatctggtaagttgggtgtttatttgtaaatgaagacaactgtatcttctgccaatttatgtgttatagatgagagaagtgaagtccacctcttgagtaattcatgctcactttacagtattggcatgaaatgcatactgcaagatctacagagtaattggtcattctctgaaagcactaaatgggatgagtttgctattgaaatgtttaaaaaccttaatcttataattaaaagcttttaaaaatattaggccaggcacttagaatgaccatctgaggctagttgaatctttgaaatccaaatgctcattactgcaggttattgtggcaaagcaaaattagcatgttacaacttagcgaaatgtcctgaagacattggcattccccagaataccaatacatggtggggtggggagaagtaccctttagagtctggtggaaattacagggttttgggaacaagggcaaaggaaaagattggccatttttatttgtcattattttggaaagtaaagtactgtgtttgattctaatttataattgctgaagaaactggacagattgaagggatttctgagatcttcagaactgggcccttatcttaatcttcagaaaggagagggcttaatgtaagccttaaaagcatacaagcacttactgaccaaagcctaaaagaaatcaaagtataggttaaatcgggttcagctctctcaccatgatccatgtttatttcctaggaaaaaaggagctatattaggtagaactgctctaacatttttcccaaaattaaaaaaaattctattaatccactttcatgtttacttataggaaattccttctgtctgttatacaatgcttttgctaagtggtatatttactatgtctgtaacaagaaaattacatattaaatgattcactgcattttttatttgaaatttttaaggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggcc

SEQ ID NO: 761 - DNA, 28253 bp, Human
accaaccaccacccaccaccactaccacccctcaccacccaccaccaccgccacccaccacccaccaccatcacccaccaccaccaccatccaccaccaccacccaaccaccaccacccaccacccaccaccatcacccaccacccaccaccacccaccacccaccacccaccaccatcacccaccacctaccacccaccacccaccaccaccaccacccaccaccacccaccacccaccaccaccaccacccaccaccacccaccaccactaccacccctcaccacccaccaccaccgccacccaccacccaccaccatcacgcactaccaaatatgtgatcatcaaaggtagaagcttacaacttgtggaaagacagataccactctctggcctggggtgggaggacagagtatgactcgtcctcaggcaggttggcttcctggatgatcagagaagtagaatctagggtgaaatgaaacaaaagtagatggagaaatctcaacaggaccaagtagagagggagaatttaggaatttagttagactgcagcaaaagaattcactgggtctctggccctaggctaaaaactatagaactccaaacctttaatgggagggggtacttcatggggcatgtctaagaggagtgaggaatgaggttaatgtgattctacggaattagacagaagtctgtatggctgaatgtactgggtttaacagcaacgttttagttagtttttgatattattgcaatgatgcactccagcaggagacaaatcctggcaggatgcatggttcaaagaaataccaatctttcaagagtatgtttaaacaaatttcactataaaagactatatctctgggaatgtcaagcaattggttactttagcagaaaaaaaaaaactagccatgtgacaacatggggataaaggaaaataaacacagtggacatgttattttttctgaaagtaaaatcgagccattttctttcataatctagtacagtcatgtgagaaattctgcttcatggtgatctcaagcaacagtttattggtggtgtggtacccaatagattgtgggtatggttgtaaatatactaaaaaacattaaattgtatgcctttagtgggtaaattttatggcatgtaaattatatctcaataaagctgtttaaaaaagaaaaagtaggaaacaaaataaaccaaataaaagtactaaaatcacccataattaattccaccatacagagataactgttaacatttgtttaaggttttcttgtttgctttttctaatttgtaaaagtcatatacgttcattaggggaaaaagaccacttagaaatgtttgcttgggccgggcgcggtggctcatgcctgtaatcccagcactttgggaggccaaggcggggggatcacgaagtcaggagatcgagaccatggtgaaacccagtctctactaaaaaatacaaaaaagtagccaggcgtggtggagggcgcctgtagtcccagctactctggaggctgaggcaggagaatggcgtgaacccgggaggcagagcttgcagtgagccgagatcacgccactgcactccagcctgggcgacagagcgagactccatctcaaaaaaaaaaaaaagaaatgtttgcttgaagaagaaagtgaaagataattataatctcaccactgacagacaaacattttaacagcttgctgtgtatctttccagacttttaaaagacatagatttatatataaaccagttttgacaaaaatgggctaatactatgcatactgctttgtaacctttaaaagtacattgtgaatatattataaacattctttcacataaatgtttatgatagaaatataaatatattttaagtgaatgctttgctctcaagtcaaagatcaatattcctaactttaccggaacccactagaattatttgctgttgggtcagttggatgaaccctaagtatctttggctgcttttcaggttggctctgacacgttttattccttcaagtacgaaatcaaggagggggattgtcctgttcaaagtggcaaaacctggcaggactgtgagtacaaggatgctgcaaaagcagtaagtgtattggccattcttgggccttctgttttctccgttgaccctgccagatttttttactgatgcagaaatgatggctactggtgagcctgtttatgagaaatgcaaataaacattccaatgtgtagaaaagtcagatgctttatatctgtgttcttgtatagacagaaaaatcatggagaagccagcagttaaacatggagaaagcctttccatgagaagggggctctagtgtccagccagaacatgtggctcagactccagagagataacaaattgacatttgggccaagccaaagagctggcgaggggagggggtgggtgcttccattgcacaatgttaagtgcaaatcttgactctgccttccattagctgtgtgatagcaggggagctgtgacctctcagaactggcactttctgctgtatatgggagataatattgacctcatcaggttgttggaggatgaaatcagatgaattatgcaaataactttgataacaatggctatcttaaccaaatgcctaacatataggcctggcacaccgtagctggttgttttgcttttttttttttttttttttttttttttgagccagagtctcgctctgtcgctcaggctggagtgcagtggcgcgatctcagctcactgcaagctctgccttccaggttcacgccattgtcctgcctcagcctcctgagtagctgggactacaggcacccaccaccacgcctggctaattttttgtgtttttagtagagaccgggtttcaccgtgttagccaggatggtctcaatctcctgacctggtgatctgcctgcctcagcctctcaaagtgctgggattacaggcgtgagccaccacgcccagccatggttgttttgctttaattaagaaagatttcagacagtatctgcctcagaagcaagcctctcttttcatggattgattcccttcttttatgtcagaacataaaagatgactgccagtcatctgccattaccaaagagtactgaactccaagtcaggagtctaggattttgcagtgctggttctcccttctcagtcatctcatctgtaaggtggggataagtagctgctgtgctctgtactgcctgcttctaggggctgtgtggacaaagggaggtgtgctttatcctgatggaatagtatctgtcacttagaatccaatggatatgactgaagaatgaaaagacaaaacaaaacaaaaacactgttcaacaataacaattaaacagctgcctattattaagtgcctgctgtgtggcgggcctctagtaggcattttgtgtgtgtttgcacacatactgttcacaacaactctaagagatagatgtatcccatctcctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaactcactgaagttgagtggtagataagaggagtgtttagcaggctggttctagacctctgcgtccatcttggttagaaagaaatagctccagggctcagccaggtgcagtggctcacacctgtaatcgtaacactttgggaggccgaggtgattggatcatttgaggtcaggagtttgagaccagcctgaccaacgtcgtgaaaccctgtctctaccaaaaatacaaaattagctgggtgtggtggcacgtgcatgtaatcccagctacttgggaggctgaggcagcagaatcacttgaatctgggaggcagagattgcagtgaaccgagagatcgcactgttgcactccagcctgggtaacaaaagcaacactctgtctcaaaaaaaaaaaaaaaaaaataggaaacaaaagaaaaaagaaataccctccagggctcaaaacaaagactcaagctttaaaacctcatcatttacactgtctttcctccagcatctcatgaatatcagtggcttatataaagtaatcattaggctattaaaaaaatttattctcatgtctcaaaactcttttggtaaaatcttcacaagttttgttttgttttgctttttaaggaaagccacatttagcaacagtattaggtagactttcccatctgaaagattaagataaatgatctctttcttttctttttaggccactggagaatgcacggcaaccgtggggaagaggagcagtacgaaattctccgtggctacccagacctgccagattactccaggtggctggtttatcctctggcactgccctggtgggaaattaaccatttctgtgagccaggaacacaatcttgaccaggctctgcttgctcccagagggtggcagtagtaaagccatttgcagagttagggagcattgggtggagcggcagagcccggaggttgagccaggctcgtgaccatcatccccttaggactatcccaactcttcccgtgtgctgcattgtacccagtgtgtgcaagggctcaacagaaggaccagaagacataagacctgccctccattgcaggcagcatcccagattgaggagcgcataggctttgagggcagacctggcctggaatctttcagagctccttgccttcttgcctctccttttccttgtctagaaaagggaggtaagagtacttcccacttcacaggactgttgtgaggctgaaatgagatgatatgcctggaggtacaatcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacgtgtaatgattaagtcagggtatttggggtatccatcacctggaatagttatcatttctatgaattggtaatatttcaagtcctctcttttagctactttgaaatatacaatatattgttgctaactatagacactctagtctgctatgtaacattagaacgtatttcttctatctaactataattcagtacctattcaccaacctcttcatttcccccttctacccgcttaccccgctcagcctctggtatctgtcattctcttcccttctctatctccatgtgatggttttagcttccacatgtgagtgagaacaatgtgaagtttgtctttctgtgcttgagttgtttcacttaacgacctctagttctgtccatgtggctttaaatgatatgatttcaattctttgtttacggccaaatactatttcattgtgagtatataccacaatttctttctttttttttttcattttgagacagagtctcgcactgtcgcccaggctggggtgcagtggcacgatctaggctcactgcaacctcccgggttcaagcaattctccagcctcagcctcagcctcctgaatagctgggattatgggcatcgccaccacgcccggataatttttgtgtttttagtagagatggggtttcaccatgttggccaggctggtctcgaactcctgacctcaggtgatccacccgcctcggcctcccaaagtgctgggattacaggtgtgagccactgtgcctggtcccccacattttctttattcattcaccttttgatggacatttaagttgatttcatatctttgctattgtgaatactgctgcgacaaacctgggagtggaagtacccctttgataggctgatttactttcctctgggtagatgcccagtagctggactactggatatatggtatttggtgttttcattttttgaggaatctccgcactattttccatagtggttgcactaatttacattcttaccaacagtgcattagagttctcttttctccatttcctcctggctgtgtttaccgcttacatggcaggcagcgagagctctgtggtgaagaagtccaggctcccagggggtccctccaggtgtgccactcactctgcagctacgttccctttttatggactttgcctctattgaccagtaggttagggctatctgttatgaacattacttgataatttaatacaaattctttttaataatagccattctaactggggtaagatgatatctcatctcataatggttttgatttgcatttccctaatgcttagtgatattgggcattttttcacatacctgttggccatttgtatgtcgtcttttgagaaatgcctactgagatcatttgcccactttttaatgggattacttggtttttttattggtgagttgattgaattccttgtatatgctggatgttagtcccttgtgggatgcatggtttgcaaatattgtttttctttctttttttttttcttttgagacacagtcttgctctgtcgcccaggctggagtgcagtcgcatgatctcggctcactgcaacctccgtctcctgagttcaagtgattctcctgcctcagcctcagcctcccgagtagctgggactatcacattcagctaatttttgtattttaaattttgtaattttgtatttttaggagagatggggtttcaccatgttggccaggctggtctcgaactcctgacctcaggcgatctgcccccctcagcctcccaaagtgctgggtttacaggcatgagccaccacgcccagcctcttctttgtttagggcagtgtatgcgaatgctcattgcgatcattaatgctgtgtttttgtctgctctttgttaagccgagggccctgtggtgacagcccagtacgactgcctcggctgtgtgcatcctatatcaacgcagagcccagacctggagcccattctgagacacggcattcagtactttaacaacaacactcaacattcctccctcttcacgcttaatgaagtaaaacgggcccaaagacaggtttgttctttaattctctaagtagcacagtattactaaaatttgttagatctttacatttaaaatgtatgattgcatggctggtggtgttttcatgtgactagcacaggaagcgaagagctttctccttagtcaaagtgagtcggatagtgcaatatgtaaagtgagaaaagatgtcgaatcagacccccttcctttgatgtttgattttaacaaatgggtaatcgtcattacaggctcttcctagagacagtgaaaaggaaaagtcataccggccttaggatttttttttttttttttttgagacagagtctctctctgtcgcccaggctggagtgcagtggcgcgatctcggctcactgcaagctccgcctcctgggttcatgccattctcctgcctcagcctcctgagtagctgggactacaggcgcccgccacccacactggctaatttttttattattattatttttagtagaggcggggtttcaccatgttagccaggatggtctcaatctcctggccttaggattttaagaaaactatattatcacctagccatcatgagttaaacacagctccaaaatattaaattgtgtctaaaatggtcggcatggctttctgggtacccactaattacagttcccatatcatcagaaaaaaaaaagtatatatccgtaattttttttttttgacagtctcgctgtgttgcctaggctggagcagtggcgcgatcttggctcactgcaacctctgcctcccaggttcaagcaattctcctgcctcagcctcccaaggaactgggattacaggcgctcatcaccatgtcttgctaatttttgtatttttagtagagacgaggtttcaccatggtggccaagcgggtggtctcaaactcccaacctcaagtcatcctcccacctcggcctcgcaaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaagagatctcctgcctcagtatcccaagtaactgggattacaggcacccaccaccacgcccggctaatttttgtatttttggtagagacaaggtttccccatgtcggccaggctggtcttaaattcctgacctcaggtgttcctcccgtctcggcctcccaaagtgctgggattacaggcatgagccaccacgcccgcccctcccagacttttctgatagttgactgggtctcttgtatttcagcctcttattatgagtgattccctttggttagtaacattctctgcatttaataaaccttacaacttgctttcatgcgagcatgctttactcaattatgtccgtatagtgctatcagggtgggagaggcccagaataaagtagaagaaatcttactacttggtaacctgggagcctgaggacccaacagtaaagaccactcccctctaaagttttctttatccgtctagaagggcattattattttatgaaattcagtaaacatttctctctgcagcctggcagaggaaatattgttaggattcacttaaggaaatccatgttccaaaactggctgaaaaatagaaaaatatatatattgcttgtcattttcagatggctagcggtgtatgtgtgtgtgtgtgtgtgtgtgtttgtgtgagagatatgagactcttaaggtgctcaatgtttattcagcatttttttgcctagtaataataatattttatatttcttgggcacttattatattgccacactgttttctaaactcctcataacattcatatcccacagcgaataatgtttaaactgccctttaaatattcaatctgaaattgtttcaggtggtggctggattgaactttcgaattacctactcaattgtgcaaacgaattgttccaaagagaattttctgttcttaactccagactgcaagtccctttggaatggtgtaagtaggcaaaaatttaatgataaagttcttagcattttgtttacattttgtggtaactatcaagctgggtgggaagactgtcacgaaaagtttagatgacattcagcaattcatattcacatttacttgggaagactaaagctcacgtcactggtcaagctgccttacctaactggccaaagaatctgcacagctagcaataagtatttttttataactttattttattttatttattttttgagacaggatctcaatctgttccccaggctggagcacagtggtgtgatctcatctcactgcagcctccacctcgcatgttcaagctattctcctgcctcagcctcccaagtagctaggactacaggcgccaaccaccacgcatggctaatttttgtatttatagtagagacagggttttaccgtgttagccagagtggtctcgaactcctgacctcaggtgatccgcccaccttggcctcctaaagtgctggtattacaggcatgagccaccgtgcctggccagcaataagtatttacagagcataaccagggactacgaatagataaaatgcttgaacggtcaactgtatctttgttatgtctccacactttcccatttccttttcttccccaggtgctcaatgcccatatggtgttcccttgctctacccagggttattcttcatgtcaaacttttctctgtttgttttctcatcttcccttccctacctttatctttaataaacagaccctgagtctctagcccttagtggtccttcttagcatcgtatcttgttatctgaaccaaaattatattaaaatggtatatctcaaggtagtagtagctagcgaatgttaagatggcgaagacatgatatgtgcccagggatgtttgcatttgagcagaagactgtgctttagccaaggaaatgctgcaagtcctttgatctagtaattctgcttctaattcatttatatgggaaatccagaccataagatgttaatgtcagttgttttttaatagaaaaatattgtaaacaaatagtttatgcaacattacagaatggttaagtaaattacagtatatccatacagtagaatatgatacagctatcaaaaatttttagtttttagtgacatagtaaaacggttacaatgttaagtaaaaaacaaaaaaagtgggatacaaaactatacatacggatttatttaaatatgtaaaataaatgtaaatacaaaaagtgatggaaaacaaattatgacaaaatatagaatgtagttaactttcagttggaattgtgggtgctttttcttttttgagaagaggtcttgctctgtcaccttggctggagtgcagtggtgcgatctcggctcactgcaacctctgcctcccaggtttaagcaattctcatgcctcagcctccctgagtagctgggattacaggcgcccgctgcaacgccaggctaatttttgtattttgggtacagatgggggttttgccacgttggccaggctgttttcgaattcttgatctcaggtgatccacccaccttggccttccaaagtgctggtattacaggtgtaagccactgcatccggccgctttttctgattctttatattttttggaagtttttgatatttcccgagttttctaattgagcatgcatttattttataattggagaaaaaagtaaaaaggacactatcaagagagtaaaaatacaacccacagaatgagagaaaatatttgcaaatcatgtatctgataagagtttaacatgcagaatatataaagaacctctttttgttcataaaataacaagtattagaaagggcatggagaaattagaacttttgtacattgctggtaggactgtaaaatgctgcagccattatagaaaatcatttggcaatttctgaaaaacttaactatagaattactatgtgacccagaagttgcactcttaggtatatgcccaaaagaactggaaatgcatattcaaacacgtgtttatacatgaatttctatagcagcaaaattcataatagccagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttggtcttgttgcccaggctggagtgcaatagcgcaatcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattcttttttcccctcacttctggagacctaggcataggtctttctatttgtttgttctatttgtttgttctatttgtttttctccctctgtttttaaattatgaaatcatgtcgagtcaaaaattaacttagaatgctgttctaataacattatatggaattctcatttttgttattttgtttttttttccttatccaagaaagaccctaactttattggcaagcatgtttatatttccaagtatattgtttttgtttgtttaaacatgttatgaatttttagagattattttttctttttggtgctgaggtgaaagaacataccctgtattgtttctgctttgtaaaatgtattggatctttttgtgacctggtgtaaaaacaattaaaaatatttgtatgatactggccgggcacggtagctcatgcctgtaatcccagcattttggtgggtggatcacttgagatcaggagttcgagaccagcctggccaacatggcaaaacctcatctctactaaaaatacaaaaaaattagccgggtgtggtggcagacgcctgtaatcccagacacttgggaggctgaggcaggagaatcacttgaatccaggaggcagaggttgcagtgagctgagattgcgccactgcactccagccttggtgacaaagagagactccatcacaaaaaaaaaaaaaaatatatatatatatatatacacacatatatatatacacatatatatatacacacacacaaatacatacaaattagtatgatacttataaagtatcatttaaaatcatatgtagcatatgaaaataccatttaaataaatctttaatatgttattcaaatcttctatgttcttgtttattttttattcacttgccctgtcttagatttgtaattgcatactaaattttcccaccatattatttctatccatttctattcacgtgtaattttttctactttaggtattttgattccatgccttctggtctatgcttttgaaaaataaaatgatcatttttactacctttaggaatgagtgttttgttctcgtgaattttactttgtccaatattactaatactgtagttcctgctacgtttatatttgtctcacgtagctttgttcatctgttatttttaagctttatacattgtttttattataagatgattcttgaaactgtaatacattgatttggtgttttaacagtgtgaaagtcttaccttatttttttagaaatttacctttttacttacatggctgttatttctgtactagatcttcctgctttccacgtgctcatgtatatgcatgtatttgttgatgctattgatactattaccttagtatctcttttgcagtaaggctatgttttgcttctttcttttttttctatgcaatgatttggaaagtacacgtcctattcttcaattttactagttgtttacttttaagactctaaaaaatgtttttaactgagcacttatatgctttttaaaaaccaggataccggtgaatgtacagataatgcatacatcgatattcagctacgaattgcttccttctcacagaactgtgacatttatccaggtaaggaataacacatgttggcaccgcaatagaggaatagtggtcccagacaactggctgagtcttttcctataagttgggttttggttcccgtgatatactccaaagtctgtgtaacctgcagacacagatgcaccccttgatgagaacactgtaccccttccctgcccagttgtgctgcagctcagactgttcttgtcagaatggtttatgaagacagaagggaaatgtatgacccctgggcaaagttggcctttgggtacaatgccatctggtctctcttctctgtaagttgtccttaagtcagatgttgtaagttgaagagacctgtattttatttctaagcactcagaacaaaaccctttcaattaaggtggttttttcctgcatgttataatgggaagaaatggagatagtgtgagtttgtggtcaggtcagtgtttcttataacaagggtgtgcttttttcatacttggaaaacgtttgtatgcgttccacgagtagtctgaagctgcctgttcatcagaaccatagcacttaaacttttctcatgagagtcactcctttaaattaagcattgctttttacagtttccatcaaaaatgcaaaaattcaggaaaagtgtagcgttttgttggagttactcgcaccttcctattgaaaatgtttccctaagtacactgtgctctgaggaggagaaaagaagagaggcaggaagtgaaagtcagacagacaaccttcccccactcactactgggcctgggctcccatgtagccccttatacatgtggatgctggttcttgtgcaggagggatgctaggccaggctgctacttcagtgtacatgttgacttaaaacctgatcctttcagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtgtgtaaactatactacaaaagcagtaacactatagtctatgtgcaaattgctgactaattttgccactgatcttggctctggattgggaaaccatacatttgataatgtgatttggtgcattagatttggtaaattaagtgccaatctccctgtatgcttcatcccggacaagtattttacaacattctctctgttttctatatgtaaaggactgaggtgaggatcaaataagttaatatatgtcaaatcactttttcaaactctaaaatgctatataaatacaatagcagctgggcgcggtggctcacacctgcaataccagcactttgggaggccaaggcgggtggatcacaaggtcaagagatcaagaccatcctggccaacatggtgaaaccctgtctctactaaaaatacaaaaattagccgggcgtggtggtgcacacctgtagtcccagctactccagaggctgaggcaggagaatcgcttgaacctgggaggcagaggttgcagtgagccgagattgcgccactgcactccagcctggcaacagagcgagactctgtctaaataaataaataaataaataaataaatacaatagcaaccatgatataattaataaaattcagggctagggccaggaagacttacgctatgtctttctggactcatctctcattataacatcacataatgtcttgggctcagccatatcagtcaatccatcattgccaaggctccacgctttcttgcctccatgtctttcacccactgttctctctgcctgggatcccgctctcctgcaaatgtaccctctggggattcatctctcctttcatgccctatcaatagaagactgacaggagtgtcttctgggagtcaggagactcagttccaccatagcatctgccgctcacatcccagatcactctgggtggtcattcaaacgttctaagcctttgtggccccgtctgtaaaatgagtgactgtattagaagagcctacattttgccgggcagagtgcctcatgcctataatcccagcactttgggaggctgaggcaggcagatcacctgaggtcaggagttcgagaccagcctgaccaacatagagaaacctcatctctactaaaaatacaaaactagccaggtatggtggtacatgcctgtaatcccagctactcggaaggctgaggcaggagaatcacttgaacccgggaggcggaggttgcaatgagccgagaccgtgtcattgcactccagcctgggcaacaagagcaaaactccttctcaaaaaaagagaagagcctacatgtctagcaactccaatagtctctgactgatgtcattatggacagacccctattttagagactaaaaattggcttccctaaatacaagctaaataaaaataatcaaaatagagccaaattgttacagcaagccaacataatcctcataatctggtgaaaaaattctcactaaaaagttcatacttttggctcagaattgaatttctaggaatctaaagtaggagtctttatatacaatgatattcactgcagttttaagtataacagcaaaaatagtaaactgtcaaaatgattaatatgagaatgattagatcatgtctggcatatcctcagaatagagtgttaagcagcaacttaaaagcatctttgtgcggagctcttgatatggggaatgtcttgtgttataatattcagtgaaaaaaaggaggcataaaattgaatatacatgatgttatcagttgtgttattttaaagtacagaaaataatgtgggaaaaaaaagtggctcacgcctgtaatcccagcactttgggaggccgaagtgggtggattgcttgaggtcaggagtttgagaccagcctgggcaacatggtgaaaccccatctataatattaggtttggtgcaaaagtagttgtgggttttgccaaagtaatggcaaaatcacaattacttttgcagcaacctaataaaaattccaaaattagcagggtgtggtggtgcacacctgcaatcccagctactcaggaggctaaggcacaagaatggcttggacccgggaggcggaggttgcagtgagccgagattgtgccactgcacttcagcctgggcgacagagtcagactccacctggaaacaaacaaaaaaacgaatgcctcatagtcatagtggtgatttttaggtgatggaataacactactttaatctttctaattttctgtgttacttttgtaactgaaaaaaagtaaacaaactagattaaagtaaatcaaaactgatactttgatctctctgctacttgagcacttgtttctatcccagacacgaccaccctctctctctgatttcattgccatatgaccacgttaggtttacttgaaagggacgccagtctatgctattcatgcttttttcagctttaacttctcactttatatttctgctttcttgtgaaattattttattcttttttcgttgttgttttttaagagagacgggggccagacatggtagctcatgcctgtgatcccagtactttgggaggcagagacaggaggatcacttgagccccggagcgagaccagctggagcaacatagcaagaccctgtctctacaaaaaaagaattaaaggccaggcgtggtggctcatgcctgtaatcccagcactttgggaggccgaggcaggtggatcacctgaggtcaggagttcgagaccagcctgaccaacatggtgaaaaaccatctctactaaaaatacaaaaatcagctgggtgtggtggtgggtgcctataatcccagctactcgggaggctgaggcaggagaatcacttaaactcgggaggcggaggttgcagtgagcaaagatcatgccattgcactccagcctgggtgacaagagtgaaactccatctcaaaaaataattaaaaaaaaaaagaattaaaaaattagctgggtatggtggtatgtgcttgtagtcccaactactttgggaagctgaagtaggaggattgcttgagactgggaggtcgagactgcagtgagctgtgatcgtgccactgcactctagcctaggtgatagaacaagaccctttgggcaacagagcaaacaaaaagagagagagatgggggtctcactatgatgcccaggctggactcgaactcctgggagcaagcaatgtgcccatctcaacctcccaagtagctgggattacaggcgcacaccaatgcacccagctcccttattctttattctgaatgttgtaggaataggccaccatgtattgtatgtcagaggtttgccatcaaaaacagaaccactcattctcaagcatgaatatctagtcttcttagtagttacagttttctctgtggattaatgaatcaacattctagtatgcatatgtgtctacattaaggatgtcagggggacacaaagaggtaacccatcagatagctgccaagtcaatctgaatattgcaagaatttcaaacttactttagagagataaatctttactaatttttgcatttaaagagagcaatttggttgcttggacatagtcacccaaggcagccttgatggaagcagccaatttactggaaatcaattaaacatatgatgaatttgctaaaagctagtctccaaaatgaccaatttgccaaattgctaaatatttatagttttaatcttgccttgggtttgcacatttagtcctgtttggatgcatgttgattccacgttgggttcatatttcagatatgaaacacttcctgaatcttccattttcacacattagtgattacagtttcatataagttttattttgccctaccaccactgctgctgtccccaaggctgttgatgctcctgtctgcctctgctgagatgaataaacttccaagatctgtgtgtgcacatgcagaaatttttcctttgacaaagtcctaggaatgtcaaataatatgtagatatataagacttgatgcaaattgccagaatcaccaaatatttgcaatgatgccaatttacattcacatcacctgggtataagacaccagttgaggccaggcgtggtagctcatgcctgtaatcccagcactttggggggccgaggcgggcggatcacctgaggtcaggagtttgggaccagcccagccaacatggtgaaacctcatctctacaaaaaacacaaaaattagccaggtgtggtgacacttgcccgtaatctcagctacttgggggcgctgaggcaggagaatcacttgaatttaggaggcggaggttgcagtgtgtgtcactgcactccagcctgggtgacagagtgagactccgtctcaaaaaataaaagaaaaaagacaccagttgaggatcttaatttgaattctcttcctaccagcagtgactgaggctgcttgattcctatgcctggccaatgccacgtatcatcaatttttgttttcatctttgcctgcatggaaggctaacaatgatgtctcattgcttttttaatgtgcatgtttttgtttattaatgaagttaaacttttttttaggcttaatgaccgttttaacttctctgaaatacctgctcatggcttttgtccatttttagtgttgggctttatattcatacagacattgattctatatcatagttttcccagcttgcctttctactttgcttattgtgatttttcagaagcagttttcatttttctctagtcaagttttagtattttccccttccttcagatttctttcctctgcttttcacctaagaaaggccttcctcatcctgggttttggtgaatatttatttatttgtttagttgttttttgtttgtttgtttttgttttgttttgtttcccgaaacagagtctcactctgtcacccaggcttgagtgtagtggcgtgatcttggctcactgtaacctctgccacccaggttcaagcgattctcctgcctcagcctcccaagtagccgggattagagatgcttgcaaccatgtccggctaatttttagtatttttaatagagacagggattcattatatgttagccaggacggtctcgaacccctgacctcaggtgatctgcccgcctcaggcccccaaagtgctggaattacaggcaggagccactattcccggccaacacatttaaatactatgatttaatactaaataatttggttgagaaattgggccacaaaatatttaatggaagatagtgttgagtagtgattaaaactgttgctagagattaaaataatttttttttctttttgagacagagtctcactctgtcacccaggctggagtgcagtggcatgacctcagctcactgcaacctccgcctcctgggttcaggtaactcccctgcctcagcctgtcaaatagctgtcaaattacaggtgtgcatcacaaagcccatctaatttttatatttttagtagaggtggggtttcaccacgttggtcagattggtcttgaacagctggccttaagtgatccacccgcctcagcctcccaaagtgctggaattgcaggcatgaaccaccacgcccagcctaaaataatttcttaatattaaaaatagtaagagaacaataaaaaccccaaataatttttctaattacaaaatttaatccacataatttctatagtagtactaactcagtatttcaccaattcaagatttggcaggacaataaggcatatttaaaaacattttaagtttttcttcctattcctgttagattattagatattacaacttgagcccttgaattactagtgaatttaacagctgttggacaataaaactcaaataaatacataaataaataaaaattataggccaggcatggtggctcatgcctgtaatcccagcactttgggaggccgaggcaggtggatcacctgaggtcgggagttcgagaccagcctgaccaacatggagaaaccccatctctactaaaaatataaaattagccaggcgtggaggtgggcaactgtaatcccagctactcaggaggctgaggcaggagaattgcttgaatccaggaggcggaggttgtggtgagccgagatcgtgccactgcactccagcctgggcaacaagagcgaaactccatctcaaaaaaaaaaaataaagaaaattatagcttgcttatttcttcccccacttagaaaaggaaatgggaccaaccgatagccaaatattttaaatatgcatgccaagctttaatgccaaacgtgtacttttttgtatgtaactctctaagttggtcaattaaaatttcaagattctcccttaacatttcttaaagataaatgatttattatgcaaatatttttaagcgtttactttgtactaattaatttttcaggtggtggctggcaagaaatattttattgacttcgtggccagggaaaccacatgttccaaggaaagtaatgaagagttgaccgaaagctgtgagaccaaaaaacttggcgtgagtagtcatgcacctgtctactttttcactggaagcctatttgatgtttttagaatcatttgtttaaatgtctcgtgaataacactgtctctctttcgacttctgttttcatggatagcaaagcctagattgcaacgctgaagtttatgtggtaccctgggagaaaaaaatttaccctactgtcaactgtcaaccactgggaatggtatgattctaattacagtcagcgtggggtcagttctgctcattctgaaaatccatatttgggggctgaaaatgaaccattactgaaatgaattggggagctatcttttttaaatggggagtaactctcacacttctgtgctgatctctgtttaatggctagaaagaagagtaacaatcctcctgatcacttctcacacattgtcagtgtctcagtgaagcttctatagactctctcctagtgcactgcagtcctgctgtgggggagcaacattggctatgccaggtgtacctgaggccagatacagcactccactgcattctgctgacatgcaaggaccatgtgaaaaatgcatggctgggcgcggtggctcacgcctgttatcccagcactttgggaggctgaagcaggcagatcacctgaggtcaggagtttgagactagcctggccaacatggtgaaaccctgtctctactgaaaatacaacaattagctgggtgtggtggcgcctgtaatcccagctactcagggggctgaggcaggagaatcccttgaacccaggaggtggaggttgcagtgagccgagatcctgccactgcactccagcctgggcaacaaagagcgaaactttgtctcaaaaaaaaaaaaagaaaagaaaaattcagactcgcaaaccccacttcacagctaccgaattttaaccagatccccaggggattcatatgcatgaatcaagtttgaaaagcattcgttgatgtcatctttcttttttaagtcttaaaagaactctgggaggtagtaacactttccctattgtcaaggatgagacactaaaaattagaaagactctgaggtcctgagtgaataatgacattatcaaatgcttcctctgtcccaggcactatactgaaggtttcacccacattttcgagtcctccttataactctgtgaggcaggtgctgttattatttctattttacagaaaggaaaagtgaagctgatggcacttggattcaaatcttggtcaattcagagtctaccctttccatcacgatgctgattaccagtagggtctggccggactccaatgaccatgttctttgcatcaccagacactgcttccaattaacacattctcacaggtagcaaaagtgtaggtagaattaatccacagatcgacatatttgaagcaggttacctcttttccctcttttctgatttggtcttttgtcatgtgtaggtatgtagatggtgtaacacaaacattgtcctcaggttgcatttcaagcttgcgaatatgtcctaatgtgcttcagcacaacaaagtgatcatggatacatgctccctatatattcagttcataaagccacttagggccttttaggataaaagcagtgatggtggtaataacagtagtatcaataattaaatactgtgctcagtaaaaacataggctcagaagctaccctagagattagctagttcaaccatccagatgaagcaaaaacactccagcttattttacagttttttttgttgttgtttggctgggtttttttgttttttttttgttgttgttgttgtttgttttttgttttttttgacagagtcactgtcgcctaggctggagtgcagtggcgccatctcagctcactgcaacctccacgtcctgggttcaagcaattctcctgcctcagcctcctgagtagctgggattacaggcatgtgccaccatgcccagctaatttttgtatttttagtagagatggggtttcagcatgttggccaggctggtctcaaactcctgacctcaagtgatctgctcgccttggtctcccaaagtgctgagattacaggtgtgagccaccatgcctggctattttatggtattattaacaacaataattaatgtccacaaattttaagatcaatcaaaagacaaaaaaaattattcatcctttctggaatgttaatatagcatttaaaatctggcaaacacctcccccattgtaaactaagatagcattgccagatctcagtgtttttttctatcatcaatagcatgatttttgcagtaatacattcatcttaatattttctgtttagatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccatacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagattttaaattttctgtaataaaaacacttattgggttgggcatggtggctcacgcctgtaatcccagcactttgggaggccgaggtgggtggatgacctggcgtcaggagttcgagaccagcctggccacatgtcgaaactccatgtctaataaaaatacaaaattagccgggcgtggtggcacgcacctgtaatcccagctactccagaggctgaggcaggagaatcacttgagcctgagaggtggaggttgcagtgagctgagattgcaccactgcattccaggctgggtgacaaaatgaaattcagtctcaaaagaaaaaaaacatttatcgaacacctattacagccatttgctatgctagataatttacttttggcatataacttaatcctcacaaccactctaaggcccccatgaacatcattcttttacaaggaaactgtagttcacagtgccctgcccagggtcatatagttaataagtggcagggctggcattcagacttagaccttttgaactccattacaccatgtcatctgaaggctttattattaatgttgtcattacaaaagacacaccaagtcactgactacagtcacagagacccaataaattaaaaaaaaaaaaggcatgccaagataatgtctgactctgagaggatccttgtctcaatccaaaatatccttattaaatacctaattgtggctggtgctgttctgtgtattggtcaggataaactgagttaagcagcagtcactaactatttaccatatgcttcgcatgaggtcctgagaggaaaagaaagaaattttaaaagacataaatcctttccctcaaagatcttgcaatcccattggcaagtcaagatgaaagcatacggaacaaagatttgatccaggctgcagtcttttgtgcaacagtgagtgaatgcaaccaatgtgactggaagaagttgactaggtagagggatcagctgtgaaaggtagtatgaagcccagctgggagtctaggctgaaatatgcagtagagttccttctacagtctttgccatactcagagggagtttgagatagatgattctgaaggttctgggtagggtggatcagaatgggaagagaatggagtcagggttctgttctgggtatttcctgacaatcatgttttagcagaaaaataagggctgatatataaagcctatacctctcagcttactcaacaacatgaagtatttccacttcaggcctttgttaggtaacataaacatgagtttcccgtgacccagaaactaactttcttattttttaaatatctataccagccgggcgcagtggcttcacgtctgtaatcccagcactttgggaggccaaggcaggcggatcacttgaggtcaggagtgcgagaccagcctggccaacatggcgaaaccccgtctctactaaaaaataattaaaaaaaaaattagcttggtgtggcggtgggagcctgtaatcccagctactggggaggctgagacacgagaatcgcttgaacccgggaggtggagattgcagggagccgagatcatgccactgcactccagcctgggcaacagagtaagactctgcctcaaataaaaaaaaaaaaaaaaaaaaaaagacctaactaccaagccaaagtcacaccccaagtgtctggccctggctctggggccacacagctacatcgctccgtgcttctcttcagggcaggcatttcctgtcgtcgagtccaacccacattcctcacattgtctacgcctagttcctcaaacaggaggcccctattggctttttactccactctccacttcctgcttctaagcctggttccaagggagttaactcacagaaagacacatgcttttcggcctcaccccagtctgtccggcgcccatgctccccttctgctcatactctgtacattcacctcgcgggaaagcccagactcccaaggctcctctgagaagatttgagaggat

SEQ ID NO: 762 - DNA, 28253 bp, Human; identical to SEQ ID NO: 761

SEQ ID NO: 763 - DNA, 18396 bp, Human
  misc_feature (1)...(18396): n = A,T,C or G
agcattcagtgagttaatccagaaaaactgctctaagagtcaaaaagcagtgatgtgctcactttgtgtctttttcaaggttgtcctgaaactacaccctttgtttcattctcttgaatgtccgtgtacaagcatttgtccaaatagccactaatttgagcacctgtggtaggtgggtgctctccggggtgagggaagtgtccagtcctgctctgtgggggcatggggattcaatgaggtcacacagatgccactatcaaggtgcctggctctaggtaagacctgaacccttgctgatttctgattgtgttatttgcaatcactttgttatgaatctatttctgaatgtaaaaaagtcggccaagagtgctggctcacgcctgaaatcctagcactttgggatgctgaggtgggtggatcacttgaggtcaggagtttgaaaccagcttggccatcatggtgaaactcagtctctactaaatatacaaaaaattagctggccatggtggtgcacgcctgcaatcccagctactcaggaggctgaggcaggagaattgcttgaacccaggaggcggaagaatcgcttgaaccattccagtctgggcaacagagcgagactccatctcaaaacaaacaaacaaacaaaagtctgcggtcctgggtgaaaactctacatgtggctctactggccccccttctagtgacagcagcagggtacctgtgtctcccctcttggagttatttttataaaatttcatgccttcatgctttttggtttaaaagcatgcaatcatgtgttgaaggcagtttcccttttcttttcttttttctttttctttcagttggagtctcactatgtcatccaggctggagtacagtggtgcaacttggctcactgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatccagctcgccctttccgggtctccaaccatgacaggagcagccggcgtggggtgatggcaagcagcctgcaggagctcatcagcaaggtgccccacatcccgcacctctcccccagtccacaggggtgccctgcactcacacagggccatggtcttgggctctaagccagggccagcacagaaagatcaagaaaagcagcatctcactggggggaaacggggagagaaattgggaatgactgctggtggttatggagtttctttttctttttctgtttttgagacaggatcttgccatgtggcccaggctggcctcaaactcctgggcttaagtgatcctcccacctcaacctcccaagtgcatgccagtttctttcttgggtgatgaaagtgctgtaaaattgattgtggtgacggtgggccaactctgtgagcataccaaaaaccactgcaccgtatactttaaatgagtggatcatatgatatgtgaattatacatcagtaaagctgtttttaaaagaggaggaaaagaaagaaggagaaacagcaagttaaactcatcagaccctctcttggcctcagagactctgagagtaaaggttaggtataaatgatcaaggggaacattacatctctgtaccataaaacattgaggtacagagacaaaaaccttaaaacagtcactaatggagaatgttgctttgtttctttgacaagggaggatgcagggatggagccgactttggaagtctgggtttggttgtaaaggccaggatctagaacagtgtcctagaccaccaaataaggaagaatcccagcctctcagagaagcataactcagactcaggcacccatggaaacaagaaacaagcatccaacatgcagtctctgaagcaagagagacactcagctacgcacacgaggctgtggctcttacagcagcaaacatgcaagagctttctttttattcatctaaataaataggtaatcttagaaattacaaatattatttaatgtaatcattacctcatgtatcttaagaagacagatccattaaaaatcttaacttcccggccgcatgcaatggcatgtacttgtagccccagctactccggaggctgtggcaggaagattgcttgagcccaggagtctgaggctgtgatgcactatgattgtgtctgtgaatagccactgcactccagcctgggcagcatagtgggtccccatcttaaaaagaacattcttcacttccctgtttccaagcaaagactgagtcatagacacaagtcaaggttacctttaccattaaaattttatcagaatcagcccaacacttttgaaaactgtaacttaataaatgtcattggctggtcacatggaaatacctggcttcactccatttctctgatgtgttgcacacctagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccggtaagcaaaaacactgtcacccaaacagctactgggtagactttttacctacaaatttgcgtgccctacttgggtgttgacttgtccactttctttcttttttttttttctttttttgagacggagtctcgctctgtcacccaggctggagtgcagtggcgcgatctcggctcactgcaagctccgcctcccgggttcccgccattctcctgcctcagcctccggagtagctgggactacaggcacccgccaccacgcccggctaactttttgtatttttagtagagacggggtttcaccgtgttagccaggatggtctcgatctcctgacctcgcgatccgcccccctctgcctcccaaagtgctgggattacaggcgtgagccaccgcgcccggccaacttctccactttctaaatatgcactttgtattcacctaacaactggatccactgccctcaaagggattcttacaaatgtttctaggaaacttagtctctctgtgaactgaggctatttgatataaagcaaataattccagggaacaggctttggccagtgagtagctacagatcctgtaaatgcacggaattgacttggcaactcttcaccatctctgttcttagaaggctggagaagtaaacaccatcaaggaagttagggagaggggtgtgtgtgcatgtgtgaatatggagatttagaaaagtaaagagacagaatgaagccttcggtctctgggaaaactatagatgatatagctcaaaaaaccttctcagtataaaatgcctaaaaatgtaaagcacaatatcaaaatatcttttcacataataaactgatctccaagaaagagaaatcctcagtggttaaaatgttgaggccagcatccagagaggaacacgaacactgaagctggcagttccccaggcatctcctctggggttcccccacctgtgagcacccacagacctcagggacagatgctgggaggacaggagacagcctccagctgacacaaagttaaggggtgagatgtgagggtctgcgtaaagcagggaatcttagagctctctcctggcaatttgggccacaagctgccctcatgagggtttaggcattgctgagtcccaaacccctaagctgagagttcggttttcagcagtatctgggggagtagcatcaatggaggggtttgctcattggattctctttactccagccccgtttccaggattgatagtgccccaggtaactagcaggagctcaggcagttccgcttgggatgaacatccatcctggcctcaaagagttttcattcgtaacgttctcacaatgcaagttcacaatcaaaacacagaacgtaaggactcaggcaccacattcatgagagtaagcagaagcaatcaagtcaggcctgccaggaccgcagatgttggaatcatcagacacacagtataaaattagtgtactaaaaatgctcacccatggctaagtttgactgactaaataaataaattaattaaatgctcaaagaaacattaaaaataatctaaaataagaatagctaggaattgaagaccagcctaggcaacagcaaaaccccaatctccaccaaaaaaaaattttttaaggcttagctgggcaagatgctacacacctgaagtcctagctactcaggaggctgaggcaggaggatcacttgagcccaggacttggatgctgcaatgaactatgatcacacctctgcactccagcctgagtgacagagcaagaccctatatcaaaaaaaacaaaaaataagaaaataccagcctgagcaacatggcaaaaccccatctctaccaaaaaatacaaaaattagcctggcgtagtggtgcatacctctagtcccagctacttgagaggctgaggcgggagaaccacttgctcctgggaggtcaaggctgcagagagtcatgattgcaccattgcactccagccccagggacagagggaaaccctgtctcaaaaaataaaaatacattaaaaaggaacaagagctaataagaactgactatacagatttgaaataatcaaatagaatttttggaaatgaaaaatataacaactaaaatcaagtaaatggagactcaggttagacagagctgaaggtaatgataaaagatctgaaagatgttgcctgtgatgtaacacaaagcagtagaggtggggaacacgaaggatgttagagaccagactgaaatctaatctctctctctttggcatcctcacgtagggaaggatttttttaaaacaagatacaatgcacaagtcatttttttttttttttttgagacagagtctcactctgttgcccaggcttgagtgcagtggtgtgatctcggctcactgcaacttctgcctcccgagttcaggtgattcttctgcctcagcctcccgagtagctgggactacaggcatgtgccaccacgcctggctaatttttgtattttcagtagagatggggtttcaccatattggacaggctggtctcgaactcctgaccttgtgatccacctgcctcggcctcccaaagtgctgggattacaggtgtgagccaccgcacccggccgatttttttatttttaagatatagggcaacacactcctctactaccaccaacagctacttaatgcagcaatttgcttcatctcagagagtgaggcacaaactatgacccagcagctgctttcctgggcatgaacctgagattccaacaacaccacgtcagcaggtgtgtgttagagcgtccatggcagcaatgccctaagtggtgagaacaaacactggaaacaaatcatgtacccttgcagcacacacgtgtgcccagcacatagaagtacttctaagtaaatacacacgaagaaactgtaatgtggtccctgaacagaatgctcttcagctgtgaaaatgtgtgaagttcagctacaggcatccatgtggatacacatcagctatgctgagcaaaagatcacaggataatacagtaaacaacgcatcctcaaactttatctcaggacctctttactctcctaaaaattaacgaggaccccaaacagcctttggcatgatctcggctcactgcaacctctgcctccctggctcaagtgtttcttgtgcctcagcctcccaagtagctgggatcacaggcaagccaccaccacgcctggctaatttttgtatttttagtagagacagggtttcaccatgttttccaggctggtcttgaacttctgacctcaagtgatccaccggccttggcctcccaaagtgctgggattacaggcatgagccaccacacccggcttgtatcaataaattctatagacatgtgccaatcagaggttctgagctgcagagactttgtcccttgggggacatttgttaatgtctgaagacatgttaggctgttgcatctagtgtgtagagaccagagatgctgccaaacatcctgcaatgcacaggacaaccccgacagcaaagacttatccagcctccaatgtcgttagtgtcaaggtcgagaaactataagctatagatagatatagatattcccaatagtcaaaattgttttttgtttgtttgcttgttttttgagatggagtctcgctctgtcgcccaggctggagtgcagtggcgcgatctcggctcactgcaacctatgcctcctggcttcaagggatcctcctgcctcagcctcctgagtagctgggattacaagtgcctgccaccatgcccggccttttttttttttttttttttttttcatttttagtagagacggggttttgtcatattggccaggctggtctcgaactcctgacctcaggtgatccacccaccttggcctcccaaagtgctaggattacaggcatgagccaccgcccccagtggttttttttttttttttaatttgtttgctttttgtttggagacagtcttgctctgtcgcccactctggagtgcagtggcacgatctcagctcactgctacctcgacctcctgggctcccccacctcagcctcccaagtagctgggactacaggcatgtgccaccatgcctggctgatttttgtatcttcttgtagagacagggttttgccatgctggccaggctggcttcaaactcctggtttcaagctcctgagctccagcgatccactacctctgcctcccacagtgctgggattacaggcgtgagccaccccgcccagccaatattcaaattcaaattgtttggaagttactgattagcatatttttgaaagaaattaaaattcagaaatttaaaaataggtattaattcattaaaagtaataacccaatacagattaacttaactcacttttttttttttttagatggagtctcgctctgtcgcccaggctggagtgcagtggcgtgatctcggctcactgcaacctccacctcctgggttcaagcgattctcctgcctcagcctcccaagtagctgggattacaggtgcctgtcaccacgcccagctaatttttgtatttttagtggggtttcactatgttggccaggctggtcttaaacttctgaccttgtgatctgcctgcctcagcttcccaaagtgctggagttgcaggcacgagccaccacgaccagccaccaggttaatttaactcatatttttatgaaaagtgactattttccaaaacaaaaagatggaggaacggcattttttacatttttgtaaatttctttaatgtctggcttaatagaagattcttatatctgcttctttatattcagtctgttgtaacatattgttttgatggaagtatgaagaaaatccatcctgacacagatatgcagctgggaaaggaggaggattttaatagcctattcagataactgaggatattcttttttttatattatgccagaactcaccaagtcatggtttcagaatagtgagttgaggtgttttcagaaaggtcagatgcagcgtgtaatctgaaggtataccagtgaagttggcctcctctgttacagtgaatccatcagtctgtcttccattttgaatggacctttttcctggggatgattttgtaacagcaggcgttggtcattgagaaaaactgattcactgagttatgcaggttttccaaatgtgctgtggaaacagcacttcttgtgagaacaaagaaggcaaactgcatcttactgtttattatggcctttctttctctttttcttttttttcgaggcagggtttgctctgtcacccgggctggagtgcagtggcgttatcttggttcactgcagccttcacctcctgggctcaagggatcctgccacctcctcctcccaagtaattgggactaccggtgcatgtcaccacacccagctaaatgcttgtatttttttagagatgggatttctccatgttgcccaggctaatcttgaactcctgggctcaagtgatccacctgcctcagcctcccaaaatgttgggattacgggcataagccaccgtgcttggcctagttttgacctctcagtcccttaatagggcctcaggattcctggatgtctccagattacactttgataaactccacatcaaatcatttacagataattcaaaaatatgcaaaattaacaatataatgtttgagatacacatgtgttaaaaatagagaaaagtaaggggaaaacgcatggcataaaaacctcttgagaggaggggagatgtgggaggtggatggggtctctaagggatggcagtgtgtaggtttcattttacgtctttctgtcccttacttctacatatattatacatatacatatatattatatatataacctcacaattttcctgactgggaaagaaaccacagaccaattataaaagcataatatttagaataaaatgtaatctttaatgtagatgagggctgggcgcagtggctcacacctgtaatcccagcacttttgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaggcaggtggggagatgtctgtagatgagactattaattgtggggtgaattagacaaatcatttaaagcaaatattggtgctgcatggctttttgcttgaggaaagtgtaacagcaaaaataatgcccccacagaccacagacacctctgtttgttttcttttctttttctttttcttttctttttttttttttttttttttgagacagttttgcttttgtcgcccaggagggagtgcaatggcgtgatctgggctcactgcaacctccacctccagggttcaagtaattctcctgcctcagcctcccgagtagctgggattacaggcgcccaccaccacgcccggctaatttttgtattattagtagagacggggtttcgccatgttggccaggctggtctcaaactcctgacctcaggcgatccacccacctcggcctcccaccgtgctaggattacaggcgtgagcccaggcggccggacagacgcccctgtcttaatcctcagccgtggcagatgggattaagtgaaggttactggggcggggttggggtggggtttgtcctggatcatctgggtagaggccgaagtcttcacaagggtccttatgagagggaggcaggtgagcatgaaggccagaggcagaggaggaggagagatgtggggtacccaccaaggcaggcgcccaagaagccgggaaaagcgaggggccgggcctgccccgcagcccccacggcggccctgcgccctggctttgactctgacctcggcagtgggacagcattggtgtgtgggtttcatgccactgaggttctggtcgtttgttacagcagcagtaggagatgggaaaggcgggtttgtttttctaaaggagacactcagctaacagggaggagttggtggtgggcgctgggaacctggttgcagggcagggtggtgggggcggtcgatgccacgggtgtagatgccaccgccggccacgcgctccagggggctcgcggcccccgtttcggctgcgcaaccacctccctggatcccagccacctgtaggcctttctgggcaaaaccagtttagactgagaccagaacgctggagcaggaagccgccagcaggtgtctcgctccccggtcccagcgccctcaggaagagcgcggccccgcagcccccgcccggcgaggccccagcggatccgcggcgggagggcgtcataattttaaccaagactggagacatttagggagagtaaaattaaaactttcaaaagtcagaaagggatgtgaggctcggaaaaagaggcgcgggacgggaggagaagccctctctgatgccaggatctgagctttccaaacacgtttcccggctgagggctcgctggcgcccccaagaggccgctgagagaaaacggcctcagcctcagctttgagtgtgtgtgtgggggggggggggggggttggggggggttgttgttgttgttgttgtttggttgggtttttttgtttgttcgtttgttttgagatggagcctcactctgtcgcccaggctggagtgcagtggcgcgatctcggctcactgcaacctctacctcccaggttcaagtgcttctcctgcctcagccttctgagtagctgggattacaggcgtgcaccaccatgcctggctaatttttgtatttttagtagagacagggtttcgccatgttggccaggctgatctcaaactcctgacctcaggtcatctgctcgtctcggcctcccaaaatgctgggattacaggtgtgcaccaccatgcccggctaatttttgtatttttagtagagacggggtttcgccatgttgaccagtctagtctcaaactcctgacctcaggtcacctgctcctcttggcctcccaaagtgctgggattacaggtgtgagccactgtgcccggcctcagctttgatttttaaagtaataagagggagctacaaccgcttagaaaaggatgatgaagtcaacctcacccgagattccacctcacaaaattttattttctttttccttctttttttttttgacaaggtcttgctctgtcatccagtctggagggcagtagcacaatcatagctcactgcagcctcaacctcctgccctgttcaaggggtgctcctgccccagcctccaaaagtgctgagactacaggcatgagccactgtgcctggccacaaaaagtttcctgaaagacaaattcaagtcaaagacaaatgcctgatatttgtaccttggggcagctttgctctcttatatttttaaagtgtcacaggagggagagcttttagttgacagattcctaatccatacataccccagatctattcaaacaaattctgtatgatccgaattagaggctacaactggaaccacaggtgggtttgtctgtatggtgggacaggggaataaagaaggctggccacggcgaggagggtttgggtaattttaggggtatttacattttaagttcccattcatgaggtcactgtcattggtgaatttaccattcacagcttcagcggctcccaacctcgaaggctcacaagacctagtaaccctgtgtagacccgaatcctgagtgctgcaagatctgtatgtggcacaagccactcagaaagaacagctcctggcctgtcatttgtactgggggcagctttgctctcatatttttaaaccattttgtggggaaaattctgttccggtgctgtttataaacctgggatgtgtagaggtcactgacttcctcctcccacccaggggggtctcctcccacccaggggttctgctgcatggctttgggcttccccatggagtccgctctcaaccctggggggttattaaaacacagaggtgctctgggaaggtgcccactctgccctcacttcagccatatgattctggtactttccacccagtagcccccataaaattgaaccaatgctgcctgcttctccattaccataactgtgttatagtgatgagatgagattcttttgtcaccaggtaaccatggtggcctccagggcgagtgggtccccaccactcatcagggcacatctatccactgagcaacggggtcctaaaatccaggccctgacgccacaccagactcaccctgagtccggaactgaaggcagatcagggacagatgcctcgtggctaattggacacagtcgtagtgtgtgcaaatgggtcctgctgaaagcatctctctatcgattagccacggagccactcacagaccttaaacagacacataggagaatctgaagctggcataagagcagagtgatgacgtggggagggttagggaaggctcctgaagcctgcccctccccccattgtcacagggcagnnnnnnnnnnnnnnnnnnnngaagggttaaggaaggctcctgaagcctgcccccctctccccccattgtcacagggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggtaacacactccaggggtcacctccgggggtctgcagactgcacagggtgtggcacaggcagcagtccccaccctgttcctctgggctcccaggccggctagcactgttaggggcagttggagtaatgttgtctggaggtcaactcttatcccacaggctcatctcacacaacagaaaatctcaagccaaaacagatttatttcttccaaagaccactaactattcattagaaacaaaagctaaataataaatataaagaggaaccacattcattttaagaactagagcacttaattctaggtgatgatgactaaaaccagagccatggaggtcgtggccgggtttgtacagagcggtcacctagaccctggtgaatcacacgcctttgcatgtatctcctgtactcctgataacttcagcctcaccagtaatgtggcatgggcgtgtgtcctctccacataatgccagggcaccgtcatcccaaagacgaaggccaggctggttgcacagcatcccaggaaacagaacttttagaagacagactcctgatccagccatacaccagacccattcaaacaaattccatgtgatcaaaaggagccttcctgggtgttcctgccccataactgggtgccacccctgccattgagcctgggactgagagagacaccagcagtccctgctctaaggaatcagctgtgtgacctttcacagactccttaacttctctgagccttgcttttatcatctttaaatgagaaggttggtcaggcgtggtggctcacacctataatcccagcactttgggaggccgaggtcagcagatcacttgaggccaagagttcgagaccagcctagccaacatggcgaaactctgtctctactaaatatacaaaaattagctgggcgtggtggcggatgcctgtaatcccagccactcaggaggctgaggcaggagaattgtttaaccccaggaggcggaggttgcagtgagctgagatccgccactgtgagccataaccacaccactgcactccagactgggtgacagagcaagactgtgtctcaaaaataaataaataaacaaacaaaaaataaataaaatgaaaaggttgcttccaagctctttatgattgccagggctctaactacacctacttctactccagtaaatttaccgttgatccttaaagaactaacctctgtggagggagtggatgggagagtggctgattgcagtagaaaggtcttcaagtcgaaaagttttgcagctgctgccattccagtgccccctgcacgtccctgtgggcagggccgcccgtttctctttgagggtgttgtttccgtcccccgtggccttgacaactgctctgatttgtgctgagcacagcaaaggggaaatgccctcctctcagaggtctcctggcctcacctgaggtgggccagggtgtgtggcttctctgtggcctcagtttcccattcagagccatcagtggctgactctaaactacagtcactgtcatagtgttggagtcttgactcccaggagagcttccttttttttgtcttttcctttttgccgggataggagaaaatagctttacacttggattttaaaagttaggcaagagagttacaacaactgaaaaaggtaagatgaagaaagctaacctcacccaaaattccacctcagtgaaatcttttttctttttcttttctttttttttttttttttttgagacggaatctcactctgctgcccaggctggagggcaggggcacgatctcagctcactgcaacctcctcctttcaagttcaagccattcccgtggctcagcctcccaagtagctgagattacaggcatgcaccaccacacccagctaacttttgtatttttaatagagacggggtttcaccatgttggccaggctggtctcaatctactggcctcaggtgatccacccacctcggtctccaaaagtgctgggattacaggcatgaaccacattccaggccctttttctttttttttaagaaagagggtctcacactgtcccccaggctggagtgcagtagcacaatcatagttcactgcagcttccaactcttggactcaagcgatcctcccacctcagcctctgaaagtgctgggattataggcatgagccaccacacctggccacaaagtctttcttgaaagacaagttcagccttcttgttactaatttgtattctctgataaatccgatgacaccacaagcagccatggaactcacgacagcccccacactggaggcaccgcctgctagggaccctgttgtgggtgctgggggcagtgggccctcctgatgagacagctgcccaggcttggctatcgcatccccatgggctcagtcactgctgaatgtcctgctactaccttaggaagggaagggatttcagtagcagggcccctagaacagcccagcagccgaagcccaggacacagcacacctgtgcgggtgcggccatctgctccacacagagcttgccagccactcaacaagcaggccgcacttcaggtggctcatgggagccgtgcttcttgcggtggtcttgggccagcagcaagggggtcctcagggagctcacagagacctgctcctggccagacccactgccacggcagctgcatctgtgccagccctgggacacgtgcactctgagagtcagacagccatgctctaaatgtcagcctggcctcctccgagtgccttttggtggggggagtgaagtattcccatcctgtctgtttctcactggcccaaaatcccaagctaaagcctccccatctgcctctgccacaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggctgtcgccggctcttgagccaaacactgtgtttcgtttggctcaatgacgaatgttgaagatgcttttatgttctgagccacatgcacttggaggccgctggtcacgctgctcaggagtggtgcccagaaaaggaaagggcttggtggtacatgaagtgggggcagtgggcagggtgccctgggggggaggcatagagggccctgggggtcatgggaagcgagcacgcagcaggcgtgcccaggagcgtgtgcatgtgtcagagccatttggtccatcatctcctgcaataaacccatcgcaagaatgaccttcaagatgtgtgacacttcctgcgtctcctttatctctcagaagagcaaaaagcaaacaaaacaaaacaaaactatcagaacagcaaaaaaaaaaaaaaactttatatagaagcaaaactcatccaggaatattctgctaacagatataatctctcataagtctttattagtgccacaaaaataacaagctgcaaaatgttattgtatgtttttttcaaacatggatttttaacaggctcaaaggggccctcacactgaaggactcaaattgtggaggtcttcaaggacttttttactttttcacttgtgaaagtgaaaggactttactttttcagcctcttttttctttttcttctttttttttttttttttttttgagacagggtctagctctgtcacccaggctggagtacagcggcctgatctcggctcactgctgcctcgacctccctgggctcaagccatcctcccacctcagcctcctgagtagctgagattacaagtgcacaccaccacccctagttttttttatttttgtagagatggggtcttgctatgttgctcagactggtctcaaactcctagactcaagcaatcctcctacctgggcctcccaaagttctgagattacagacgtgagccaccacacccggcccagcctttttcttaaaaaccaaaaaacaactgctgcaccctcagctgcagattctgcctgcagccaggtggggcaccgcgttgccaaggtggagctgtgcctcatgctggctcagctgcgaggaacctcctgtccgtggctgggatctctagctgcaggcacagctggacgaaggcaatcagacaacattgtaagaatctgtctcccactctcttggatctgattccctgcagggaggggggaccccctcaagtggaagcaagtgcagacctcaggccctgcagcaggaagctctgggctacaccttgtccccccattggatgtcctgggttacacctcatgctgcagacacagcagctggtggctctgccaggctgggccacacactgagtcctggagccaccccaaagagaaatagggtgctgttcctagaatcagggggaacagatgctagaagaaaaatatttcctgattaagaaatgatgccttggaggccttttccttccctagccaccaactctggccacagaaagacaccacagtgtgtcccggaaccctagaggaagaaaaactctcccctcccctacccccttcccggggctcccagctgctgctcagccgttcccggcagggatggtcctcccttcacagacagtttgcagtcccctttgagaggccccgtgaccggcgctgagtcctgggctctcactgtgtctgagccagttcttggagaagctgggccaggccccacagcaggacagacaaaaggaaaggaggtggcgttcctcaaagcacaggctcttctttcacactgcgaaaaaaacaggcactttccagtattatcccttcttgccttccagaatgagctgcgctgctggtagagcgagggttacaaagagtgttcaggcacaggccgtctgctgtgacttcaaaacatttcctatataaggagctcctgaccgccctgcccacctcgggccagcaggagaggaggtgaggaggagggctgtagccaggcgtgtgg

SEQ ID NO: 764 - DNA, 37531 bp, Human
  misc_feature (1)...(37531): n = A,T,C or G
tgaagttgctcagggattgtatcagaggcatttgaaccggagcaactccatattgaataggggctgggtaaaataagactgagatctactgggctgcattcccaggaggttaaggcattcttagtcacaggatgaggtaggaggttagcagaaggtagaggtcataaagaccttgttgataaaacaggttgcagtaaagaagccagccaaaacccagcaaaaccaagatggtgacaagagtgacctctggtcaccctcactgctcattatacactaattataagccattagcatgctaaaagacactccccccagcaccatgacagtttgcaaatgctatagcaatgtctggaagctacgctatatggtctaaaaaggggaacttccttagttcctggaatttcccaccccttccttggaaaacttgtgaatagtccaccccttgttttagcatataatcaagaaataactatgagtatccctagtccagcagcctaagctgctgctctgcctatggagtagccattcttttattcctttaccttattaataaacttgctttcactttactctatggactcacccttaattctttcttgcgcgaggtccaaaccctctcttggggtctgcatcaggacccttttctagtaacagttgggaccaggtagaaattggagtctgaagtttctctttattcctgaaagttgatccctgatcccttcatggggaagaaaatgggacttgatttaggagaagtgattctaatactggccaggtgcagtggctcacacctgtaatcccagcactttgggaggccagagtttgagaccagcctggccaacagcctggccctgtctctactaaaaatacaaaaaaaaattagccagatgtggtggtgggcacctgtaatcccagctactcgggaggctgaggcaggagaatcacttgaacctgggaggcggaggctgcagtgagcggagatcacaccattgcactccagcctgggcaacaagcgcaaaactccatctcaaagacaaaaaaaaaaaatgattctaatactggctctgccttgggccagccacatcacctttagctaattctttccccttagggtgtgtgtttcatccagccttccattcaattaaatattttagtaagcaccttctgtgttccagctacctctgccataatgaacttatattgtcttataggagccaaacagcagagcgcaaataaacaagccacatacgaaggctatgcgggaaatgaaggcagagggtgggggtggaaagggccaggtagtaaatatttttggctttgtggccatcactcaactctgctcgtagagaggaaacagccataggcaatacataaatgaatggacatggctgttttctagtacaactctatttactgaaacaagtgttgggccatagtatgctgattcccagactagatcagaaagggccttaaaatccaaggagatggctttagatttgtacttatagttaatggggatctcttgaaaattctcaagctggaatgtaatttgatggaaatctattttgtgtagaaccgtgtaaaagcatctgacatagaaagagagcctaataccccaggttgtcgctgcttttgaattgcgtatgagcactttgtgacctgctaggaatttagggggaaattttcattgttgtaaaccttgacagaccttccactgtttcttgtatgcagtgaacatacaacaaaattgtggttactggattagaagctccctgagggcaaggactttgttttctttgttgccatatatgtagtctctgggatgtaagcatattcacatatttgaatgcattaatggggcggtaaccctgaagcttaaatatgcaaaacttctcacccctaggcgtaatggaaaactgtatcacctaatgagtgtcatttaaaaatatcacagtatcagtgatgccactgaccttgtggctttttttctctcttcccagatggcagatgatcagggctgtattgaagagcagggggttgaggattcagcaaatgaagattcagtggatgctaagccagaccggtcctcgtttgtaccgtccctcttcaggtaagtttgcttaatcagggaccctggaccacgtcagcctgccatgcctctgccatctccacccacccatggggagggggacattcagggaaggaggttcatgctgagcatgaggtttgcacaggttcttgctagctgtacgtagcaacactagtgtcctcatgtgcaccctgttgtctgtgggccaagcccaggaatggacaaaagcaaccactgggagtctcctgctcagccgctgagtgtctggtagcagttcctaagtatcaggggctgttctcattagaggtgatttgcaggcaccttcagaacagagcctgggctgctgctgccagtgggaccaagtttgacaacacagaatccaagggctgagggacaggaggttttagggtgactcacgcccaccctgtgtctcctgaggcattgcactgatggaagggagattgcatcctgttcattagttcctacctttccatttcttgagctcacttttaaaattctaaattttgcatttaataatataatagcttcattgattaaactcttgtatgcctgcttggtattattgcatttagtctacataattgcacatttagttttattgttatcaccatttgtcaggtagggaaactgaggtgctgtgaggttgaatagcttgcctttttgctgatagttagtaaatggtaaagctaagatgagaaactaaacaatgccagcaccactcacttaaagattctgctgtgtgcttcccatttaaaagtcgggctagcttggtgcagtggcttacacctgtaatctcagcactgtgagaggccaaggagggaggatcgcttgagcccaggagtttgggaccagactggacaacacagtgagagccccgtctctacaaaaaaagataagaaaattagctgggtgtggtggcgcgtgctggtagtctggctactcgggaagctgaggcaggaggatcacttgagcccaggagatcgaggctgcagtgggccatgattgcaccactgcactccagcctgggcaacagagtgagactctgtctcaaaaaaacaagttgttttttttttttaataaaaaatataagtagggctgtaaggacatggaggaaccccaaccctcccttaaccttgatcatggatggacagtgagtggaacttcttgagagacagaaggcagcaggagtcagacgcatcacacttctttggattccctaagccaagtcctactgggaaagatagagagagggataaaggccgaggttagggagtgctcccaggcagtattcaggaggggaagagctggtggggatgggcagccaggctcccaacaccccagagcagaccttgggccatatcatccaacataggacttggaaaagtgggagaaccccaacactgtggacccagattccgttgtttgccagatagagtcaagaatatccaatgaaatgaccagaaaatacagttctgactcctggaactttccaaaaccatgagaaatcggtgcaggccaacttactccccaaggaaagccccttagagcaatggtcttcaaatgcctttgcttatgtgtgctcaaaataatataaagctgtgtgtatattttaaggtaacatacacatttttgtcaagatagttgcaaaaaatgtaataatatttcactcttccgaaccctttttgagtatctgacttcagcaagttgtctacaagtgaaagaaacgggaatcatttaataatcattttgtaagtcagtttaagaacagactaatacacaggactccagctcagcaaagccttttgatgtacttcccagaaattattaaaataaatggtgtgttgtaaatactgacatttcaaagtcgtttctttaaatgtacccagtggaatctacatccatagtgattttataaccacctttatccattaaaagaatacatgaacagctctcctgtaacagctagaacttttatgtcttttttcccttcaaacttggttttttcattctcttttcctccacattttcttctgatgtaatagatttagttgcttgaaagtcttattgatcacaccacatcatatacctatgtaacatatacatgtatgcatatgtgtatccatataaattttaagacagttttctagatatcatgagtattaaaagaaagttctcctagactaagttactgtttcagctttaatgaattcacaattgatctgaaaaataaatgttaatatatcattaatattattaaattgtcattcatcaaaataattattaaatagaaattgcattgaagtttcaacttataatggaatgaaggggctcttaataagttagtttctaaagaaatggacaaataatacttattgctggaataagaaagaatttgatattacctctttttcctatttttcatttttagagataagatgcactgagaaatcatgaataaatacatgagatggtaggagttttgttacagtcatgtcacttaattctttgaattccttctgagttctggaccaaaaaatgacaacttgattaggtctttccttaattatgttggaagaattggcaattatctaacttacaaaaggaattatcattccgccttaaaggtatttaatttttttagtttctgggaagtacaccaaaaaacttgtacccaaacttctcaaacagttgtaaattaaatttgctcttcttttatttagaggcagtctgtttaactcaaaatgttccagaaaagataattaagcattaataaacatttgtcagtatcctttttttgataaaatgcttttaaaccatatgctttttaaaatgtatttttgtcaagacgttggagttgctaatgcagctcattcatgtatgaaaattgtctgctctataatctaatggacagagccagtccctgtcaaaccagttagccataccacacttgtttgctgtcagtaaaggtctgataccatttttcagttcagtgaatatgttattaggcatccttgtgacagtcatcttgtttctgaattctaaatttttattcttggatagatgaatggatggatgggtagaagggaagaaggatgaaaggaagaaagaaagggtaccaagcccagccccatgtttacctcctggaatcagtgtttgttttgttctcacaggactgatatggtttggctctgtgtccccacctaaatctcgtcttgaattgtaatcaccataatccctacgtgttgagggagagacccggtgggaggtgactggatcatgggggtggttcccccatgctgttctggtgatagtgagttctcatgagatctgatggttttatgtgtttgacagttcctcctacacacactctgtctctcctgctgccatgtaagacatgtctgctcccccttccaccatgcttccccagccatgtggaactgtgagtcaattaaacctcttttctttataaattacccaatctcaggtagcatcttcatagcagtttgagaacagaccaatacataggactccagctcaataataaaaaatctttggaaataagggaacgaaaaaggcaaagacattaaataagaaccatcatcacttccatttcattctattatatatatatattttaacacatttttcagtatatacaagcatactttgttttactgtgctttgcagatactgcttttctttctttctttttttttttttttttgagacagagtctcactctgttgtccaggctggagtgcagtggtgtgatcttggctcactgcagcctccgcctcccaggtacaagcgattctcctgcctcagcctcccaagtagccagactacaggcgtatgccaccacgcctagctaatttttatatgtattttagtaaagacaggattttgccatgtttcccaggctggtcttgaactcctgaccttaagtgatccaccccccgcttggcctcccaaagtgctgggattacaggcatgagccaccacacctggcccagatattgcatttttaataaatggaaggtttgtggcaaccctgcaaacctattggctccatttttccaacagcatatgctcactttgtatctctatgttacattttggtagttctcacaacattttaagttttttaattagtgttatatctgttactatgatctgtgatcagtaatcttttttgttgtcgttgttcaaatccaggataatctctgtaaatgtgatgagtgatctttgatgttactattgtaattgctttggggtgccacaaagcacacctgtataagacagcagacttaaatgataaatgttaagtgtgttctgactgttccacccactggccattcctgtctctctccttctccttgggcctccctattccctgaggcaatattgaaattgggccaattaatagccctacaatggcctctaggtgtctattgaaaggaagagtgatatgtctgtcactttaaatcaaaagctagaagtgattcaacttagtgaaggcatgttgaagccaagacaggctgaaagctaggcctcctgtgccaaacagccaagttgtgaatgcaaaggaaaagttcttgaaggaaattaaaagtgctattccagtgaacacacggataataacattattgctaattattgctgacttggagaaagtttgagtggtctggatagaagatcaaaccagccccaactttttcttaagctaaagcctaagccagagcaaggccctaactctgcagttctttgaaggctgagagaggtgagaaagctgcaaaagaaaagtttgaagctagcaatggttgatccatgaggtttaaggaaagaagccttctccataaaatagaagttcaacatgaagcagcaagtgctgatgtagaagctacagcaaattatccagaagatctagctaagatcattggtgagagtggctacactaaacaacagattctcaatgtagacaaagcagccttctataggaagaagatgccatctaagattgtcctagctagagaagagaagtcaatgcctggcttcagtgctttataaggatgcttgactctcttgttaggcagactggtgactttaagccgaagccaatgctcattgaccagtctgaaaatccttaagaattatgctaaatctatactctttctgtgccctataaatggaagaacaaagcctggatgacacctgtttatagcatggtttactggatattttaagcacactgttgagacctactgctcattaaaataagattcctttcattgacattgcacctggtcacccaggagctctggtgaagatgcagaaggagattaatgtttttatgcctgctaaaacatccattctgcagctcatagatcaaggagtaatttcaacttccaagtcttattacttaagaaataatgtcttactatttgagaaatattatttcagaaatacattttataaggctatagttgccataaataatgttgggaataacattatagctatagtgttaccgctgatggatctgggcagttaattgaaaaccttctggaaaggatgcaccattctagatgccagtaagaacatttgcgatttatgggaggatgtctgaacattaataggagtttggaagaagttgattccaaccctcatggatgactttgatgggttcaagacttccttcaatggaggaagtaactgcagatgtgccaatcatggtggaaatagcaagagaactagaattagaagtagacctgaagatgtggctgaattgctgcaatcttatgataaaacttgaacagataaggagtttcttcttatgaataagccaagtaagtggtttcttgagatggaatctactgctggtgaatgtgctgatacatttttgaaatatacatttagaatattacataaacttagttggtaaagcagccacagagtttgagaggattgacatgaattttgtatgtgttttaactctttttttgtttgttttcttttaaactttttccctttttttttttttttttttttttaacgaacactttcgttgagggctgactttcaatagatcgcagtgagggagctgctctgctacatacgaaaccccaacccagaagcaggtcatctttgaatggtttagtgccaggttcgccaggaacatgcattgcgtgacaggcgaggggacaatcacctttctgttgacttgaattttgaatgaagttgtactgtgaataaaatgctatcaaacagaatggtatgctacagagaaattgttcataaaaggaagaatcatttgatgcagcgaacttcattgctgtcttattttaagaaattgtcacagccaccctaattttcggcagccaccaccagattaatcagcaggcatcagtgctgaggccagatcctccaccagcccaacagttacaacccactgaaggctcaaatgattgttagcattttttagcaataaagtatgttttaattaagatatgtattttttggacataatgctgttgcgtatactcagactggagtacagtgtgaacataacttttctacccactgggaaaccaaaaaagtcaggcgactccatttattgcaatatttgctttcctgtggtggtctgaaactgagccgacggtatatctgagttgtgcctatatttgaatttggaacagcccagtgtggtcccacgtacccccattactagtgacatacttcccctttatcagactcatgtataagtaagaagcccaccacagtgcctgattcaaggagactcacagatacgtcttgtttgtctctttgtggatgacctggaggtttcatcaccctgtaagtgaggttcagggtgggtgagaaagtctgcccttcttttacacagtgggagatgggagaatgggcaagggaaaaagtggtatctctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccaaaatatcttaaaatttgtaaagcattcagatttttagttatttagaggaaatcattgtggggccagtccatattcattatgaaccacagtttatagaacagggtctagggtcctccttgcacttgaacagggttctgtcttgatgtaaatataaccctatagtccttgccctggatataaagtcaaagttttaaccaaatgcctaggcacagctacagaaaataataactaattgctgaattgtaggacatagccttggagctgtgggaggttgaggagggaaggataaggaaggactggaggaggagctgaaacttgagttgtcaggaaaagcagggggggtatcaggggaccggtggaacctcagggccagggtggagatgatggtcaggcaaggccaccgatgtggcttctgcctaggaaagtgggcaaaatctgctggacagggtgagttaggtcttaatagcataggccacaaggagccattgtaggtccaagaccaagccctggccagcagcctagaagatattctctcctaggaacctgagaaatcagaggctcccttctgagctctgctcaaggtcagaattcaagaaaaggaaaaaaaggggaaaacaggtttcccgcagtctcagattacccctgggcctccgtggagtctcgtgtgtctctgctgaggagtttgtttacccttctggtttcccagtggaagagagcaggagaaaagatctattctcaacatttgctaaactccctattttccaggcactggctcggatcacatgggttttacccttggcatcatctctgttttccagcctttgccccctggagggtggttaataaatgccacttggttataattctctctcctggaggcatcttgggcttcttcaccagtgagtgaagatatgtaaacacatccctataaaaaatgtgttatttgtataattataaggaagattcaagtggcatcctttttcatttggagaggggttaaaaaactgttttagaagacgcaatgctttggaattagagacaagaacaaagaaggcagaccttaattcattccaaagaatacattccaagttaagcaaaaattgtgccatgatgcccattgattgaaaggggccagatctgggcccactaaagaaaatatgaacattgaaatttatgcagggcgtttacttttcaataaaggaaggattcaaattcagcttccagaaaattggatgcctgtctcccaaatttgtacatagagaatgataaagatttaatgctgtatttgaagcagtgatgacactatgtaaaataatagaagtagcaaagttgagtcagacaaccggggttcagatcctggcccttcctcccacttactatttgagggactatagcaagtcacgtgaccttcctgtgcctcagcttccttatctgcataatagagatattgatctctgcccacgggattgttatgagaatcagagtaaccgtcagcttcctgaattacctgaatgtgcctgctgaggaagaaatcatagaatcatgattttaacactgggagaacttacctaattcccttcattatgatcaaggaaaggaagaccagagaggtgatacgtagccacccaagaggaccaggaccgagacacaggcctaacttgtccagtgcttccccccagcgtcaggtggcacccacgactttggtggcaccaggctgttcatccacattaatccacccacagagtgcttttttccttccacccaagtgggtcagcaaattttcttcgtgtacacggcttcttctctgcttcactttggcagagggatggtatagggacagctgtcccagcagggcgagcagtgggctttccagtggcggagggatggcatagggacagctgtcccagcagggcgagccgtgggctttccagcggcggacggatggcatagggacgctgtcccagcagggcgagcagtgggctttccagtgaagagggccaagtgtacgtttcaggagcagcaagcacaggacaccaaaacgtgggcagaggtctagaaactgcaaagctgtagcttctgcatgtgtgggatacctccagttcttttcagttattgctcttctagaggggataaattaaagtgaaaaggtaaggtaaatcatcagcttttcacagtaatagaaacctagaacactattagcagagaaaaattaagcctagtaatagaaaagtactatgaaaacataaccagttgcttctcacatgaacatgtgatcacagacaggaaatgtgagcgtggcattgcatgtttaacccctgagctgctggttttctttctctcaaggatctgtgatgatgagaattttgtttgttttgttttgagacagagtctcactctgttgcccaggctggagtgcagtggtgtgatctcacctccctgcaacctccacctcccaggttcaagcaattctcgtgcctcagcctcccgagtagctgggattataggcgcgtgccaccactcctggctaatttttttgtatttttagtagagacagggtttcaccatgttggctagactggtctcaaactcctgacatcaggtaatctgcctgcctcagcctcccaaagtgctgggattatgggcgtgagccaccctgcccgccaatggtcagttttaaggggaaaagatgggtggagtgattaaggactgaagtatgttagctgttctaatgctggaccctgcagccgtaatacagacgtattgtatcctccattcagtctattaggctatttaaagacaattcagccttttctaccccctggatgatttgttttaaagtcatttgtcaatttttattgtcagggaccctactggttttgtttttttgttttttttttttaggggaaagagggaaatgtggaggttggtatgttttggggagggggatctattcttctccttagcctcttttaaactgagtttgcttccccatgtttatatttttgcaactgactttcagagaaaaaaatgtatagagcgaattttctctcctgttcacagacctgaggatggcaggtgatcaagaggcttgtgcagggtagcaggtgtcataacctcattgtatcagcttcataccctttctagactgtggtcctgaaccaagaaatggagaaaagcgttgctgagccgttcactttataagtgtttggtttttatgtgtttgcattttccttgttgcatttggagggttgagatggggaaatacagcaactcctggatcgttcactttatgcaagatcattgaaaaatgtttgtatgcctcatttaaaaatgaagggctttggtatgcttccgtggtctcctattatttttattcacttgagtacctttaaaggaaaaacataacctaatgaacttgaactctttaattcaccacacactcacttcctgtttttgttgattaacttacatatagtttgacatgttttgccgtcatgtgagtgccgttttgcagcctggtgtagatttgggacttcggtgggttgaccatgtgtgatgctcatcaacttgaactgtatgatggtttgttctgttgatactctgtctcttgcttagctattcccctgtcgttcccaatttttcactcttaaagattgtgctcctggctgcatgtttatggaaattttgttttcttttttcctttggaccccacgctcacagacagttgcttttttccacaggagccatcccagggttgggggatgctacaatggggagccggggcatttctgccggtcagcagagaagggagaggccagtgtgaccttcccagcccgagtttgaatggtcctgtggaaaactccagcgtgcagttcactgctgattcagtcacaggccttcagggccaggcagcctgtgccagtcttctatcccctgctgagctccgagcatgttgagtttttattattacagagaagaaggaaactcacttcctgtcgtcgcagagcacagcctagttctgatgcagaggggactgttttcagatggagacactaggtactactacctgcactctttcttttcttctctgtcttgctctgtgccttaatatgttaggactgtggggatgccctctgttgagatgttgagaccatgaatgaatcatcccaaaaatatttagacaaagtggctacgaaaaccagagctctagttccgaatgaaacagctctggggaaatgtgagcctggtggtgtgtttactttcatgctgatgaatgtctgcaggcagatagagctactgggaatcctattcatggtgatgctttagaaaattaatcgcagtgggcttcttgcatgcttatattcctttccaaatatagaaaggcataattcacattttgagtagcccaggggatccataagaggataaaacctgtatttatccactccagtgatggggaaaattacacttgcaccgggagtggattgtaaaaatccattgtactctttctaaggtttttcacttctttgtaaagtaggcagaatatttttatcctataacattttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgtgttcctagcagagatttatgcttatctgaacacatctggaaatgaagatagtggtacttgcccatactggcgaagaagctcaacatgaagaaagagatgggatggttaggaagcactgggttcaacctgctgtgttaactttcctttgcattttagtgtacacttaagtgcacttaataagtcattctaccaagatattgtagtgtgttgtgatcttgcttgtctggctctaagcatagtgatttagtagccaggtttctttttttaaatctgcagtgaattgtggaacacagaagcttttaagcggatttagaactttcaattcactgctctggtttatcttggactttgcacttaatggcaggttccaaaacaagaatcctatgtttcttcgcaaagtaatcttagtaaaagtcttccgaatataaacggggccaaagtaaaggtagttgcatcagcagttagcaaagagaggaaaaagaggaggatggatagaatgggaagcgacaaactctggaggaaaaactaccctggccagttttatttgccttgtctttctttgcctctcatctgtactttgcagaatcagtgggataatgattgttaattcaatttgtaaagcataagcctataaaaatattcatacttcttcatggtgacttaaaaaatatctgaagtggttcctccaccgtttgtgtcgttcatcagcttcggaagaaagactcatacccgttgatctggacttgaaagaatctcagtggccttttcctcctgcccctccgtttggcggggtacagcagttctcacatgcttcagcatcttctgcagtgaggtcctaggaacctggagaaacaacaacagccacttttagaaaatcatgtctttggggatgattgccagctgaagaagtttctaatctggacctttgaaagcattttattttccttctttttccctccccagctcccacccctgggagaacctgctggactgagctatggactgttgccttctttgtgccattggctaattaattagcacaatctcctgggagcccttgaggccctttcttctgtccaatagcagttgtgtagctgatgatctgctcgactccagcagctgatttccaagcagacagtaactcttttattcgctgctgggactgagatcacaaagcatgtctcctctgactgtgctgagagtgaattactgctcacacctaggctgccctggggactctacacagtttgttacaaaggaaggagactctaaggatgacactgcctgctggggcatttcctggaaggattttggtggtggcattaaaggaatttcagtttaatgttcagctcagctgtcattgctgggagaccttgcaggttccaaggagagttgtaaattgcccccgtggccctaaacataccctcactgctgcagaggggcaccttccagaggccgtgcttcctgaggtatgtcaggttccatctcctggccaagagccaaggagccaaaaggctgtgcacagctggagaggtgtttgataccgtagagcgagctggtgttctccgccccacacaggagtgtgaatcggcaccacgcaggaatgtggggccaacatcttccatcaacttctccgcttccacgggctctggaagtaggcgaggggcttgaaacaagatcagagacagcaatgaaaggtcagagccaagagggcctatgcagtgggcggacaggcttgtcatcgtgaccctcaagcttcagagggtccgagatgctcagaccctctgctgctgccattgatcagcatgttgcttttgttctgtgcttaacactacttattggagatcgtcccaggagaacgcccacacctgacctgagactcattctgtaggtctagagcaaagcataggattccgaattttaacaaagttgagaaactctggaataggagacttggggttacaccttggaatgaatccaggctctattcctctctagctttgtaattttggacaagctgatttcatccctctctgtgaaatggaactaatacctcacagaactcttgaagattaaatgagataatatatgtaaagtggtaaatgatcaaaaaatgatgtttattataactgtatttattattgttgttattgctgacacagtggagtaagaagtttaaaaggctaggcagagggataaagtcacagtgaaaaatagaaaaacggggtgtctagggagccccctcaattagcacaaaaaagtatgaatccagtgatcttcaaaataagccagatcttgaaatccgtttgtagcaagcaagagacttttaactgttaaatggcaattattagtttagtgttttaaataacttatttgcatataataaaaagttacacagagttcttccactcttgcctactgtctgctcccagctccctgtaacacagataaccacgctgaaagatagacataataatgaaccggcgtcagtgtcgggagtaaatacccaagattcattgtctcacggccacggaaaactaagacacagacacacaaatactgaggttcagagtggaagtttaataagcaaaagaaagagaagagctctctctactgcagagagaggggtccaagagaaatggattgctggttccgcagtggaatgcaaggcgtttcatagatgagcttgaggaggcagtggctgatttacataggatgcaaaagattggttgaaccaggtgtgtcatttgcatagggcaccaaaaactgtttagggctaggtgtgtcatttgcatagggcatgaaaaagctggccaccccacactcatcttttattatgcagctggttctccacctggccagcgccatgttacctgtttccttactgtacatgtggtggcaaagaaaagggaagagtggagcctccatgttaaacatacctggcccttacgtagcccttttctactggcatagctgccggtgttcacccgtgcaagcttccagcttgcttatctatgtctgcagcttgatttttcagactgctctttgttaaaaaaaaaagaaattatttggggcctgctttttgttaaaagggaaattctgtggaggactcttatacccttactatctgcctaaataatttctatctcctgtatcaataacagtaataatcatgatgtttatttaccacttacaacaggacacacactgttctaaatgctttgtgaagattaacttgtttacaggctctgagcaaatgctgttattttgtccttttaacaaatgaggaagcacaagcacagagaggttaagtaatttgcccacagtcacacagctatgcagtagaatagggagtcaaatccacacagcccagcccctgaatccatggatttatctactgcaccatccttcaagtgtctctttatgcagatacgagcaaatctaaacatattttcttttcttctttttttttccaaaaggtagcacactgctgccattgttctgcaatttggttttgttctgcacttaacacgacttattggagattgtcccacatcagaacataaagaggttcctcattcttgtttactgtactgtgtgattttgattaaagaaccctccctttatgatccaacctggttattatgggagcgagtgactaattgaataagcttatgtctgccagatagctcttgtaattgaagtgtgctatgaaggttcaacactggaaatgggagagtcaggggaaatgagggaagaaaacttattactccaaaaatgtttccaggtagtattaggtctcccacctgaaagaaatactcaagcaagagttgtcctgcgttcgggctgccctaaattaactccctctcagaaatctgttctcttcctatatgtgagctttgagcctaatgaggctgtacctaatgagtgtctctgcagcagccttgcaacaagaattggcaaaatggaagtgcgggtaccagtgtgcctgcccctccctcacctgcccctgacatgtcctgctggtcaccaggcaggacggcagctccatttagctgatcacctaaacagaggtggcccagggcctctgactgtggtgtttcttcagcacgaaacgctcttcactcattcacaaaacactgttgagcacctgctatgtgtctggcactgttgtagaagctgggggaactgcagtgaagtagtccaggtcctgccctcatagagtttacactctagcaggagacaacatagctctgtaatttgaggtcaggtgatgaatttaaaaattaaagcaggggccggcgtggtggcttacacctgtaatcccagcacctcgggaggccgaggtgggcagattacctgaggtcaggagttcgagaccaacctagccaacatgatgaaaccccatctctactaacaaaatacaaaaaaaattgcccggttatggtggcgtgcacgtgtaatcccagctactcctgaggctgaggcaggagtgggaaggaaaaagtggatataataggggtagtaactcatgtaggccctgtgggctgtggtcaggaccctggagttccttcccagcatatgggaaaaccactggatggctctgggcaaggaactaatctgactggatttatatatttttttttttttaaatacagggtctccgttgccgaggctggaatgcagtggcgcgatctcggctcactgcagcctctgcctcccaggctcaagtgatcctcccacctcagcctcccaagcagctgggactataggcgtgcaccaccacgcctggctaaaattatttatttatttgtttgtttgtttgtattttttgtggagaccaagtttctccctgtcgaactcctggactcaagtgatctgcccacactggccttggaaagtgttgggattacaggcacgagctaccgcacctggccttaccattttatttaaaagctcactttggagagaagccagttaggaggcaatggtggacaacaggtcagaagatgatgtaccttgagcgttccagggtcctggcctgagggagcaagcagcatgatgcccaatgaactagggttgttgtgtgcagagacaagagacccagggatagtggccagctccaccgggtgggagccatcgtgggtgccctgggtcctgccatgccctgtgatcctccgcaagcaggtctgagccgtgcaggggagagctgcaccaggactggggccgacaggccagcagggacaccctgaaggcttcagaaaccctggaacggagtttcacagggagccctgggagggctttaagtggtgatggtggaatctgatttttgttgttgttgttgttgagacagtcttgttctgtcacccaggctggagtgcaatggcatgatctcggcttactcaaacctccgcctcccgggttcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagccttcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagttcctctccccttttttctggtgctttcctcctgatgccttctagacaatcatttgcaccttttctttgtctccagttacatgttttaatcattggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaaagaggaagcagataccaagttcattttgaaaaataagagttcattttaggggcagactagctaagctcttttgcttagaaggagaaattaatattggcggactcaaatccagaaggaggaagcagatattaagttcattttgaaaaataggagttcaatttaggggcaggctaggtatcacccttttgagatatttaccaggagtgaggaccacatttcatattcagttgtaaggtacttttcataaccatggacagtgttttcttaaagtgtttctctttcttcccctattgtgttctttttatgtaaccagttaattttccaaattttattctgatagaaccagagtccttttattttttacataacatatctaattctgtttttctcttaaaggatgcttgctggttttgttttgttcatcactgaggatgagctaatgacagcttttaaaacatcccagcttgttttttacttggatatcatcatagagatccataccacagaagaaagaagtaggacttttatctctgaaaggattttagtgcataaactgtgacttccagcctgctagacttcatgctagtcttaggatctttgaatagccttaaattagctgcaggatccaggaagcttgctctgaaattcagttgacatggtaagaaccctactttaggccagatgtggtagctcacacctgtaatcccaatactttgggagggcgaggcgggtggatcacctgaggtcatgagttcaagaccagccttggcaacatggtgaaaacctgtctactaaaaatacaaaaattagctgggcatggtggtgcacacctgtaatcacagctactcaggaggccgaggcatgagaatcacttgaacctgggaggcggaggttgcggtgagccgagatcacgccactgcactccagcctgagcgacagagagagactccatctcaaaaataaataaataaataaaaactctactttacctattcagtgttcttttcttttatcccattctggcattttctgaagggttgcagagagcactggttgaagcctatcctgaagctaccttggtagaggagttaattgcaccaggagacctaatttcagaaaggtcacagattatattccaccctccacaaaagtaacctggaagatgagtaagtcctgtcctaaattttagtaccaaaaacagtgtttgctcaaagaaaaaatagtctagtagagaaaagcacaccctttggggtcagaccaccaggaatcacatacaaactctgaacctgaattttcttatctacacgaaggcagcatggctgtgagaacatgcagtgattttataaaactcctggcccataggtggcaggtattaataggaaatagctacgtaaatatacttcttctggacttaggtactgtttttgcattggtcacctctgcttttgaggtctcactcaagaaatctttgcccagaccaatgtcctggagagtttccccaacattttcttctagtattttcatagtttcaggtcttagctttaaatcttccatccattttgatttaatttttgtatatggcaagagttaggggtccagtttcattcttttgcatatggctatctagttttcccagcaccatttattgaagacattgtccttaccccaatgtatgctcttagcccctttgttgaaaatgagtttactgtaaatgcatagatttctttctggattttctctttttttttccattggtccgtgtgtcttgtttttatgcaagtcctatgctgttttggttattatagctttgtagtataatctgaagtcaggtaatgtgatttctccagttttgttccttttgctcaggatggctttggttattctgggtcttttgtggtttcatataaattttagaattttttcttctatctctgaagaatgtcattggtattttgatagggattgcatggaatctgtagattgctttgagcagtatggagatttttaacaattttaattctttgaatccatggccaacttgcttggatttggacttgctgtgccccctcacaaccctgagctagttacttgcccaccccaagcctccgcagctcatccttaaagggggttacgatgatatctgcctccctctttgagttgctatcagaattcagtgaggacatgcagatgagagttttaacaatatctgggcccctagtaagcactgacaaatgttaattattattgttacttgtaaaatgggcatgattatcccccactacctacctctgaggcacctatcgaacaccagagattttgtgtgttcgaaagactgtgcacacattattttaaaaagtacagaggacactgtcaatagcagtcattaacagggtggcaataaggaaatcctattgctgcctgaatggtgtgtccttgaacagtgcagaaactccctttgctgatacatctccaaggggcagggggtggggatacatcacaggaagtacctgctgccactgcaactcccatctaattttgcgacagtcacgaaatgcgtcacctactgcatgcaactgactgcgtcacatgagaggaagttggttttctgcaaagggtaacaactcaccggatcaggtcacacgggcgggtggacgcagagctccgactagccgcaagtccagcgctcttttgtgctgcttctttgtggaaggaaatgtgaagaaaacccagcgtcaccctgtaaaccagacaaaatacaaaacagtggagaagcccagagaaggcaaaacagattccggatatttctcttttaaaagtaaaatggcatcatggaagaaatttggccttccgaaagtggaggataaagtcatgttcaaggggaagaacagcaatacagcatctgcggcttagacatacagagctcgtctgtaatttggagtaagataggagtgggggcggagagggggaaggccatgccctttcagagattctgagaaactccaaccataaaagtccatgacaactcaagtgcagtacccgtgaccccatgtttgtcaggtaacaagctgggttttgacttttattttgctgcttctaactctggctgggcgccatgggagaagggcgggcagatcactctattgaatactccaggggacagtgttgcagactgggacccacccttcactagctgggtgacctgggacaatccccgtctccccatggacctcagtttccgtatctgtaaaatgaagtggatacaattctattcattcatttatataacaaatatttattcagcaacttatatgttgggcattgttctccctattggggattcagtgattttcagaacggagaaatgtctccctcctggagctcacgttggcatagatggctggcaagacagcttcccaccctcattggaaatgtgtccctctgcccgctccatggtgcctcatgccccaccacactgcctacctgctagacttttggcaaactggaccaccagttgtctggagattggaaagagcctacttttttgttgtaatccttctgttcctttttcccccttttaatgtaaatgttattaaaacataacatccacatagaaagtgcacatactgataaattttcaccaacagaaacacacatgtaaccagcacccacaccaagaaacaaaatatgactcacactgaagaaagaccccatgtccctctggtctctgatctccaccgtagggaaaaccatctccagatttctgatcctaggtattagttttgttctttttaactttgtctttgtatatacccttttgtatgtcagttctttcactcattgttatatttgtgaggtttattcatgttgcttcacattgtggtggtttgtttattctcgtatagtatttcattagacgaacgttcaacaatgtgtgcatttgactgtgaatggacgtacagattattttctgctggaggccatcgctgaatggtattgctgtgacgtgtggacctatcttagtgaacgtgtttgcttttcccaggggagttgctgtggcataggttatgtatacattccatttcagtacattctgctggttttccacaatgggtgtacaaagtaggttcccaccagcaatgtttgataatccagggagctgaacattttgcatcttttacgctgtagccattctggtaagtgtgtactggtatcacatggtgattttaatttgcatttctctggcatctaataaaatttgccaggggaccctgttccacttaaacatgacaattaaacagagccgtctgtccacgccaggtcttttcttcaaggatactgcagttttcttaggcatcccccgctttcacactagtagtaaaatgaagagacgttactatacacacttcttccacagcccctgactctggaactttatatttcaccagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtgggtgtgtgggcatgggctcatctttccggttccctttcatcttctcctatttgtatcagacatttatgggagaaatgctgcacctacttactgtggcagacagcccctctgaaggcaaggttcctgtattcaggggaaagggttatgcggaaatcaagaatgttcagtctaaggccccaccacgtgtattagctgatgcggggctttgaccaaagggctaagaatccaggggaaccttggctttgatgggagctgaatgttaccaggaggctcacctgttgcgggcaggtggcactgttagcctcccctttgagtttgcttcagttcatttaaattgtggccttggaaggcattgtatatacttggagtgtttctgctgcagctggcaccagtacatttagcacccggcccactggcgcccgcatgtagtattcagccaggggatgctcacctgtggattcattgcttgattcccacaggtatgggcgttcgaaacggaacagacaaagatgccgaggcgctcttcaagtgcttccgaagcctgggttttgacgtgattgtctataatgactgctcttgtgccaagatgcaagatctgcttaaaaaaggtgagtgctgccaggagtggtggctcatgcctgcaatcccagaactttgggaggccaaggtgggaggatcacttgaacccaggagtgcaagactagcctgggcaaaatggcaacaccctatcttgaaatttttttttttttttaagtagccaggcatgatggcatgtgcctgtagtcccagctacttgagaggctgaggtggaaggattgcttgagcctaggaggttaagggtgcagtgagccatgataacaccattgcactccagcctgggtgacagagtgaggccctgtcacaaaaaaagaaaagttgagcccttaccgcccctccatctatcttcttcctgtacccaagggaggcgatccgcccaccatggccaggcccatctcagaaggatgcctgtgcagggcagaggaatttcagtgtgagaaacctccctccctcttgaccagtccatacctgtcctggagtaggcaggtttccttgaggagccttcaatctctttgtaaaatgatgaaatcagcttaaagtccagcaaaagaaatagattatttgtatacagaatggtcacaatttcaaaagactcattcctgggaagtaacaaatctgtgtcatcctttctagaatgaagtgtaagcgtaaacttttcccttgtggcagatagagaataataattccatatactttagaactatgttattttttatatagcatgttcacaaaattatttcattagatctttaacagaagccctgcaatgttgggcaacagaatattatgctcattttataaatataggggtgggccacgtgtggtgtctcacacctgtaatcccagcagtttgggaggccaaggcaggaggattgcttgaggccaggagttcgagaccagcctggccaacatgatgaaaccccgtctctacttaaaaatacaaaaattagctaagtgtggcgacacacacctgtaatcacagctactcgggaggctgaggcatgagaatcacttgaacccgggaacccaggaggcagaggttgcagtgagccaagatggcaccactgcactgcagcctgggtgacagagcaggactctgtctcaaaaaaaaataataataataaaataaaaaataaaataaaagaaggggtggagcttcagagaggaagaaagatacactgaagggtgcagttagtaggggcagaaccgaaacccacgctctggtcttctaactccaggacaaatgcgtttcctattacacgaccctctctaatggatgccacctaaggtattctggcatttagggcaagtgtttgaaagtaacatcctatcaattcactagacacagacccacaggaagtagataggaacacaatctaaatcactgctatttttcttaacctcacagctaaaacaaaaaaagtccccaccatcttttttttttttaaaactaggcatttttcctaatttcctccaacttgactcttacaagctgaccttttgtaccctagtaggttatgtcctagaccagactagaaatcaggagtctgagatctgggtctggcccaagttctaacaggcaacccaggcaaggcaaccacatcatcctgatttttttgctttcctgaaaggcagattatgataccagctcctgctgtttcttggggatggagtgaggaagcctgtgagccaagaggaattttgtgagcgtgcttcgagaagtataatggcccagataggcatatgaacttgtcccaattgtagtttctgtttggtttttgtttgtttgttttgttttgttttgtttgagacggagtctcactctgtcgcccaggcttgagtgcagtggtgcaatctcggctcactgcaacctccacctcccgggttcaagcaattctcctgcctcagcctcccaggtagctggcattacagatgcgtgccaccatgcctggctaattttttttttttttttttagtagagatggggtattaccatgctggccaggctggtctcaaactcatgacctcatgatccgcctgccttggcctcccaaagtgctgggattacaggcgtgagccactgcgcccggccgtttctgttcttttgaaaggtgattcattctgcccaagtccagagcatgtcacaatcagagaattcttgcttattgtcctatcaaactagtaaagcacttattttttctgactttacatgcagtcagttccagtgaagacaaaactcccattttctaactgtcctaatttgtgtactcttaaaataagctaagaactccagctttcatcaccatcaccttgtacctctactgtcaaaactaatacaagaatcactggggagataatgcaaagtgtcttggtaattcgaatgggagaggccactcttactctgcctggaactggtgaggtagctggactttgcagtgtcctgggcttgaaaaacggccccaaggctccaacgtgttctaccacctttggggaaggttatgagacctctccgagattccatttttttaaatcagtgaaataaagataaatgaggcctacttccagtcttgtaggaattaaaaataactcatgtaaagtacctagatcagtgtctgcacatagtatttgctcaagaaattctaaatattattcctccccccctcattaatcagagagaagaagaaaggatatgtgtattagctagttataggttggtgcaaaagtaattgcggtttttggcattaaaagtaatggttagttcacctatagctggttagttagtatcatagaacctttggtgagttctagctgggccaactagctacatggtttatgattcctctcctcagtatcctaaatggacagccaagctagtatttttatttatttttctttaattttgtttaattgtggtaaaatacacataacgtaaaattaccatcataaccatttttaaatgtatagatcagaatgacttcacatggttgtgtcaccatcaccaccatccatctcaggctttctttcatcttccgtaactgaaactttatctccattaaacactaactggctatttccccttccctccagcccctggcaaccaccgttctatattctgtgatcttgactactcaaggtacctcctgaaagtggaatcatgcgatgcttgccctttagtgactggcttattgcacttagcgtaatattttattctctttaacaaacacttgcatgatgcttattatgtggcgtgttttacaaatattaactcatttaatgagttaatattgatcttcaatgtacagataaggaaatcaaggcacaaaatggttcagtaacattcctgatgtcacagaactagccaacagcagggccacacacatcagcccccatacactgtacctatccctctctcttaacgtcttagataagtctgatcctttgaaaggagcccagtccccagctcctcccctcccctcccttgtaaccctctaatagtcagaggcagctgccaggctgcctctgaaaatgctgcatctgaggctccccagaacttagaccttaattcttcaatgttcgtattatttgcttgcagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggtaatctcttttcaatgccaatacacttgaaaatgggaaagattgcagagtgacggggatggcatcatttttacaaatccaaatgctgcttccatattcaaattagggttttatttttctgggaaagattacagagtgacggggatggcatcatttttacaaatccaaatgctgcttccatattcaaattagggttttatttttctatctctgaatggttagcatatgtgtttccactggatcacaaattatgaaggtttctttttttttttctttgagatggaatcttgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcattgagctcctaagtatgccaggcacagttctaggtatcaggacacagcagtgaacagcacgtacatttctgttcccaactgcatagaatgatgtctgctttgatatttaggcttgccgagggaccgagcttgatgatggcatccaggccgactcggggcccatcaatgacacagatgctaatcctcgatacaagatcccagtggaagctgacttcctcttcgcctattccacggttccaggtatcatgtccattgtctgccaagcatacttcagtccattccatcatcaaaacacagatttggggactgtattcgtttcctcttgctgcagtaatacattactacaaacacagtggcttaaaatacacaaatgtattatcttgcagttctggaggtcagaattccaaaataggttggcagggctacgttccttttggaggctcaagggaaaatccatttcccagcctttacgtggcatgttagaaccacctgcattccttggctgtggccccttccttcatcttcaaagccagcaactttgcatctctctgacccttctgtcgtttaccgtgctctctttctgaccacagctgagaaaggacacctgtgattagatggaacccacctggatgctccaggatcatctccccatgtcaatccgatacccttaaccacatctgcaaagtcctttcttccacataaggtttcatgttcataggttccagggttagggcgtggacatctttgggcaccattattctgcctaccacagaaatgcattcacttttctctccaggaaagctgaattctctcatttgttattattattattgttttagtagttataaggacaaacatttctgtagtactttgcaatatagagtatctttcatgtgttttttctcatatacaataataccgtaagtatttaggaaaggtgttattcctgtcctgattttacaggtaaaataaaagaatttttagtttggatgaatctaagtgatatgcctaaggtcaggtagagatttcagtgcacagtagagctgtgagtcagccaaggttcctttacacggcagcctgtacacagataccagaaaacgccagcaatgggcaagcctactcactaccaagcactacatttgactgaatctgttcaatgaaagtccttcctttgttttgggtacaaaccagcactaagttagaattttcccagctgtaatagtagttgtgtcaagtatttggcacaagggtactggttacagtaaataggttgatgtgtttggaaaaccagctctggcaggatctacagatgagattttgtgagagcgataacttcacaagttttaaggatggcataagatcgaaaataatttggtctttctgctcttgagagggaggtggtgtaatgggggcatatgtctgtgtaaacaaacccagtggtagagttgtagttgctctgagcaaggaggcagttgagaaaagctatgttaaaaaggagctgctgggccgggcacggtggctcacgtctgtaatccgagcactttgggaggccagggcaggtggatctcaaggtcaggagattgagaccatcctggctaacacagtgaaaccccatctctactaaaaatacaaaaaaaaaaaaaaatagctgggcatggtggtgggcgcctgtaatcccagctactcgggaggctgaggcaggagaatggcgtgaacttgggaggcggagcttgcagtgagccaagatcgcaccactgcactccagcctgggcaacagagcaagactccgtctcaaaaaaaaaaaaaaaaaaaaaaggagctgctataactgagcctaaaatttcaaacaacataggtaaaagaaggatggcttgtcagacggagtgctgaggggctggatagcccagtgcatttggtaaaactcggggctggatctcagggtatatcagtcttcttgggctgctatagcaaaataccttagacaaggtggcttaaacaacagacatttatttctctaagttatggatgctgggaagtccaagatcaaggtgccggctaagttgctttctggtgagggctccctttctagctcataaatggtcacgttcttgctatagcctcatatggcagagattgagagcaagactgagtgaggtctgttgtgtctcttcttataaggacaccaatcctcttggatcagagccctaccctagtgacctcattggaccttaattacctccataaagaccctgcctctaaacacagtcacattatggggtgcggcttcaataaatgaattttgggaagacatagttcagtccatagcaagggatatgacagggcatggccagggtcaaaccaggacaggtaggcaagtggccctgtcatggtggaacctgtgtgctatgtcaagcagcctgaactttactcagataaagtggcgcaagggaacggttttaggttagggagttataggatgagatttgccctcccgggtcatcaggctctcctggccctgcccctcagacaattgggcattcagcttccttgtgcctctagatttcttcagcaaggtccaactctactcctatgtatcccagcagcaggaacacatctcagaattccttgaggttctctgcaaattccttctctagtaggcttggattaggaagtagcactgacccctaaaggatagtgaggagttccagagttatggaatagacctccagcatttcctttggaagtctgcacatgcagatctgtctcacacccacgtatctgatatttatcaggtgggtacgtccatcaaaactgacacaagagagtaccctggcaacatccaccaatgctggcccttagtgatgctgtctgtcatgggatttccatgctgaaatactcaaagcattttctagcatcttcatgccagccgttaaatctcagatgtttgctctctgagcacaccagcataattctcattaatgacttgtgtgcagagtagagtgaaatagtttctgaaaagcaggtgtgaaagtgccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagagctggaaatcatgcaaatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacctctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaaccagtccagtttgctttccttttgaagttatttatggcaatggagaaatgagaaaagagaaaacaggataagaattgaccctattggctgggcgcagtggctcatgcctgtaatcccagcactttgggaggccaaggtgggtggatcatttgaggtcaggagttcgagaccagcctggccaacatgatgaaaccccacttctactaaaaatacaaaaaaattagccaggtgtgatggtgggcacctgtagtcccagctgctcaggaggctgaggcaggacaatcgcttgaacccaggaagtggaggttgcagtgagccgagatcgagccactgcactccagcctaggcgacagagtgagactctgtctcaaaaaaaaaaaaaagaagaagaagatttgaccctattgacttgacctcaacacataatatataatttttttgaagtgagtacactagtaagtaaattatcacttgggaagccaggactcttcacataaagggttaatcaatttagaaagatgtttgtgatgggctgccatttattaattttggcaataaaatcaggtaacataaaagtatcttctttcaaataagaaaactaattttgggtgtgtttactagacttgtccttggtttcctgccatctaaaatatgccacatgttcaaaattggagatcataacagacatctacactactattcccagaattcacaggctgttctttggaaaataagctatctaataaaggtctctatcacagaaatcaaagggcctaagtgcattgcaatttgaagtaaacaccatacaatctacttatttgccttgtaaccttcattaaagggaaagaaatgctcccaagtgtcaggattaatttttcctgaattctctgggaagttaaaccttacagataatgaatattaccttatatcccttagacttttaataaagagtcttagtccttgaatacttccatgggcagacacttatttattgagatcagaaatccgagttcaacttgggaatgtgttcagtgataccactttcattctaaactttccagactttttatattccgaaattctgaggacaagttaccctaaaggagaactcggtcctggtgaatatacattcccaattctcatcgttgttgagaaccccagttcctcctcacaggagtatcagacagggcactgcccttgtcctatgggaagacagtgcagactacagcatccccactggctttatgagctcaaagctggatttctgtttggattttcattttcctcagggtgccattaggttatttaaatttttagctattgggtcaggcacggtggctcatgcctgtaatcctagcactttgggaggccaatgcgggcagatcacttgaggtcaggagtttacaggagtttaagaccagcctgaccaacatggtgaaaccctgtcgctactaaaaatacaaaaattagccaggcaccagtggtgggcacctgtagtcccagctactccggaggctgagacaggagaatagcttgaacctgggaggcggaggttgcagtgagctgagatcttgtcactgcactctagcaacaaagcaagactccatctcaaaaaataaaaaaattaaaaaaaaatgaatgtattttttaaatatattaactattaatacattcacagacagctttgggctctgccctgggctttttctctgagcaaatttccacaagctgtcatcagccaatgtgtttatgaactgctacaaatcggtctgaaagtcctgcggtcactgaatttacatgatttaaaacctcgaggaaaccaaggcctctctgtgagaaagaaaacaacatccaccaaaatgtcctagacactggctgacaaatcccttattttgcccagtcttgcagtgcgtcacctgaaatcttttattaccagctactctggtgaccaaggattgattgcctttgacttcctcgaagcacaccattttt
